United States Patent 8,071,291 (GENETIC POLYMORPHISMS ASSOCIATED WITH VENOUS THROMBOSIS, METHODS OF DETECTION AND USES THEREOF) - sequence listing, part 6

SEQ ID NO: 534 - DNA, 603336 bp, Homo sapiens
attttcatctattattctaataacttttaataaatctctgtaaaaacatcaaaaattctataagcccataacattttaactgctcttgtctgtctcatcttgttctttcctgtccctttaataggtagctaagtatgatttcacttcactaattcagacacaaataatgtgaaagatggtataattcagagaacacctgggctgtcctttatctttgcttagtaaactgttttttccttcagggacatgaaagctaacgttagcctggcacacatgattctgatttctgaattggtggtgcttgaattaatgacatttttctgaagcaaaggaaattaaatagtgcactttattgttccactggcacatattgttacatatcctgagcaaacctattttagtgtatgtgtcgtgctaaagactgaataccagccaatgtctgtagctatctgatacgtgactgtttactcctctattgaatggggtttatcatttgtttggagtaagaggataggccttgattgaaacaataaatatttatgataaaagaaaacgagtccctttttgacagggacctaggctcaggcataaactgacaattagactcaagtggtgaattaaattaatgaatagttagcctttataatacaaatgcaaatagagctctaatttccaagttggctagttgtttttttctgcctaatattccattctttataactcagttttaaataatagttgcttgaggtatattactgtgttgtgtcattgtgagttttatgcagttggaaattttataagtttgagttaatctgtaattttaatagtttgtaagtttattttttcttgatttttgttatttttctttagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttacctaatttgtcttgaaatattccttataattccttataaaatattcagagactgatgctattaataaaccaaataaaggattgatgattatcttatcggagtgattccctggaaaaggtaagtgcttttctgattttattgctgtccaagttcccggttgatgagcctacttcctgtcttctttggctggccttttattcatcaagtttttttttttttttttcaccttttctttcccaacatgagcatccttgctattttccagtacgtaatcacttgcacctttacagaaaggtcatatccttgctgtatctaaaatattgccatgctaacatattgtaagatgctgagtcaaggtagaaaaatgcacaatatatttccaagtgtgcagctctcttcagaaaaaaaaaaagtgtgtcagcaagcccaaaaggaacatgacagcttatcaaatacttattcatttcctctgaaatttgttcttaagagataaggtcagtagggagacaagcttaggtaattgtctgtttggctgttacaggcagggaacctttgtggtagtgcacaggtagaataagtctatagagaatgcctctgattaagtcctctgctataaataaagggctggatttaagatattctttcgggtagaatggacacagaattaaaaatgtgagaaacagctttaaactctgttaataatgtttcaacatcagcttatgttttatttgattcacttcgttaagcttagaatccaaagtctactactagtaaaacccagatttgcccttgagcatttcaaggttataggatgcctggtcttcctgttaggatgctatacattcaactttgacacctatgttttctcttgcagtaaatgggataccactattttgtagtttgcaactaggggggaagttaaactacccagtttggacattttcctaatttggggtgattggccaaacttgtagtaaaaggctgaattcttatcattaggtcatttagttcttaaatgaagattttttttttaatgtagcaagatataataaggctgactaactggatagagtccattaacatatatggaattgagatatatatatacatcttggttgcacacatacacgcagaaatagaactgttttctcacaagatgacaaaaggctatactacgtatcacattcagtattggacagagagagtaaaagcaggaatgcataagaactgatttttttttctttttctttttttagtcacctggtgggccatttaaacattttatttatttattttttaatttttattttactttaagttctgggatgcatgcgctgaatgtgcagatttgttacataggttacatgtgccatggtggtttgctgcaccatcaacccgtcatctaagttttaagctctgcacgcattaggtatttgtcccaatgctctccctccccttgccgcccaccgcctgacaggccccagtgtgtgatgttcccctccctgtgtctatgtgttctcattgttcaactcccactgtttttcatctttgtcactgattatccacgtgaccttaggtaagtcagtctgttactgttactgcatttgccaagtaggaataattaagtcgtactaacctcacaagattattaaggtacaataatttacatatatgtgtgtgcgtaattacatatatgtataactttaaggtagtaatattactgaatgtttaaataacattgactgatagtcacagatctctaaaagggagggtgaatagggaaggaatatacaaacgtctcctattataattctctctctataggagctcctgcccttttaaaaaataccctgagtgtgaggtgggatgcatattttgaaaaaaatttccagatgattgatactaacaaccccctacccccattgttttttactgatgggttgtgttgagatgatcaaggttgtcttctgctccatgagtcttttcactctctctctctctctctctctctctctctctctctatatatatatatatatatatatatacacacacacacacacacagacacacacacacacacacacacacataaaaaagcagcagggcattttgaagtggtgtaaattgcaggattccaagtttcagtaatgggttgtttggactacatgtgctccgcgagtatcaagatgaatttttgaagatctgttggccagatttcccagcgtcacttgtaaatgtcttcttgtgaaaaacaagtgccaaatggcaattgtaattgcataggatttttttagtgtttcatgattgcctcccctccctgacacccttccccactggctgctgccccaacatccattattttttgccagtgcatttggacaccctgaactcctatatatctctcccaccccgtttttataattttttattttctttctattgctgagaaaggcaccaaaaggagagggaagcctttttaaaggaagtcacagcctagaggcatttaaatttgcagcagctactcttctttgtttattaaatggtcacttgtgtcagagatcctatttgtatgaaaaataaaaatgaagagctgtctgcctaggattagtgactttttgatttctgtacctgcattttcaagatggtgtggttttattgttccctgttagtgagccacttgtcctatctaaggtgaccagactgatttgagaatgcagtttggcgcataaataaaatgggacacatttttcattggcaattttattttttaaaaatgaaatattcaaagtacttttctttcaaatatcaacacataatgtttaactttaaatatttacagcatgttgttgtgatgctcttgtagaaaaatgcatgcttctggcctgaaagccagagcaaaatgcaaaagaccatttaactgcagccagagaacatgaacctgtacagtatccagtcacttttcagcacaggagagcaggaatacaaaattggaacctattgtttcctagcaacatggctcagaccattataacacaattttcaatatgattagaacctctacctgttgttatacagaaactgaaaacttggcatacactgtaaacatctttacttttcatgagaaagtaagcagctaaaaagaatgtttttctgacataaaggctatacttctctttttcgccttctttcttactgatgcttttgccagaagaatagtaaagatttagacgttgtcatgattcatacaagtaaaatatttttcaaggacacaatctgatatactaacatttatttaagaggttaaagtccaccactaaatctaaggaaagatttttaactgccaaacacatttcctttgacaaataatgtaagatgacaactgccaagacaaaatccacagcaagtttaactctaagtattttcagttactgtttagaaagtaatttcttcttatgaacagtagtatatttggtccttaatagctttcacatgaaggacacactgaaaataatagtcactatttatggttgaattcttttttgttgtttgttttctgtatttttaaattttactttgcttttttttgtttttttgttttttgcgctttttttgttttttttgttttgttttgttttgttttgttttctttgcagaagaaagaacctttatagaaggctgtggaagagctgaagtactagtcaggtcagctatgtgtatgtgaatttcttcaagaaaacaggaatgttccattccatctgtagccttatgtctttccacaagctatatataatatgctccaatgtctccaaaattttcttttcaatacttcgttactgtacttttgcttctattaccaatgaactccattacaatcacccttacatgaacacatcttcataaatgcaaaaactttgccctgactctcttaagtgatattatagtggggcctggtctagttaaaaatatatttttaaagaaaaaaaaaagaaaaagagtcaaaataacatgatggaatgcttgaaactgtgtcaacagtgatgaaaatgtctcatgaaaattataacttaatttcatacctgtctacataggtagcatgtgaattccaaattatacattgtcaagttttcatacatttggctatgttgtatatattatatatatgtagtctatatattatagatcttctagataaattgacagtaaaggacacacttattttatacattttttgggttaaaaataaatcatatacttatttatatggtaaaagtgttttgttgcaagttagtatgaattgagatttatttccctttccttcaggagtcatgcttctaatcaataacgattagaatgacaactaaaagtaaacatatttaaatgtgttaaactttgaacttttcagttcatttggatctctagactgtagtgcaagagtgaaaacaaaacaaaacagaaaagcacaaacaaaatgggcttaagtaggaaaaagaaacaaccatggagtattccctgcctccagcccagaatgttcttcataggagagtccaactactatgctctcactttaacttactcgaatggtgtgtggctgtgcagtgtcagccatctgtctgctgggtatgagaaattcatatgtttctctgaaaaatgcttttactttcatcaggaaatgcaaacgaattgttctttcaataatttaaactgcagaactgcaagtcaatgaaggcattctttctattcagctgaataggaagtgatatactcaatatctccatcttcttcttaagaaatgccaaaatgtttctcttcgatttactactgattagtagttttgttttttttttctttcctccctcaagctttaggagttgtaaaaagaataataatagttcaaggcagtattaaaaccacagctgtaagtaataaaaagtgcatttcctgaatataatacaaatgtaactttaacaaactaaaggcacgaaccaaccaaatacgtattacaaactagaaatgcacagttcaaggtaatcactattaagtaaaagcttcaaatatttgtttctaatggatatttaaagcagtttgaaaatgatacatcatcaatgaattgcaaaaacgtataattgcttaaaatataagcaaaatagactctaatattgacattttggatttgtgataaaatacataatcacatttatgaatgcactctctatatacagttcacaaattatttttccattaatttaaaagaacatcagaggttctaggaacttaaggtccatttttaggttggtgtggaggtattcaaattttcaacaagtttgttagtaattttagaattccattctgaataaatactgtaccattaatacaggcctgattcagaaaaaacccaataatatgattttagtatggattagcaatatatcaagctggtgtgtttccagttataaagagagatgagttcctcatgaattctgtctctcagaatacatgtgtaagtggtattctaacccgaaggttttgaaaatgaaatgtttgaatacacccttccctactgtttgccagggtcatttcctttcccttgctttcctttgtgtagtaggaggcagactcttgaaaaaccttaacatgagcttatgactttgcatattttcaaagaaactgtcatcgcaaagcaaggcaatgaccccacactgcatttaggtagcatctggaaagaatccaaactaacattccatcataaatttgccttcagacatagcaaatgttcagattcggtgatgaaagtgcagaagctggctcaggggaattttctacgggccacattgtgctgtcatgtattttcatttgtggtaacttacaattacacagcattttacaaactatctctttgtcactgggcacaaatcttccagctcaccaaggggcttgttttactgcaggattcctagagattgagaaactgcagctgatattaacactaatcctgacctttctccaaattttaaatgatcgcagaacaaataacccgtcctggaaaatagttattttcctaggcagtagagacgattaaataaagataaatgggtaagtacggagaacgaaaataactaactgtataaattattttagtaaaaatgagtctgcctctctatagttagttgaaatgttttcggttggaaaggatttacttgattcgatttcctgaagatggctgggagatgttcaatacagaattgtacatttgaaagataaatctaagtgggctgaaacaatgtggcagcaactgctgtgatgtttggtctggtcttccctttagtactttcacttaagtaccaggtctatttttttaaggttttggctcttatgaatttctgcagtagtagttaatgtatgtatcggcatcccagacacgtatgcctgctaaagcctttgtttgtttttgtaccagaatcatacttttaagtaaattaccgttcatgtgcacaaaaccattgggtcagtgtatagatactgaatcactaatgtgaaactatgaccaaaacacatcctatatataaatgagaaattcctacccaggttaataaaagctatgtttacatgataccaatacagctgaacaacttttagtaaaaaattgagtcaaaacaggtcgtgtgagagaggtcacgctggccagctgctttggtatcatgtacacacgagcaaatagcggctatacagtctggttaccacacccacagggaagcatggtagacagaacccagccaccacacgccaaaacacagcacaacaatatggcatttactttaacaagcaaggaggaataatcaagaaggaagggcaattgggtcctcactctaggagatggtggctgaagacattttacacctgtttttaagtttcctataacagatctggaaaacgtcaaagggctggcagtctttcgaaaggcaagtttcagatactattgcaccacctattcaaatagcccgtaagttctgccaacagttaaggatgaaactgcttctcacaatagagatagagaaccttgggttctttctggatattggaacatatgcatggctcggcaaattgaaagtggtgctttctgaaaactgtttttagctgtttgagttctacttgtgttattttgaatactgccacacaagaactaaaaatctctgtcatttcttaaagagtttaaacaaacaatattaaaataccatcttccgtcacattgaaaggcagttggatatgtttttcctccatatttacatatacagagttctgatctagaaaaccaatacaataaaccattttatgttttaaaaacaggcagtctttggtgacgcaaaggcagagatatttttgttacctcctgcctatttcgctctgtctcataaagtgaatattattggcactgtcagaaagttctaaatactgctcaacagacaaaacaaaatacccatcgtaaccttgtacccgcccagtgctcaaaagctgctgcttttccccttctgtccatgccctaatcccctcttccccctcttgcagccttctttgttccttagtccaggcctgggccactgcgcgctgtctggcaatctccaacacgtgattcttttcctcttcgacagttgtcccataccggatgttgaagcacagggctccatgctggagctgaatatctgcaaaccgtctagtcctcccattcaacacagaagtcatctgggacacagtgacattgacaccattctccagaatccgcctccccccagtgttaccgatgagcaccaggtcttcctccagagacccaagcttaatgaagtagtgagtgtccctcccctctatggtaaaatgtaggttttccaggtaatgggcattattgagaatggcagcaagccgcctgctatcttcattggctactcctataatatcagctgttactatgccatccttgatggcaaattttatacctttcccaaaaacagaagggacagcagcaaaccttggttgcttccctccttcaaggcaccgtccatcattgtatcggggagtcataggtagttggtccaaggaaatgaaattcctgagctgtttctggagttcacactgaatgcccaggatagtctaggaaagagaggcacagagcagatgcagcatggagttagacatctgtcagatacttggtgattgtggaaaggacaggcttgcaagtttgcttccttctctctttaatttgtcagtgagtgatttaaaaataagccagatttggaatctcttcatcagagatttggaaaagactaacaggtgactacctagcattcttatatcttggtggagttaagcataaggaaatacatttaaacttgaaatcacagaattgcagagctggaaggcactttaagttggtccagctctcccaaaacacagacattttattttcactgatttcactcacactgactagatgttattactacatgtagagtaatacttaggcacagtgaggcacaaagaaatgcataaggcatagttcctactttaaagagtttaagaccttataattaactatggcaaatcagccagaaattcattgatctttttatgtggacttaaaaaaaacctttttttttgggcaattttcaaacatactaagaaataaagagaaaagactaatgaacctccaagtatccattatgaagcttcagcaattttcaacattttgctaaatgttttttagaaggacttttaattacagaaagcatttacatctttacaaaaagggatgaatttataggacctatctagaacttcctgtcccttataattttttagacttaaatttcaaggcctcacacccaaatttcagttttattctatcaagcccattttgttttcgcaaacacagatattcatatttctttcagttgaaagaaaaagctccttattttcatttgtacctcatacttctggtgatatcatctgctgaatcttaaatgttttgatgttcctattttttctcaaaactgtacccttgtaatatttattatttttgcttcattgtgtttatgtattttttctttatcagaataattttattctgttattcccatgctcttaagacatcaacccctaaattattttacagttggaaatctgatgttttcgtgtctcttaccgaacaattttctctaggtagaatccataattgctcttggtagcccatttcagaatttttaaagtacagttcctctttcctcttatgtacctattgcagcagtcatcaagtaacctgttaatcttttttttcccccaaaactccaattctctgatcttttttctcatggagctttttttataccttctcattaattgtgcacgttttagtgaatattcaagaagactaaaaaatcagtaagcaaacatatgtatatataatttctgggtattgaatgcccttctgttgtttcagctaaaaggaggtgataaaacttttactaacctttccaggatcccactcttgagtttttgtctgaagccgtagaagctcgtaagttaattctaaattttctaattcaggtttgggaaatccaggtagtacattgtgtaattggaaaccaaatagctccaaccaacttctgatgtctgtgagacacaatattaaaaaaagaaaatgaaaaatcccatactttataagctttgttgaaaacttgaaagatacctctcctgccttcaaactgtttaggcaatagaagttaggaataaaactcctatttatttatttatttatttatttatttatttatttgacatagtctcactctgttgcccaggctggagtacagtggtgcaatcttggctcactgcaacctccacctcttgggttcaagcgattctcctgcctcagcctccttcctgagtagctgggattataggcatgtgctaatttttgtatttttagtagagatggggtttcaccatgttggccaggctggtctcaaactcctggcctcaagtgatctgcctgcctcagcctcccaatgctgggattacaggtgtgagccaccgcacccagcctaaaactcccctttatatggcccacactaaaacacctgatcctctctctacagggtagagtgttgatttgtggataaccctggattataatatcagcttatatgatgaaacaagaatcctgaatttttcttttacgaaattattcatataagcttgtaagagtaaaacacagaaacagctaaaaaatgtagtaggatgcaaaagtattatatgttaacatgcacgttttgctcactctagaaaactaaggaagacagcaaatgcacaataacttgcgggctaactgtcaggaagaggaagcatatttacaaaggcattgagattctgtgataaaatcaacagtactgagttactcaagtttagcttaaagttttaaatagtttaaatacctgtggtatactttgcaacatcttgaattttgccaactgggtagttattttcaaaggagtagaggttgaatggtttaggaaggaggttcaactgtttccatatgtgatgattaggcgttgtccatctgccagcaacaacatcataatccctttgccccaggtgcactaatttagtaaggaaatcatagagtcctccatgaaaaccaataatgacctgaaagtcagggtaagtgtcatgatagatatcgccataaggtgtgtatagtatctcctttatgacctgacctcggctgctgaacacagctagtggggtacctgtattatcacaggctacataatattcttcaccactgcttaactccatggcaataaggtgaccttggagatcataatacagagatgtaatctccgagcttgtgtggttgtacaaatgagtaactcttatggggttggtaaggtctgcataaaagaactgaaggtgctgccctaggctggacttactcgcgacacgtcgcccaagcccatcatagtaatactgcacagtccagccagaagccttattgtaggctttctgcagcaggccattagaattatattcaaaaatatcatttcccctctgcctcagaaagccatcttcatccattttatactgaatttctcctaatctggtgatgcggtctcggaggtcatatcggagaggagtaagacgagcactcttcccatggcttaagaggttgatgtttccattcagatcgtaactataacgccactgggttttgtcatttacagaaacagtctgaagttgcccatcagcatcgtattcatagaagtaccttgttatattggcatctactcctacccttatgtcacatattaccatgcggcccacattatcatattgaatggtcatccagtaggcaattgcctttaggatttcatattggacttcaatgacttgtccattggcactgaagattttggtgtgtttcatcactgtagtagttatgacctgatttaaatcgtaattaattacactgaattttccaaactgctctgttctgccagagacatcaacatatcggtaaagatctataggcaaaggggtttcattgattacagcttgcatgcttgtgactcggaaattgttgtagctgtagtcgaaccgtgcattcacaaggccttcttcactgaatctgaaaatctggcgtccaataagaggtcctgcaggaaccaaaacaaaaacagtaagaagctaggcgatcaatgtggaagagtcagaaaggtctagtgttattttatttagtactggtgcttttatattcataatacaatattagagactgatctctgatatcaaatgcctgggcatattacctcatggatatatattctcatagtggtaatcctcaaatataaaaaattaaaatactctatagttatagaaaattttaattatagaaactacagaagtaataacacatccagtagcccagggtgatgaaattgatacttcttgctataatcactgacaaaaatgctttcatttcatttaacctttgctacaaagtcagagggtcaggttttgacaaattccagcattaaagtaactggatttgggcattctataaacccaaagggtgaaatacattagaaagttctgacttgtgaagatattttgtcatcaactgaggcttataaaggttacacagggcttgagctagtttcagtgagacttatatcttgccgtttcatctttgagaagatttggtgctgagcaggaatgggtatacagttacactaggcacttggatttcaaattacttgagagctgaaagaaagaaatgcactatatgtttttaagaaatcagctttcatcagactataacatgctttacattttcaatgtcagataatttgataagtaaagtgaaagttgggttgaatgtgtgtagattaatgcttctatctcacactgtggtcagtaaaaatgtcataagaaaatagtgatgttgttgtacacaccaccactctttcacaacaaacctgtttgcctgtatctgattgtgcagatgaatccgtcatgcatcaggtgtattgtcttaatcactccagaagactcttcatatgttaatgtgacctgagtggtatcatagagaacctcagaaagccttgcttgcttggtgtacttgtataagactctgcgccctgtccccagatgcagggtctgtagcaatcggccatctcgactatagtcttggataaaagaagtgctactgtccggtggggtgtagatgttccggtagtagcccactgaaagcatggtttgtaagctgtgacgcaccatgctaggcatggtgactgagagcagacaatctggttggtcatactcaaagatgtaacgccgctggctgtgtaggagaagcatcacagactgaaacgagacaaaggcagaatagcatattatggacaactaaagttgaggcgactaaagaaaatacacattcatccattcaacacaaatcaatcaagcacttactgtgtgccagacactgtggcaaaccctagtggatacagtagtgcacaatagtggtgtctatcttcatgaaatttacagttttaatggaggagaaagacaagtaaccaagcaattacaatatagtgtgaaatgtgttatgacaggggagttacagagtgcttctggaaggcagaggaagaccagcttactcagacttgagagaccagaaaaggcttcttggataaagtggcatctgagttgagacataaagattgcctagggattgtccaggtgaaggcagggagccgggggcaggggtagggaaagagtattcttggcagagagcacagccttgtgagggtctggatatgaaaaagaacacggctttttcagagaatgagagaaattttgtgtggctagaacttgagtatgttgggagtggtgggaatggcaggagatgacgtcagctatgtaggctgagtccagatcatgctaggctttctaagccacactaaggagtttggattcaagtatgttggcaacagggagtcatcgaagggtttctattttatttcatttttttagagccagggtctcacggtgttgcccaggctggagtgcagtggtgtagtcatagctcactgcagcctcgaactcctgagcttaggctatcctcctgtctcagcctcctgagtaactgggactaccaatgtgtgccactgcatctggcactcttgaagggttttaagcaagttaagggacggttgcaagagggcacttgcaagctgggagaaactgtcaagttggtattttagaaaggttacttcaacgtgcatatgtttcagaggaaggtaaatggatggcagggcatttcacaaattaatttatagttatcataaagtattgattgacttcacatactagatgtcttcctaaaaattgtgcataaaatattattatggcactattaatgttttgcaattgatgttttaacttcacatttccatttgtgttttaatattagggaagcatgtcattaaaactgaatgattctctggttatgcagcccctctcccccaaactgatctgtattttagaaacagttgtttgttgaggtataatgcaggtaacaggtgtttcataaatattgattgtcttgttttaattctaaatgcagacataaaaggagcactgttttagggaggactctaattgactgacatgtgcatctcatcttttaataaaaataaaaatttctcatccttggagattctgatatgactccctagaggagctttatccttcccctttagaaaattaccttttcaagcaaagagatttagttgagggttatttattcaagtttgtgttatgaaaacaataggtatattttcattttctaagcacaaattatataaatatttatgaatgtgaattacacaagtatatgtaatgtacatttatatcttctaaatatgacattacattctaatattgaatgtgctttctgaaactgcatatcctccctacccttctgagaattattgactttgaattgcatttcagtaccatgaagtcaaagtcagtggttatttgctcatttgttcattctttcttttccaccaacattacgcctgcagagccagaggtgagtgcagaaatcctgtcaattcgtcacttgtggacaacctgcagcttgccacagcctacagttccaccactgtgacctctgaaaacctcctgaacaaaaggaaggagacttggaaatcctgaatgggcttggagacattaagggagaactgcctccctggaccaaggcagaattcaatagaaccagcaagaaattttcctatgaatgggaaagcaggtggcagggggcaggggtggaaaagctttgtacaggaattgtggaaaagcttttgcattatctctagtctgaaagtcacatttctcagttcctttccactctcttctgtcaacttgctgtgagtaaatgacatctgtcacctgtgacacgggccagggactatcaccatatggcccccacacattatctagtaccagcctgcctgggccatgccttttccagtcactgtaccagcctttccaagtatttatggcacgtcgttgttattctctcctctgttcccatcctcctgcctgcagtaaaccactgcctgaaccgtgttcctaggtggtgctgatgctgggctgtctcaaaagcccttagtctgtttcaaagcttcctgccaatggcaagaatgtggatgatgtgattagaaatcaaatgaatgtaactgttacattgccaaaataccatttagctctcatttggctgctttttcactttgggtgggcattattatcagtttgctcaaaaacagtgcttatgaatctatccaatgtccacaatgctgttataggataaaaggccatttcttattagtccaaataacagagtgggagacttttattcttttaattgattgtgaggttctaaaagagataattgtaaaagcaacaacaacagcaacagcaatcatggctgtatgcttatttgaacaagactagaaatgagagcagaaatttgaaaagttaaagcatttgaatgaccaccagatggcagtgtggggccacctggaagctgaagccaaagtcgtcgttctgtctctctaggcagcctctgaaagtgtcagccccaaagaggcaattgctgtaaatgtataaggctaaagtatcttattaaatgattataaaatatatttaaatgcattttaaaaatgaagttcataagaattattttaggaaactgaaaggtttacatttactctaatacaaaattttagcccacaagtcttcaaaatataattaactcagagaagtctcataaatcaagacagagaattaatgaccacatagagaaaatttaagaaacaataattgatttttttaatagggaagagatcattaagcaaccacagccattacccaaataattatttttctcctaatggctacaaccattgtgcatgaaaatgatatgcataagtttcacttactctagaagaagtcaaactattttcacaaaatttctgcgtgttaaggtgaaaaatctgctgctgctttttaatacatcgtgacacaggtatggcaagcgaattcacaaggtaataccagagtattttggggtgtaaaaagagaaatccattttaaagtttgagaattcttagtttaaaatatactacaagaacgagcctctttatccctgctctgcccctgtcatagtgggagaatgtgccacaaaggccatattaatgagaggactggaaagaacacaaggagatacaaaacctcaagtcagtgaaaaagttacatgttacatgggattttggtaaattcaatgttctttccctttttccctctagaatcacaatttcaaagatgctttaatttcctccctccctccctgcctccctcccttccttccttcttccctcccttactttcttctgctctttcttgttttgatttacctccaagtggcagtaagtgctagctagcatttaaattctctacttgggtgttttatattaagttatttcatttaattatatctattcagtgaattagttatgattactggtaataataatgttaataaaatcaattttatgacaaatgacttttggaaagtaaagaatcgttccataattatgcgttctgtaggttctgagttttgcataacaggactgcttaaatcagtagctacccttttaattagagaacaaattaaatataaaatcaagaaaggaacaaaagtgaactcaaaggtacaaataagctggtttgtctcactggtcagaaagttaccaggacttgtcttgataccttattctgggtgaggaaggtcttatttttgtccactgcagacactggcagtctcaccgaggtttttgtttgtttgcttagcaattattgccaactacgtttttgtagcaaagagaacttgtgaagtttgcttcacgtgattctttgcttaagtaaatttgatggaataatcagtgaattcggaaaagagaaacaataaaatctcctcattggtgtcagagaagaggctaaataactgcacccagggatgaaattgaagttttcaataggctcttatgttattgtgcagatagtctaaagggaaagtcttttttttattattatactttaagttttagggtacatgtgcacaatgtgcaggttagttacgtatgtatacatgtgccatgctggtgcgctgcacccactaactcgtcatctagaggggaaagtcttatgagacctagatgtgactgtctataggcaattagctcagttggtcggactctggtgccaatgaggttggaattatgagtgcaatcctacgtatgcttctaaggagtgctggctacttaactagtcacatgggggacctgtggaaagattggtgcaaacctgtcttcctttctgaaaaactaactcagctaatattctgttagtgatcagtagcactgtttttttcatatgaaggtcatcaatatacaccttaagaaatactttgcctatgcacacataccagcaaatttttggattcagttaatgttgtaacaggcttggcattctgtaggcactagtcacacggttttgccaatcattcttgttaccaaaattcaaaagaggaaagacctgctctataagattcagattttgccagtgtagaggatagattatagatttgataaatatttctagcaaaaaaggacatgaggtggattcaccaaaggactccttccttttgccctggctcccaagtgaactctgcttcatctccaggcatttccaacttggtaaattctccagcaacaaactctgggaactagtaacatggtttgataatgacatataaccactggcacactatttttgtttaactttggggagggcgtatcagaaaagttgggcattatttggtaccaatagggaaatctgtcatgtgagctatgagctcctatgacttctctaagaacatctagaagctaccttgtactgattacccttgaattctcaagggaagccatttttcaatttttgtagaaattaatttaggactgatgaattcctaaatgtgttgaaagaatagatttgggaaacaagaggcactatcttaggagattagacattgagatagagatcaattactcttactgtcctctggtaccaatctggccagaaaccattttgctctgtaggggctgatgtttgacaaatggttcctgtagtgggattaaaatatttttctattattcccagacacaggccacaagctcccattatggatgctactggagactcagtgtacagaaaagagtattaccaatgaggccccactaccaccattcccgcaggctgattacttttggaaattagtcttcaaatgtatacaactaaaacttcactgactatcctaacaaaattagaattgcttatcctctgggtaaaaagccctttaccagagctgagtacattaacacaattttataattttctagctatttttccctcggtatgagctttcataataataaagataaccttttcaaaagcatgaacaaagatgttcaaatgaggagaaagctaagccgttattctgactttagtctgaaagagtacttggcagagtctgggactggggaaaattttcagctgaaaaacagtttatccttataagttcaacatctttttgttacttctacagaacagaacagctggaacacagacttttctcctgcaggtcctcaccaagatggacaattagggccattttcgatagtctcattcagaaacttgaaacttgtctttttcccctatgtacttactttttctaagtaggtatagctccaaattttcccatcagcccaagttcttgaaataattttcccactctggtcatattccattttttcattccacgttcctctttgaataaacgtcaccaatcccgaaggtgaatatgtgatgttcacttcattatatctgcttacaggagaccacagaatgggtcgcccagtctggtcataaagaattcgaagggtgaattttcgatggtcatcatagatctttcctgtgcgggttatatgatcaaaatctatggagagtaggtttctgttgtgggcctatgagaaagagatatgaaatacattttaagcacagccttgttcccctcattagagcactgacaatcatgaatcctttcctgattatccaacgatagagtctgtcttgcctctgaagcctcacggcttcacattccacagatgccacctgtctttattcctctaccacattgtacactctcagagagcagggctatgtcttaagtacttgaaatactctagactctcaataggtggttgttgattgctttttccccagctcaagccttaagtgcagtgccacagttttcagtaattatgtgatcttattttatgtaagtcagttgcctactaaggagtgggtattccttcacccttttcaccagtgaagtggccataacataaaagggtgaattatttgtgtgattagaaatcagacaaaaggaatacagtgagccccctctaacttatacagattcccttctttggtttcctcattcacctgggcttggagttttatatgatttcacacctattataggggaactcaggttgccttgccctctagttatggaatctcacttagcaatactttcacggaggcctgtaggtaaatgaactaagtgttggtaggtcccccagcattcacaagggcagcaccactaactgtggttaaagcacagagttaagtttggattccaagtttagaaacagtactttcacatgattctggttctagactttttctaccgtatggtagcattttctctgggcacctcaaaaccttgtagcagtcccagagtgatcctgattcaagggatcttgaactggattccatgaaagacagtattcaacggtgcctgactgataaaattcatctgggttcacacaagataaccaaataactaaatgacttagtaaaaaaaaaaaaagtttaaaaaatcagcagtgggacaactgacctgattttttccacgtttcagctggtagtgtcagtgtttgctagatctaccagtaacttctgctatgggtagctgattacaacacaatcacttagaaaatgcaatcctcaactgtttttttttgtgtgtgtgtgtttcagaaaaaaaaaaggtgttcttgattttagtcattaagaggttcagtccctgctggccagtgcactgaagaaggccctgtggaagaggggagctttgaagaaggcataggtggaaagtgcaggaaggaattttaaaatttattttattttagcttagctcagtttagttaagttttagttttagtgggttttatgttttgttgtgttaaaactttttatttttacatagtctgactcacaagaagttgcaaaaatggtagagttgctgtgtacccttcacccagcttttaggggacagacttctgatttgggtggagagagtcctagtgtatccggcaggaacaaaaacaagaatgaaaaaggagagactttgaggagtctaagtagcagtgaactgcagtcaggagacattcaaactagttacttgtctgtgcaccagtcatttcttccatctgcgccttagttttcttatctgtgaaacaagagtgatgttaccactttacaccacaaacttgtgctaagaattaaacgatattccatatacaggtacttggtaagctgtgaaacaacactagtaattgttatttgtataacataatgattacttttctcattttatttaggcttgtgaataggaccacatttcagattccaaggtgattgtagcttagtgtactagatttatatcggtaagagttgtcaacatgatcctgaatgaaatgttaaatatcttgttaatgaaggggaggagtgaaactcacattaggatttgactacattaatcatagtcagattaaactgattcactagctactcaactaaacttgatgttaattttaacttttgtggtcaaggatctgtttaactatctgaaagctatgcaatgtatcccaagaaaagtgcatataaaatgcatatatattaacatttttaatatactcttaggggggctttgaacctttctgaaaaacctaaacataaaaccttttcaggtctcaggaatccaagatcaacatcctggttcagaaagagttttgatcttagaggtctggatggctgcaaagctaatgctctcataccagactctggtcttcctttgttcagaatcttgtgctctttgctttaaaaagtaacctttccctcccacccccaaatataaaagagataactttttcatggcagaaaaattagaaatatagaaatgtacaaaggatataattacatgtaatccaaccatccaatgaaaatcactgttaacacttcactgtatttcatttcatttatcttacttttttggcataatctctgtgcatacatttaaaacatacaactaggattgtatttaaagttttgtgtcctactttttcagctaatgttttatctttagcattccttgtgttattcaatgttcttaaaatatactttttaatggttgcatgtcttactacatgataaacatttatttatctattctcccaattagaaatcagaaagtagtttttgtttttctctttcatattgcatgttttgctgaacatttttataagtaaatatttccataatacagaaccctatgagtgaaattactgggtcaaatgagacatgttaaaagacccctgatgcaacctgagagattactttatagtgcacagaggttgtataaattcatactcccattagctagtagtgggagaggctatctcagtccatccttactagcattgagtattatcagttaattaacttttcccaatatgagagtgggaaaatgatatgctgctgtggcttaaatttgcatttatttgattactactgaggctgaacactttttaacatctattggccacatgtgtatcttctataaattgtctgctcatgatatttgcccatttttctattggggtgtgacactttcctttttaaacctcttttggtttcagtttcttcattggtcagctggggctaatgttatttgcccttaattttgaacttctgaaaaaaaaaaaaagaagacctaccaaatgttccatgccatgaattgtatctggaagactagtggttagatgcttaaattatctgggggcaagtgccgtttgtgtcaggggtaggtttaattcagggagtacaaccacaaattgggactcttgactctttataccatctgtggccaatgcatgcagtgttgtcttgcatacatatacagccacctgttgttatgtgcttatgtgttgttatgtgcacctaaaaggtgataagaaaagcgcatatttcctgtcttttgatacaacgggcctggaagcctataggaaaccaggtgttcttgaactacccttcctgtggtttcacagccacatatctccaactgtaatactgttcatttacaatagctgtaaaatatccatgtactcccagagatggttgtaactgttgcaatttatgctataatgatagttaaagagccaaagtaacaagtgatttccagttcaactaaatttgtggttttatttgtctgatagattaagtttactactcaagaacacatttcttagtaaagtcattatagctacataagcagggatcactgtttaaaatccaccacaaagcaagcagaggacaactctgcctaatgttctttctctgcctgtcaagacgtctgccgctgtgcttctctgtttatggataatgcactctgatattccagtgctgctgaaacactagtttcaaagtcaggtttggaagttaatgtaaaattcggctaagagctaaaaaagaatgaaggaactgaagatgccacaggttcctccctgagtctcctggggaaaccatgtgtgagaagcctggcaaagagaatgcttttccagctgagcctctcccaaccttttttttttttttcgagccggagttttgctcttgtcacccaggctggagtgcaatggcacgatcttggctcactgcaacctccacttcctggttcaagcgattctcctgcctcagcctcccgagtagctgggattacaggtgcccgccaccacgcccagctaatttttttgtatttttagtagagacagggtttcgccatgttggccaggctggtctcgaactcctgacctcaggcaatccacccacctcaccctcccaaagtgctgggattacaggcatgagccaccacgccaggcctccaacctccttcttgagtgctcacgtgccaccagcctctatgataagaataagaactaggctgaacactacctactactgggtttgtgggcaaggctgagaaagctccacattcatacaagtgcttgctttcctgaaagatgatagcccttgacctaagtgtggaccatcaatctttatttccactcttgtttcagtattcaatctacactaatcctttccctggaaaagagaagggggggaaaaaaggattgaaatttgggaatagctccaagttaaaaagggtatctttggatagctgtgcattgaataaaacctttgagtttggcaactgacaggctgtgtggtgtggtaagaaaactgtttggtaataggtttttaataagggaagatggatctacgctgtaatgcatccttcggtttcccttatgtttttttcagctatactaggagacaggcctgattgttgttcatactaggaccagagaggaaagagggaagagtgtgctctggagagccacgaatagtgttgctggcagaaatgaaaaggcctgtaaaaagagggtatatggggaaaagcaaagccctttcctgctctttctgaggactttgtgttctaattgttcaagagaaaatcctttcaacccttctgatttgaaagtcgttcagttagaaaaataacattgtactacgttgatctaaaggcaattggtgatatttagctgtttttgacctacacaaagggcaatttgctatggttcaaccaactacacacttgcacacccacgcctgtgaatgtgctgaactctgagctatgatcactgcagttgattttctcccctccttaaggaggagaaggctgaattttcaagaacactgtcactagacaactgtgttacttgtttaatttttgctgaagaagttggaaggtaaataagtgagatgggccaaatagccacgtcagagtttggaagatcctgcatttaatttttttgtttttgtttttgtttttgagacagagtctcgctctgtcgcccaggctggagtgcaatggcatgatcttggctcaccacaacctccacctcccgggttcaagggattctcctgcctcagcctcctgagtagctgggattataggcacccgccaccatgcccggttaatttttgtatttttagtagagacggggtttcaccatgttggccagcctggtcttgaagtgacccagtgatccacccgcctcagcctcccaaagtcctgggattacaggtgtgagccaccgtgcccggcctcctgcatttaatttttatgaagttgtgagaatggatagaaaagtcacagttggggctgggcgcggtggctcacgtctgtaatcccagcactttgggaggcccaggcgggcggatcacaaggtcaggagatagagaccatcctggctaatgcggtgaaaccccatctctattaaaaatacaaaaaattagccgggcgtggtggcaggcgcctgtaatcccagctactcggaaggctgaggaaggagaactgctcgaacagaggagacggagcttgcagtgggccaagatcgcgccactgccctccagcctgggcgacagagcaagactcttaaaaaaaaaaaaaagtcacagttgatcttaaaaagtaccacatgctactttactctcactagttttaaggtaattagtatttgatttttagaaatcaatcactacattaattccacagatttttttttttattggtatctcttggtagacaatcaaaagcttacttaagcctacttttatttcacagagatgcctaccaatgaacagggcatatgttcagtactagcatcagcctctaatatttcacctggaattcccatttttttctttctttttgaaagagaactaaacttacttttaaaatagatggaataaatgtataatttctctagacattttattctttaaaaattatttcatatttaacaagaatcattgtatgacatttatgcaggattttctttttttctttttttttattttttggtgtatatgtgctttattattttaaaatcaactttatttggatagtttacacacagtaggagtcaccaattttaagcgtacaatttaatgagttttgacagtcattgaatcaggtaaccactaccacaatcgtgatagcatttccatcacccccaaaacttctcatttccctttacgtcaatttaacatccccaccaactgttttgtcccccatgcaggattttcaatcatttgtttacatagtgatagatttctagaaaagtttacatgacatcataataacctttgacacaaaactgcttgagttagaaggaacccttctgttcactcttatccgactacccactgtaatttacaatcacatacaactagttgtttctaattcttttgaagaatttgattcaataatataatgttttttactcccaagacactccctttactttgccagcatatagaaccttatcaacagaggggatcttaggaaatgggcttttgagccagactgcctgaattcaaatcctgtgatcactgcttactagctgtgtgacctctctgtgcctcagtttcttcatctgtaaaatgggaatgataatgataaacccatctggtaaggtgttataaatagtaaatgagttaatatgtggcagtatacatggtaaggcttcaaggaatgctaattgctgctgttatggttaatactaccactaataatatattgcaccatccatgtccctctttttatagatgagaaaagtgcaaaattatgggcataccagttcttcctcaaaatcatactcatttttctcacccaactttggctatattatttaccttggacattttttgcactatgctaatttgcccttgcttaagtactttgctgttgaccaattcatctgtgtaaccatacaacagatatttaaaatttttttataccaaatcattaatgctcatatacaggtgaaatggtatatgaaataattctttctttctagttatcttagtgaggttgatccaagattaacaaaaataggctaggcacggtgactcgtgcctgaagtcccagcactttaggaggctgaggtgggcggatggcttgagtccaggagttcaagaccagcctgggcaacatggcaagaccctgtctttacaaagaaacaaaaacaaaaattagccgagcacggtggcatgcgcctgtagtcccagctactcaggagactgaggtgggagattcgcttgagcccgggagttagaggctgcagtgagccaagatcgtgccactgcattccactctgggagacaaaaaacaaaaaaacaaaaacacaaccaaatatagcaggttctatgatttggaagccccaagaattcctggaccccaaaaatcaatactgcccagtagccttgatataggaaatctcctgtctccagggggctccttagggggaaaagcactgttacttgactgaaaactgcagatatatttttaaatagattaatctgattaatatatctccagtcaggctccttatctaaattttcacaaaataaatgcttccaccaaacctgaggagaaggaagttaaaatagtgtcaagtgaatgaaaatccaactctgagcaccctgtagctgaggaccaaggcaatttctcagaatagagggaaaggccagagccctcttggctgcccccaccaattccccatcatttgtcagcctgagaccctgtgttcaaccgagcttgtttctccttctcagctcacatctgaacactcacgtttcatttaaaaaccaacctaccctattctcagttatgtttgagtagaggaaaaaagtaaattgggagagttttagataagtccttgcttcatttcatttgtaaacacataataatcctacctgattttataattttggtcataaagtgctaagccccctccattgtttttcttttaataaaggaggctgcagttcagggattttgctataaccttacaactcagtctacaaaatcttataaacagctctgggatccaaagctgggatacatctcatatgacagcattgttatccatggacatagcaaggtacaaactggatgtagttcctaaaccagtatgcttttggtaaatgcccaattctttttacaattgcctctattgttatctgcactctaatttctctattgtccagggaaatgtatttatggggacagattgatgcagcagataagcagatacatggactagatgcaaaagtgccttgcaaggaaggaagatgagtcaaacacaactcaggttggagggaaatggattttttaaataaatgaaatttcaggatgttaatgtgacttatttcacttaatggagctggtgaaggatggctcagaggtaacaaatcccttgcctgctcaggctgagcagggtatcatgtttcccaaaagtttgcctccctcaccttaaaaaggatcctgacgttgcatgaaaaaaaatcactgattattctccaaagataggtctatccttttctgatttttttttctttccagctaaaaggtctgggggaggtgtgatcggcagcttttgggaacatttgacgtctatcatcttaccaaatgggcctttaaatgaacctgtcattttgtccttgaacaattagtgctttatggcctgcacacttgcaaattacaaccacacttttgtgtgggttttcaaaagggagccccatttcccacagtacagaaggggtttctatgttgtatgacttggaaattctgtctcaacagctctgatagctccacctgccctcagtctgaaatgacagcttcactagaagaaataaatgattcagtccaaggtattgaggaacttgagagcatcagagaagcttattctttggatgcttacaaatgggtcattgcatattttggtccaggaagagagaaaattggcatcagcttgtcccttgaaagctaccagaaatgaagggacgccatctcggaaataataacgtcagtgggggaagagaatttgctttgtcaaaattggattcacatgtcccttttgggagcatactcatttcattaaattggaaatgccaaatctggggaaattgaggcatcagcataaaaaaaatcactaggaatagggagatcgggtaaaaattaaccagttaagcagcctccttcctctttttgcctgcttcatgcttttcctgcctggaagccagccagttgtcctgtgcctcccacacttgccagtacattagagtcgattatttgtccctttttgtcagcattgaaatgaggagtcaggccctgccaaggtagctccactgagtggggcaatgatttatagattaattattttaaggaacaaggcagcacagtgtgatgcagtagaaagagtgccatgctaggtgaggacctgcattttagctctggctctgatccttaatagctggttgactttgggcaaatcacttaacctacctgggccttggtctccttatctgtaaattgaaagtaacaattgacagctgtggtgatcaaataaaatcctggctatgaaaccattttgttcactctgaggcactaaacatatgtaaatgattgttattgttattagacttctggggcatgccatggtaacaccacctggccaataaggggcctcatttttcagtcacaggacctcagggagtagcctagaagtgatatagagaagagggccttgaatttgttgcccttatagtccagtccgcaaatctgctcaactctgccacaggatcggaaatgggtcacattataattagtactaactaaacactttacttcttaacactaatgagctcccaaatgttttatgacaattagcttctcagcactaagaacaatttgggatatggggtgtaaattacagtttatagtttctctccattatctgtgcatatggaggacagaaaacaggatgggttgttctagaaaatggaaacttccaaggtcacataatataggatgagttatcctaaagaatgaaaaatcccaaagtcacatagtatatgatttggttcagaaagtttttttgaggctatatgctgggagaggtactaagaaatcatgtcttcaatacaatttttctgtgatgagtccatgaggtcgataagccatatgtagataattcttactttctctagtagtacacttttattttacaggtgaaaaaaaaaaatcaaggcatttcttaaagcgtttgtaaaatagggtatcaaggccaggttctctaacttccccatccagggttctacccaggaggtcctatttctcaaagaattccgatagaaatctttactgctacccacacattggtttgatatttggattggtttcacttctccattcagtggcatatctggtaaatattctgtcagaaacttgtcaatagaatcgaaacataaaaattgacttgtgcacatacaaatttcagtagctttataaaaaaaaaacccaaacaaaaccaaacaacaacaaaaaaaccacccactaaagtctgtggctgtgtgtcaccaagagaactgattgaaaagtgagcactggccgggcacggtggctcatgcctgtaatcccagcactttgggaggccgaggcaggtggatcacgaggtcaggagatcaagaccatcctggcgaacacggtgaaatcccgtctctactaaaaatacaaaaaagtagccgggtgtggtggcgggcacctgtagtcccagctacttgggaggctgaggcaggagaatggcgtgaacccgggaggcagagcttgcagtgagccgagatcgcaccactgcactccagcctgggcgacagagcaagactcttgtctcaaaaaaaaaaaaagaaaaaaaaaagaaaagtgagcactgctgtagattattttgttcatatcaagccatatgaccggtttgactgcctctctctggaattgggtggttgtttgggggttgcacttccacaaccttaaggttaccaaatttttgatatgagttctacatttcttttcaaataattaatatgtcagtatgttcaattctttgccttctacttttaaacttaacttcctcgtaaagcaacctttttcaattacctactccaccctgactcattccgattacctgctccaccctaaatcattcggatcacctgctctaccctaactcattcagattacctgctacctgctctgccctgactcccgccaaaacactcaccccgtcattctctttaaattagccaatcggaattagtttagtctgtgcggtctaaccctagccaataggggaacgacacagcaacacgtgcgtcagggataagagccccttcccctcccttgtccaagtgtgcactcaccattgctccatctgtaagggcgcacccttctatagaagtaacttgccttactgataattaaaaagaaaattttatattcgagtgctattccttttgcggcaccgaaactttatatataacagaaaccttcccggtatatcaggcgtgacacaggtgctcaaagcagatctggcctcaatagtgagtgattatttcccgcaggctggcagttgctctagggctgatattgaatgttactacatgtagaaagctggccacatcatcctaacactggttaacgttcaagaggaggcaggtagacagagtgctatggcgattgtaggctttgtgtgctgcagaaaagctgaccgaggtctcctggttaactctggtgaactgtgcttggtaaggactttaaaactccctaatctataacttcctccaggcagctctgagtacctcagcccaatctcagtaccagtcctttatccctctggccctggatatgtattcatggcaatgctataattcactgatttttcctcttgtctttgcccaaatgttgccttttgtctcacatccttttgtgtgtacctgcgaggtctttccaaagagctacctggaaagcagggacctcggtcaactcagtgaacctgatagacatctccagggcatgctgggaggggtgctggagggcctcctttgactaaacacatttctccagccagactttcttggtgaaattgctactattagagcactttagctggctaatgacaaagaaagctcctattagaatgctcatttaaggatactgaaccattatcggccattagcatcctcttttgaattagtatatcatataagccagtcagtcacttagaaaagctttggagaaatgggacttcagtttagggaggctctgcagttaaacaaacaaacaaacaaacaaacaaacaaacaaaacacctataaaagttctatatcttgtgtaaagtcaagccttaccctcagcctcctttcaaaagccgaaacattgcctttgttttgctccttcctctgccgccactcgatgaggtttgcattgtgctctccgggcaatgagatgttgcatttgcccagggtagggttgactgcccctgccaggatgtggggctctgagctgaggccgatctccatcccgctggcaaaagtgacacgcagggaaccatctggattcacccgataggtactttgagtattttctgtagacagaagagcaaaggaggaagagggggaaggaagggaagagcaggaagcagaaaagagacaggtttagttttaggaggcacgtttgggggataagcaggtggggtgctgtggtcctatctgccttctgggctagactaccgctctgacaggcaaacgtgttccctatccatttgggtcttgttattttcacagctggagtatctgtttcttggataaaagactcttgtctaacactgcaggctgtttttgtttttttcttttttcatttttaaagaattccctccctcactgacttgttggatcagcctcctcagtttgatatgctgggagctagaatgagaagagtgtgaagttcaacgtagcaccttaccacctgggcccaccatcacagttgccgtactccacaaaataccactaacaaaagttagtgtactcttagagtgtctggtgtcaccacctaacaacagaatgaggtcttaatgacagggcagagagaaagcaatttctctttgtgcacttgtcctctagcttctaagacattccaaatcctatctcccttccttcctttcttcttctgttcttccttacttttctgtcttcaaatataatgagtttttaattctctcatttcacttatattcttgcttggtctgtatcctaagattttcctttttcttcacccatgttggcattgatctagaatgccaagctcagctggagcccaggctccatttatttaatataacctagccagaccctgaaagacctttgcaaacagctgggtattgggaaataagttgatagcagagcagacttggcagggattgaacctcatgactcccacagagatgggcccaaagttgatgtgagaacttgtaaaaggtgtgaattttgtctgtgtttcaacttccatagctggaaaacaggaagagtacatcttctcagctagaggtgaattctgtttatgaatggtgtacgcaggtttcaaggtggatgttgacataggggctgttacagtcagatatcgttggaaacaatcttaccttgttttaaaatatatatggtactagttgccgtcaagttggttgacatgaggacattttcacggttggaagtatctagctccacttttgtcagcttctccaggtcactgtggaagctgctgacctctccagtgggaaacgttgcattggtcaggtgtccctcggggtcatacctgaggaatgtaaccaatcccagctttgaagcgtctcggcagtgataacaggactttgcaaaataaaaatcacttggcagctaatacagtttaactttgagtgataacaagtattattaaccttgttcaagaagaagaaaaaggtcagagagatgattaatcaaacgaaggtattttttgcagcttctgaattcttgataacttccttgagctgtgctgttttacagaaaaaatatatctggtaatgaatcaccagggtggaacactgatttatgaatcatgtcctgctgtgtgcaacgttgcagggaggcctccgtttgcgatttgggtcgatcccattagaggtgatggattacaaaacccagcagagggtgctgttgtcaaagcaaaagaaggtacaaaagggccctcaaaggctgagaagccaatatactgactttgggttatgatgggaaaattataatttgctgctgtttaagttgccaaatttgaaatgaatgaatcattcttccaacaaaatgaacaggcacagaggataatggaaacatgttcattaaaacattctggagccctctgatcttgatgtcacttaaattttaaaaatctttttagggtatagtacataaggttttgtaatttgtctatatgagtaagagacaaaaaataattacctgggataataggctataagctatatctagaaatatagtctagggagtttactttttccaaaaaaaaaaaaaaaaaaatcagaattattggcaatctcactgtcctccaaatgaaaactgcttccctgaaggcttttgatgtggagctgttcttttattgccaatagaaccatgaaaaataaacacttcattaaaagtaaacacatgtacttggaaacccattactgttttcttttcaagttgcaaattacaaaatatttaagcacttttatttgccttttaaaatgttaaacaattatattctttttacccaaaatgagcaggattcagcctggacacaatggtagagactggctgtactactccctcccccaacgattacacaaagtggcatagtaattcagtatcaatccattatattctaaaaaactcagcctgggtagttgctcaaattttaataactataccagcctttggaaggcttgggaaaagcagttggactgtactttataggacagacttgaacttgagcctatacataatgccacctaaagttcagttctgcatatacacgtgcgtgtgtgcacacacacatatatattatcagttaaaacagtcacatatgtgaatagaatgaatcaaataggttattgacatcacagatatgcctagccttagatgttaaattgggtgtctcctttgtttaaatggatttcagtcgaaatggttggcacagtgctattatgcagctaaggacgcgttatcaaagaaagactgaagagtgctgtttcttcctggggttaatggcaaaatccttccctctgcaaagactgcccacgttctgcctgctgtggggctctatagctacaagaagcagaagaacggagcataggaaggctcgaatacccactttagccccaaccttgtctgtttggtcttccatccaggggagaaaaacaataatatccagccttttttaaaaaaaattaattaatttttttgagacagtcttgctctgtcacccaggctggagtgcagtggtgtgatctcggctcactgcaacctccacctcccgggttcaagcaattctcgtgtcctagcctccctgagtagctgggattacaaacgagtaccactacatctggctaatttttgtatttttagtagagatgtgttttcgccatgttggccagactggtatccaactcctggcctcatgtgattccccctgcctcagcctcccaaagtgctggtattacaggcgtgagccaccacgcccggcccactgtccagccattattctcccaaggtagaggaggcaggagtttgcaggcagtagaccgaaggaagctgctgcatgcctttcttatcaggggaactgtggccccaacaacctggattatgcaggcacttcctctctgttccacatgaggcaccagcaactttgcctcattggtttccctttcctgatttctttctttctttctttcttttttacaatagtaaaactttttttttattattatactttaaattttagggtacatgtgcacaatgtgcaggttagttacatatgtatacatgtgccatgttggtgtgctgcacccgttaactcgtcatttaacattaggtgtatctcctaatgctatccctcccccctccccccaccccacaacaggccccagagtgtgatgttccccttcctgtgtccatgtgttctcattgttcaattcccacctatgagtgagaacatgcagtgtttggttttttgtccttgtgatagtttgctgagaatggtggtttacagcttcatccatgtccctacaaaggacatgaactcatcgttttttatggctgcatagtattccatggtgtatatgtgccatattttcttaatccagtctatcattattggacatttgggttggttccaagtctttgctattgtgaatagtgccgcaataaacatacgtgtgcatgtgtctttatagcagcatgatttatattccttcgggtatatacccagtaatgggatggctgggtcaaatggtatttctagttctagatccctgaggaattgccacactgacttccacaatggttgaactagtttacagtcccaccaccagtgtaaaagtgttcctatttctccaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattagaaaaagaggaagtcaaattgtccctgtttgcagatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggaactcttcaaggagaactacaaaccactgctcaatgaaataaaagaggatacaaacaaatggaagaacattccacgctcatgggtaggaagaatcaatatcgtgaaaatggccatactgcccaaggtaatttatagattcaatgccatccccatcaagctaccaatgactttcttcacagaattggaaaaaactactttaaagttcatgtggaaccaaaaaagagcccacatcgccaagtcaatcctaagccaaaagaacaaagctggaggcatcatgctacctgacttcaaactatactacaaggctacagtaaccaaaacagcatggtactggtaccaaaacagagatattgaccaatggaacagaacagagccctcagaaataatgctgcatatctacaactatctgatctttgacaaacctgacaaaaacaagaaatggggaaaggattccctatttaataaatggtgatgggaaaactggccagccatatgtagaaagctgaaactggatcccttccttacatcttacacaaaaactaattcaagatggattaaagacttaaatgttagacctaaaaccataaaaaaccctagaagaaaacctaggcattaccattcaggacataggcatgagcaaggacttcatgtctaaaacaccaaaagcaatggcaacgaaagccaaaattgagaaatggaatctaattaaactcaagagcttctgcacagcaaaagaaactaccatcagagtgaacaggcaacctacagaacgggagaaaatttttgcaatctactcatctgacaaagggctaatatccagaatctacaacgaaccccaacaaatttacaagaaaaaaacaaccctatcaacaagtgggcaaaggatatgaacagacacttctcaaaagaagacatttatgcagccaaaagacacatgaaaaaatgttcatcatcactggcctttcctgatttctaaagggattcctcaacccttgacaagctcactctatcattcctccaggaaagctgaacttagatgctgtggatgcaggttccacatggactttccagcttgggggcagtttccttcagtcacacagccccttgttttaagggaagatctcatgtaaagatatgagcagtggttatatccactcatcagagcaagatgacaagatcagataccaactgggccatccatgcataggggtacaagggtcaaaattcccaatgaacctttgcagtgacctgtggctaaatctggtttcctagtccacccacccaaacaccttttcagctaagttattggtggtctttgtctgataaacatttcaaagcttatttccaagagcacaggcatattcctacatattttgtacccatccctcctccccatattgacggtggtatattcagagaggcaagctaaagattcctagataagactgtaattacccagatagatttagctgggagactgcttggtgtatatgtgtgtgtttgtgtgtgtgtatgtgtgtgtgtgtgtgtgcacgcacgtgtgtgtgtgttttctggtgaaggaggcaatggtgttgggaataagatatttcccatgggtctgtccagttgttgggtagctggaaagttatattgcctcatttcctttctgtggccagagaggccaatgaaagtgtacatttgactgtaactccatgataaacaaagcaccccaactccaacacactcacataccccaattctgctagttcacagttaaagcaatcacatttaatggtatctgcagggtggtgtctctgatgctcaatatggccctggatcaaaacatacagatcccacctctcttctgttgggtcatttccaaaggaagaacaacaggcagatgtacacatcagcgggtaattcctacaactttggaaagattgctcaaagtggataagaaatagagcgagattttgatttcttatagcttacttgagttttttctgtcatcacaggggaatgcatctttccagactgagtgtcgaagaaacaagtttaatcaaaatctcttctgctgtgtgtttcccttcggtgcctccatcctttggtgcagagatacaagccgatatgctccaacgaatcccttcaggccacagcatgggagcaaacccaccctctttgcatgcagggcacagcactcacctaaccaggctgcaaattatagctgctgaattgtgccatcaggaaatgacagttgccttcatagccatcagaagtggatttggtaagaggagatttgttatcaaattgtcccttgctgtcctgattttacagagttccactgtgatggtctcagagggtaccagacagttaagtaatgagtacactcacccttttcctcagcactgtcataggctgtgtgcatgtgcacttgagtgagtgtgtgtgtgcatgtgcacacatgtgcaccccagtagagcaaaggaaacatttgtaaagaaaattcagaatccattcttgtccttgagaagcatatagtttagttggagagatgatatttacacatgattaaaaatatatttggcctggtattttctcataagggatagcttgccctttcctctgaggacaatttaagccagagttaaactgttcaagataaaactagaggctcccacacctttgctttaaaaaaaaattgcagataatagaagagaaattcattacttactcttttaaaggaaatatgaaagagtcagaccctctttacactttcatgtcagaaagctgaccaacctaataagaattctttaggaaatatgggattcccctttcctcactaataaattcctttggcttcctatgattcagttccaagtccataatgtccttctatcttcatttgtccttcattcaataaatatcagagtcttgtgctagggaccagggatacagtgctgaatgaaattcacagtctagtggggcagataagatatgcacacaaataactctaatgccagaatattgccatgaatttctgtaaagaagaaactagaatctcagaagaggcaaaggtcatttccagctgggctgagcagaataggaggaggaagagcagaagcaggtggtgtttgaatcctagaaggtaggtagagattgggaaggggaggaaggcattccaaatggaggtatgaagaaaggcacgctgactgatgggatgtctactgggggaccagcattgctggagcacagggttcctctaggagggtagtgagagataaggcttatacaataaagaagcatagacagtttttcaaggggataaaaggatgatccaaacagtgttttggtggcaatgagtcttggaaggggaggcaaggagcagggagaactgttaggaggctgcagacccagttcatatatgagaagatggtggtctgttgccttcgttaaatatattgtgattgcctatcattcagatttgtcttccccactagactgtacaactctcacatctttagagggaggacacagtgtctcattcatttttatattctccgtgtctggaacagagtagatctcactccatgtacttgttgaatgagtataaataggatgctgccagtgaaaaaaaggatgggggtggatatgagagccaatgtggttacagaacagacagaaccatcgatagtgcttctgggagggcacactcaggttacatagatgtgctatggagttcagcggaacttccctaccagcttctgttacttctgttcactctgtctttatttcagttcttcccagaaataccgacgataattctgttttactcactcttgatccttatcaagggcataaagcacaaggagaggtgactgagcaagggtgtcaactctctatttctaaagatctgaaggaacagccaacatttctatgttcttgtttaattgaaatcattcacctgcctggaggcatgtgcctgaaccatacaatgccttagttccttttctactctgggattctagaaggcattggaaacgtcacatgtgtttagaatgactgattattacataagcatttctgcatgggaatcgcatcctatccccaggcaaatatctcacccagagacatggcttgtttatcttgccccctaccccttctgatcttataagggagaagggggaatctgtcattagccatccatgataaaactgggcatttgtaaaacagtctagaagatacccagagatattatgaaggcttctccaacctgtcagtgggtggtgtttttgtttgtttgtttgtttgttttttgttttcttgatgggaggagaggatgtgttaataaagtctgaaaacagagaatgcagaagacgaaggatcaagagatcatgtaaacggagagtctccttcaagtgggagggcttcccacaaagggcaaggggcctgacgaaccgtcaactcagaatggaccagcagcagtgacacgactgatgctttggccttagtctgggaccttttcagtttagtagagcagaagcctttgccagggaaacaagcaagggcatcctggctacttttgcagccttgtggagaaaggcttgtctgctgtgcgagttgctaggcccctccctcagatctcagctgctgcggggttattacaattaggagcccacctgtgccgcctcaggccagtattcgtgccttgacaatcacttccttgttagctgtttctctgtggtcagcttttccccctgacacttgggacactcatgggcaatggtgcatcaaatactaacacttggggtgtgcaattttgatcctggtccaagtcaaatggaattatgaaaattagtgaactatgtaaacaacatcacactacctaataaaagcccaggcactaccactacacaagatgcattttaaaatcccatttggattatccactgttcagggtcatctatgtcatttttcctcctgatagctgcagataatagaaagttgaatggattagtgactggcctacctttacactgcagtcttccatcctgccaaatttcacttctgtttctgtttctctcatgctcctctcagagcagaacttatacttccacctgtgcaaacaatttgtccccttgtccacataaagaagcctcccttttacctcggggaattactcgagttcttttaggagggcctggtatcagtggtatagcagccttctaccgaccttagcactgctctgaccctgactagaagagtaggtcaaatgctgtgttctccaacttcagaaggacaagagaaaacttgaaggagtgctcagaactagccaaaggactagaggacaaaagtgaaaaaagtcagatattgtataaagactgtaggaggaattagtcacattatgaaggttggaaagttgctcatttctgtttacaggcaagaagggacaggagctgtgttttgttaaagactgctgttcagcaccagaatagactgcttcaggagaagaggtaccttctcctttcaacagatgctatttgaccaagagggtttcagtataattctggctggagttaagaaggtgggagaaagaacaaatggttattcagcctcccttttcatctcctggtgctacctattcctcttttactgctacttgaggggaaactttctagctctctagattttgtatggtcactctcgtaagcccacatgatcctctgttttctgttatcctgactctggataagccaactagcatgtgaatgggcacgttacttccctattctgggtttcggtttcttcatttgtaaaatgacatctaatgtctctttgtggccataaaatttcatgactacccccatgtggatgtctgtgtttctcatagcttagtggctcgagattggttactcaccaatgatgttagttgataccttttcactcactgttggccaaattctggtaacaggcctggaccccattcaccgtgagaatcttgcctaccacacagtgcctgcatcaatgtgatgccagtggaaaacaggcacacaaattgatatgacaacaaaattatcttctctcttcagcatcatcaattttcccctctatattagatcatttttatcagtatacaaatatgctgttatttctctcacttaaaaaactcttctgtttactctgtttctcctccagctctaatttctctgctctttacagcaaaactcctcaaaagagttctttactcactgtctcagtctctctcctcctagtcattctatattattattattgagatataattctcacaccataaaaatcaccattctaaattgtacaatccagtgacttacagtacatttgcaatgttgtgcaaccatcaccaccacttctagaacatttctatcacccccaagataaaccccatatgaattaaccgtcactccccattcattcttctccccagctcttggcaactacaaatctattttctgtctttatggatttgcctcttctagacatctcatataaatggaatcagaagggtcctttgtttctagattctttcactgagcataatgtttttgaggttcatccacattgtagtatgtatcagaacttcatttctttttatggctgaacactatttcatgacatggatatatcacattttgtttgtcttctcaccacttgataggcatttgagttgtttatatttctcagctattataaataatgttgctatgaaaatttgtgtatccattctctcttaagagaatattctactcaggctttggtccctcatgtgtcacagcgcctgctcttcacagtgctaaatcaagtggtcaattctaagtcctcatcttacttatcaggagtatttggcacagtggctcactctttcctcctggaatcacctgttttatttggtgctatggtctgaatttgtccccctaaattcaaatattgagactgaactgccgatgtgatagtactaacaggtgaggcctttaggaggtgattaggtcatgttgtctctgccttcatgaatgcaattagcaatcttacaaaagagctggagagagccagctaggtcccttttcactgtcccccttctgtcatataaggactcagcaggcagtgccattttggaagcagagagtagccctcaccagacactgactctgctggcatcttgaccttgaacttcccaacctccagaactgtgaaaaataaatttgttcttgattaattacccagtaaaaggtattttgttatagcagcacaaacagattaacacagttggcttccaggacattccactctcctagttttctttccacttcactggcctttccttctcagtgtcttttgctggttcctcttcataccctcaactcttttcttctctttctttttttttgaaacagagtttcgctcttgttgcccaggctggagtgcagtggcgccatctcagctcactgcaacctccacctcccgggttcaagtgattctcctgcctcaggcctcccaagtagctcggattacaggtacccgccaccacacccagctaattgtttgtatttttagtagagacggggtttcatcatgttggccaggttagtcttgaactcctgacctcaggtgatccacccgccttggcctcccaaagtgcagggattactggtgtgagccactgtgcctggcccatatcttcaattttaaacatggagtgcttcatggtcagtcttcagatctcttttcttcattgtctacactcactttcatggagagatctcatcccatctcatggttttaaatacaatctaaacaccagtacatctcaaatttcactctccaccctctcccctcaattctagactcatatatccaattgtctacctgatattttcacttagatgcctaactaaattgatcatatccaaaactgaattcccaatctcccacctcacaaccttccagtataatatgttccttgtatagtcttcccctcttggtaaatgaaaaccagttgctcaggccaaaacctttgaaggtatctctgacccctctttctcccacactcaatactcaatctctctataagtcctgatagctctactgtcaaaatgtattcagaattttagcacctcttactggcccaactccctggtccaagtcatcatcttttgcctgcattattgcaatagttcctcctgcttcccagttaggttcccctgtttccactacacagtccatttgtaatacagtgtgattttttaaaaaatgaaagttggcttatatcacttctttactcaaaactctccagtggctccacttcttagagtaaaattcaaagtctttacagtggcctacaaggccctacatgaagtagttctggttacttaattgatttcatgtcctcattaaccttactcattccacttccatcacaatggctgccttactcttccttgaatgtgtcaggcttactcctgctgcagggcatttatacttgctcttccctttgcctggaatacccctcataccaccccccaccccccagatattcatatggcttactcttacctcctacagatctttatgcaaaagtcaccttctttcttggtgaggcctttcctgtccacccaatctgaaataaaaacctcttctgctccacccacttgatctcccttactttactagatttttctccatagaacttatcaccatttgaaattgtatacatcttcctcatcttcctccagtacaatataagttccataaaagtagggatttttatctgttttattcatagctatatccccagcgcctagaacattgtatggtatgtagtaggtgctcatgtgtttgttgaataaatacatgaatggttgaactggttcttttgaaaactagttaatacttcagccatctcttgctgggggactgaattccaccattagctttcaaaatagttgtttgcctaatttcagctgcagtgtgatccggcttgagtttttaaaaaagacattaaaacttctcattagaaattttatcttttctaagggtagtatatttaaaaacacaggctcttgctggttgaatcctgggtatttatgtgaatcaggacaagttaactattttgtccttcagttttctcatccataaagtgggcatacttaggggcacctatcccatgttattatggggatcaaataaagtcacatatgtaaattacctagcccagtacctggcacttagtaaatctttagctaaccgtagcttttattactcttattaagatggaagagaattactttcaaaaaacagaggaagacttgcaactgaaacaactgaatacatttttctaagtgaaaccaaaatagctgtctggctcttttgtacagatggcatttctttggaaaatgatccaaaacttgaaggccaattgttttgtccctttcttcaagaggctttcatgggactggacatattctctatatcctcccaaaatagtcacacttggaaccccttatactttaacatctccacttctcacattcttcaactttgatgccattccagactctgaattcagattccatggattagctcactcagtatactggtaaaaaactcagcaattccttttgtggggaaaatgcttcccgagtgccaaaagaccagctttctagatgggcttacttgcaaacaaggtcatccatgccttaaaaggcaaggacaatggtctctatttctgtgttacggcacctcctagtagcttgctgtcagacacattttgtgttagttccccattaaacaaagttatcacagttccagtctataaatgccaaaatgtgctggattattcaacttgtgcagggaccctgaggaagcccaatcccgtacagagcatttggctcttccttttacagaagcagccaatggaatggagcctctcctattcagcatttgccccacataattcttctcttgctttccagggtccacttcttatatttgaacttctctcttacctcccacagcaacttatactgagctgggctgggctgggcatacattcatttattcattcattaaaccccacagggctcaataaatagttgttaagtcacactgcttctttgctgctttagaactacagttttgttatttaaatgaaattgtaccttatcttcccagggatgttgtaaatttcttgagtacttgtacttctacctcattcctgtctcctgcagtgccacacttgagtcttccttgatgcagtctgtttttattattatgctctgcaaactgctctggaaaaatgggtctgaactctaggaattaggtaaaattttctccttgacttttcattttttaaaatggtggttgttaggagaaaacagcatgcaacactcagcaattactaaggcattttcccagtataatacaatttcaaataaaaacctaacaaagcccatgtcaagaattagaaacttactcataaacggttgtccatccattttcgttacttttggtagccagaagccctgtgtttcctggataggtcattaaggccagattatagccttgggctgacactcttttcaggactccattgctgcttatagtcagccagtatacttgtccgccaggcaccacaagccatagcggcattccgcctgcatcacggcgaatgtgcactgaattgccattgctgctggtaatcgcgcccaagtcaccttcagaattgtaggtgaagttataaacatagtcccttgttatcaagttcagggtgtgtaggtgggttccatttacagtgaactggtacagttcctgatcagcgggtgaagcaatctcataaatgttcatgtcattcaggtgggcttggttcctgctgatggtacgaattcgaacatttccgaggtctgccacatagagggttccatcaggcgacactgctaaggaggaaggggctttcatctttgcatctttggcatagccaccatcacctgtgggagaaagacttgattttaacaattggcatcataagcatttacatgaacataccacagacataaagctctgtgcatcaagaatcattttaaaggaaacaatcagtgaaccaacattctctgtattccctccctgaaaaatatgaagcctattattcaaaagattgtaattcttgagtcagtaccactgcagatgaacagtaagatctaattatctcagttataccaattttgtgaaatcctcaatcctgctgttcagaatctattgtattataagaaacaagaactgcaaataatgatagccacacaaaatttggctggaaatctgagagttatgcctgtcaatgctttcaggatctgtttcaggactttccagtcctactgtgcctagatgccctttcttctgttaattcccattgtcacactgtcaaagtacactaagtctataagtacaacaatgattcagaacatcaaatttgatacctggaataaacattagatttgctttgaccgaaagatacaaattagcaaaatatctataaaactaattgtcgaagaaaacattggaaatattgatcaaaagtcatattgaccaaattgctcactcctgactcctctggcctaaggaaaggcaaaggttaagagaaccattcgggcctggatgaacagtttaatagcactgcgtgtagtatggagggatttccacatcccagcaataattgtatctgttgacattaagaggaccgtttgccatctgagatatccactacatgttttggggagaaggctcttttttttttttttttccaatttcgattagaagaaaacttcactatgggttattgagaaagtcttagctttttaaaaagcaatgtatctagcagaccaatgtcctgagaactctccattgccagatttaattttgctcatctatcccaaagacagtctgttcttagtccctttgagtctcaaatagcacatgcttttaatctgaaaaccaaccacttatggggaagtaattttttcctcagctaaaccagtaaatgtgggttttacctagttttcctttctctaaagtacaaatatttaataatatcatgatctttcatttgtatagtggtctcaactttttaagagtctaaacatttttattacactagtttatcctcagaatagcaaggtgatataactgagacaatgccatctttattaaacaaatgaagcaaatgagtcatgaagagatcttgcagctttgctagggtcactcagtgagtcagttgtgagaacaagtcggtgatctgactcctaatccatcgctttctccactagctcataccaatgtttgcaagtaacactttgcttttccttttccttttgactttactggggcacgtttttcttttcaaaacagagaggggaagctggtgaattgctaaaaaggtcatacctgaaaaacagtcacagtttggatcaattttgcagtcacagtcagtgggggcaccagcgatgatgtagatctccccattggtggttacttgctgaatgcggtttactttcctctcgtctgtttcagctatgaagagcagcccgctgtgggagacactgatggccctcgctgactctagagtggagtgaattgctaccttgctgaccaggaaatgatcgatgcctggcacctggcagtgaatggggcgtcctgcgatgatccgaacacgcctgttctcagaaatttgcagcacaatgttgttatccaagacatacaatgaattgtccataggatttactgcaaggtctgttggccactctaatcgcacctgtgaaacgaacagaacacataccattaggttaccatgtctttccatggacagttttaacttgaaaaaaagaaaaaaaaattggtgtattgtttcccccgtcttatgaattttagcaacattggtgatgtctcggaaagtggagggcagggggaggatggttaatcacatgttctggtaaacgtacttatcatttatgccatttacaatataatgtaattttttccaataatttcagaaggatcatttagagtagaggttttcaaagtgtgttctctggatcagcagcaacagtattatctgggaacttgtgagaaatgcaaattctcaggtcccaccctagatctattgaatcagaaaccctggaggtggggacccaaacatctgtgttttgccaaggtgattctggggatcattgctgtaggaattccggtagctatgatactcaaatctctctcactgtcctgtagacgtataggagagcaaagtcatacaggtttctgggtgacagaatgccagagaagccagattttactcaatgagcaaccttttgcaacaggacctgctattagcatagacctagcatccactttgtggaacactcaggtacagttcgtcagctgttgatttagaatcctggggtgtagcacactgcttacttagcttgacctggttcactccataggttcccctttttagcaaagaaacaggttgtttttttctttcactgagtattcgctgagtacctttctctgggttaagccttgtgctaagctttgggggctcaaaaatgactacgacacggcctctgtcctcaaatgatttgtggtatagtagagccctcagaggaaccattagacaattactctccacgttatgaaaagaaggcaacagaggggataagatagcacttcacctggactaggagtcaggaggcaagatattcccagagcaggtggtacctaagtaaggtctgaaatgaacagtaggagaagaattgggtggaagttgaggggggaggggcatcagagttgaggaaaatctgggtactaggaaaagcatgggtgaaagtccagaggttaaagacagcatggcccatccaggttactaaaactaattcagtaagactaataataggctgggtgtgagggagacctgagggatgaggccaggtgttatggactaaattgtgtcctccccaacttcatatgttgaagccctaacccccagtgtgactgtatttgtagacagggccttcaaagaggtagtttagattacatgagatcataagggtggggatctaatccaacaggactgatgtctctccaataagaggaagagataccaggaatgcttacgcacagagggatgactatatgaggacacagctagaaagcagccacctgcaagccaaagagagacacctcagaagaaactaaactcaccaacaccttgatcttagatttctagcctccagaagtatgagaaaatacatttctgttgtttaagccattcagtctatagtattttgtatggctgccctagcagactaatatatcaggtgctctggtttgaatgtgtcccccaaatatcatgtgttggaaacttaatcctcaaattcatatgctgatggcatttggaggtggggccatatccatcacctcaagcatttatcatttctttgtgttaagaacgtttaaaatccactcttgcagctatttgaaaatatataacaaattgttgtttattatagtcactctataatgctctagaacactagaacttagtcttcctacttagtggtagttttatatccattaagcaacctctggctatccctgtccaccttcccaacctctagtaaccactattctactttctgcttttatgaggtcaacctttttagcttccatatatgagtgagaacatggggtatttatctttctgtgcctggcttatttcacttaacgtagtgtctgatatggtttggatctgtgttcctgcccaaatatcatgttcaattgtaatccccagtgttggaagtgggtcctggtggaaagtgactggatcatgggggtgaagttcttatgactgatttagtactgtccccccttggtactgtatagtgagttctcatgagacggggttgtttaaaagtgtgtagcaccttccccttctctctctcttcctcctgctctggccatgtgaggtgccagctccccttcaccttggctatgactgtaagtttcctgaggcctccctaaaagccaagcagatgccagaatcatgcttcttgtacagcctgtgaaaccgtgagccaatgaaacctcttttctttataaattacccagtctcaggtatttctttatagcagtgtaagaatggattaatacggtgtcctccaagctcatttatgttgccacaaatgacagaattttgttcttttttgttgctaagtagtactccacagtgtatatgtaccacattttctttatccattcatctgtcgatagacacttaggttgagttcatgtcttagctgttgcaaatagtgcagctatctctttgacatactgatttcctttacttttctgaatcataacagttctatttttaattttttgaggaaactccatattgttttccataatggctgtactaatttacattttcctttctctgcaactcaccagcatttttttttgtcattctgataacagccattccaactggggtgagatgatatctcattgtggttttgatttgcatttctctgtttgaaagataattaggattagataaggtcataagggtggggtccccatgatgggactggtggctttataagaagaggaagacagacttgagctggcatgtttttgtcctcttgccatatgatgccattccaccatgttatgatgcagcaaaaatgccctcaccagctgccagtgccatgctcttggacttcccagccttcagaaccaagagctaaataaatgtttttcttcataaattacccagtctgtgatattctgttatagcaacaaaaaacagactaaaacattgggtaatagagggaagcacatgtccagttttgttttgatggctgtgggaagccactgaagggctttaagtaggggtgtgagatagtcatatttgggttctagacagatcatcctggctgctgtccagaccatattagagaaggaggcgagataggagggaggcaggcatttagggggctcctgcacgggcccaagttagggattatggtgcctgaactgggatggcaacaatgggtatggagaaaagcagatggatttgagacatgttaaagagttggaagcaaaaggactggtgtgtgtgtgtgtgtgtgtgtgtgtgtgtgtgtgtgtgtgtgtgtgtgtttggtgtgccttgtgccaagagatgtgctaggcactggagacatgcaggctagccaaacatggcttcaccttagttcctttctagacacaggagttgattcaatgcctaccctgacatctccttgacagtaactatttatccctaggtgtttctcagggaactgtgttccacaccattccccaccctaccactcacttgttctctatttcttttcttttaggctaaaggcagaaaaaaagtcccattcatggccaaaatagtaacagtaatgtagccacttttcttttttgctttgagtgaaagcccacagaaggctttgtttttcttgtggaatctgaaagtctgaaaacaaggtatgagctgtcattgcattctgcggcctactacttccccagctcaaagaggcttacaagcaatcagtaatgaagtggataaaggtcaatttgagataaggcctttcttctaattgtgtctcattagggagggcaactggtgatattgtgaagaggacaaaggttgtctttgacctcctctactgcaccatgtggggctctttgcccatgtctgagtctctcccatacatccagcagcctcattctgtttctatgtttctgtgtgccttccacctctatccacatagactggccttctctggtcagtaccagatgcttctgtgcagctaggaatttgagtgctaatggggtataaagctgagcttgtgttatgcatgttctacagagcctttcagactgaggccatcggataaacattaaacaccagccttaacagctcccagagcagtttgcggtgatgtgttcctcagcacgtctgtctgaggcctttgcatgtcagtgccctgccactgagagggagagtgaacgcctgctgctttggagggcgctgactcctccactgtgtgcccctgccttggacctctatacactatcatgcttgtccagaagctgtctgtgtgcactggtcctacggagcatagtcccccaggaaatgagctggggctggctgaggaagaggaaatgaattcatttccgtacaacactcccattttgattgagtctcaagtcagtgacccagaaaaaacaaacctggcagaaatgacgttctaattatccccactctgggagccgaggccagggcagaggctggggacagcacacacctggcagaagccagagaagaagcatgtttcagattctgtttttagctatcaaggctgcctctgagataaaggctggtagttgggaaataagctgttaaattctccaactcacccaaccagatttaaaccaatacgattggtgtcatgtttattatatttaattttgcctcaaaaatacaccagctattttgtctgtttgttttcttttccatggaataagtcaccctccggcatcttcctgtgactaaagtgccctttctgcttctgagccattttctatacaaactacacagattccctttaattcccatttgatttggccgggcagcttgtctatgcaatctccacagatgaaagatgtgtggctacttagtagttgagagtctgccttttcagaagctggacctcttcacctctcgtagcttgtcagttccttttatgtccttctcatgttaaatactcctattgccaggtaagttttcaaggaactggtgccttatgctcacacaacagaaatactgtatttactaccaagacattttcataacatacagcttaatataaggaatggagtctttgagctgattctgacagttagaattagtatctactagttgcagagagaccctagaattatatgatactaaggtggggctaaggttggcccccaattgctgctaccatttgtccaaatgatttcttggggtaaataaacacttcttttttgggggggtgggaacagagattgaagagcagcagcaaagctctgtaaactctgcctagtgacccaacctacaggcaaactatttggcctcatttgtggtggttgccacaccttgtaaaaatacattaatttgtttgaaatgtcaaaatgcatttaagctaaactagcattaaaggtcacttgtgtagccgccagctggtggaatgtgcctatctcccaacaaccttccctgagaaataaccctgagcataaaggagctcttggtcaggatgtcaacctttgacagcattacgtcttcctctgctaattgaaaacttgccttgaagggagttgactctcaggtcaaccagtcccatgattggtttagagatccagctaattttgacctaagtagcaatttataaagcagcagaatcctatagggagaaattcatgtttaaaagcaatatctaaatataatcccttggttagactaaactggaaaatgtctaaattatgtataagcctaatcccatactgtatgctcaaaccaccatttgtatacttgggctccctccaacagtttgagtcctggttcccacccttattagtatgtaacccttggcaaatgaggtatattctacgagtctctggtttcctcatctgtaacaaaacaaggaggctagtgatagtatatctacttgtaaagttattgtgtggattaaatgagataatggtgtaagttgcttagcccagtgcctggcacatagtaagggatagcaagtggtattaatagtaataacagtttttatagtcatagacctttagagctaggaggaacctggcccagttaccattcaatgtagctccttttcaactgtgtttcccagacttcaattgtccctgtgccacctttatgagttttgcctcacccctacatcacctgcactattattgacttaatattttgctttaaattgacttctaaaatgtgaataggtgctgccccttcctttgaactgttatgtaatcaataacacatgaaattacaggcccagtcatctgagccattaatagaagtgactactgtttactgaatgcctgctgggtgtcaggtacttcatatggtttaccacttaatataaaaattacctgagaaaaactattaacatctccactctcagatatgtgcttttagcccctatgccatctgattcgtcattcccaagactggacatgtttcttcattcttgtctcaccaaatctggcctccccttatccccttttgaatcaacctaaaggtttctctctttggctgtgaaggtcaagactttttatgagttgagtgatttatctttttctttgtcatctattatctttcagttcaatgctttatgagttttgaccacgtgccaggcactatgttataaaggtaaacaaacagatttctgctcttgattagttcaaggcagatacagaaatagataatttaacataatgtggttaagtgtcatgagtgccatgatagatgtatgcccagaatgacatggaaacacaatggagggagtttggggcaagattcctagaagagaaatgtaaacttaattttgaaggatgaagcaaaggtattgagaaaaagcaaggcgggaagggtgatcttggcagagggaaaagaatgaacaaaagtacagaagcatgaaatcatatgagagtgaaggaactaactgctgtctgggatttcttaggcataaaataaggtaggtggtagtggtgaatgagttctaaatgtttgctaggactaggtccaggttcctccactgaggctctgttgtcaggtggtgccagtcctgtgcattgtaggatgttcagcagcatccctgacttttacacattaggtgccagtagcaccttacccccagttgtggcaactgaaaatacctccagacattgcaaaatgtcccttgaggggcaaaaatgtctcttgctgagaatcaccgcattaagtcatggagagtggtatatgctgatagctttagacttaaactgtgtgtgttgaggagtctccactttaaagtggagagctgacatgatcagattagtattttagaaagattacttaggctgcattttgggggacaggccggaaggagaccagactagatgcaggataaccaatttggaggacagccattcattggtacattcatcccttaatatatccttttatccaaccatctgacagatatctgggtcctgatccagatagacatagtccctgccttcatggaacttggagtctgggacactgcttctcatacttttttgatttactcatccatttgagaatctgatgaaagctatgtactctctccctagaaaaaggcttcaatgcactagaaggaagtagttaggacctcaggctcacgagttaagatttctggagttgaaaattccatctgtgtcatttgctatccctgtgaccttggcacgaatcagttaacctatctgagcttctgtttcctcatttacaaattgaatatagtaacactatcttttcaaaaattattattggaattagataggaaaaaatacatagaccatctagcacagtgcttggtacattaaaagagctttgtagaggctagctatttttgaaaattatggaacatgtgtgtatttgtgctggtccctgtctattgttctgttccttggctagttcataaactcttaagtttaatcatatagtcatgctttcaaggtttctcttgattctatgtcaccagtcatttcctccttgtttatctatgccattccttgagaatctttctaagctatatgtcctccaagaaatatttggctggtattgggatatattatctcatatatatctgtcagccaatttcatggctaatattttagcttattacttgaactccccactgttaattgtaatagtactcttggtacaattccagctacagaaaatgctaccttaattgatttcctttcttctgtcaataaatgtctatttatctcatgttaggtaccatgctaggcactaaggagccagcttcagtcaggatagactagattcctcccctcataatgtttatagtcttttgctgacttcatttccttcatcttccagtatgtacaaggggttgttagtggcatagagcagtagactatttctgttccagtttattcattttaagaagttaacatttatggaagtgctcaaaaacatatcatgactgttactatattttacaattgtcaccaagtgctaataatttcttttcccaaagttcaagtgtgctgaagaaaccagttgtttcccaaaaggtcctgcctccccatttcaaacatgacacttctaatctccctcttttactacactgggagccttgtggctcatttaaaaaatgactctgtttgattttgatctgtgagtcctcttcagtaggaatttccaggaagcgtatgattatctcttctgtagtatgccagccctggggaagatacagtgacaggactgagtgctctctgccaggtgttatgccagctccatgttagatttttccgcacttctaaaagctgacaactccagattgttagcatcactttttgtcagttttcaaatggtcttctcatttcttgacactgatactctctgagcttcttcaaatgtataaaagagggaaaaagccatctggagaaagtttggttttttgcacttggaaagcatgatgacacctttaagagtgatggcctttattgatcttgcttttaaaaagtggaaattattagaagatgaaatacaccaagattacatggccttgtcaacagggcaaattatttcccattatcttagatacacactcttgtgtctctctgcataatggctggagagtttgaagaacctctcaacctttggtcaaatgcattggcatggtctgtttccatggcttcccaattagagtaactgacacttaagttgcattgttcattgcaaatgaatagctaggatcaatctaatcaagagtaacaatttggctgatcttgagaattattctactgcagaggatatagattaaattgcatctctcccaatgttcctaaaacattttggaagtggggaaaacaaagcaaagcaaaaccaaaccaaacaaagcaaaacttccaaagtagtcctagtatatttcatcttctaataatttccactttttgcaagcaagatcaataagggccatcgctcttttaggtgtcatcatgttttctaactgtagaaaaccaagctttatctagatggattttctctcctatttataaatttgaagaagctcagacaatatcagggtcaaaacaaaatgttaaatttgtggttcctaaaattcctgtggcagagactgctggttctaggcctattcttatattcactctttcctcctgattacactcccagtttatttatttatttgtttgtttgtttgtttgtttgagacagagtcttgctctgtcgcccaggctggcgtgcagtggcatgatctcagctcactgcaacctctgcctcccaggttcaagcaattctactgcctaagcctcctgagtagctgggactacaggtatgcaccaccacaactagctatttttttatttttatttgtatttgtatttttagtagagatggggtttcgccatgttggccagactggtcttgaactcctgacctcaggtgatccacccacctcggcctcccaaagtgctaggattacaggcatgagccaccacacccagccaactctgtttttgaatctgagtacattgctgtttagaatacaagacattccagccttatttgcaattatctgtagtcaagtgaagttccaggcaataatatgtaagaggaagtgtggaagcacccacacttacaaatagatacttaaaaaggctgcttaaggagagctgacccaagtggaaggaagctcttcttgccctttcttccattctgcaatgtggatataccagtgagagttctagcagatgtcatggaccatgaggtggccttgaaaatggaatttatgtgttagagtggcaaggcaaaaatacagaaacctggaacccagatgacactgcggagctgccatctcagccctaaaccacacatctagcctggctgctctcttgcttacatcactgtcatgttagggttttctgttattcttggttgaatctaatcacggggaagacagtgctctgttaggctttggtcttgactggagttactcactacaacattacattcaaactggtctaacagatttctagttttacacctctggatgaatcacctatgattggaaaattaaattaaactaaattgaaataaattaagtctgaaagagactgatgcatgtagcaaagtccactagggcagtgttaaggggatgactaattgcttaaacctaatgattaacctcaagcattcttgaatacctagggctccatctttgggtacttcaagctcttccagctccatgactccttcatttagatccagtacttctctcttattctaaaatacttgtttgtcttcctatgttctctaccaagactatgagttttcgacggcaaagatgagaactcttttatttttgttttcctagtatctggcattaagctggcaaacgtttgttgaatgaaaatattagtgcttcattgacagtaatgtttttggtccatgaaagcatttaaaaaaattataacatgcaaataggctctaagaaaaactatttctcatcaacatgtttgtgtcagtaaatctgggtttccagagacccactgaggttagtgtaaattgccataaatacctcaattttaagaaatgcatttcccactgcctccatactttaacttttctgaagtgaagatgtatcttatagtcaatgtgtatgtttgatggtacatttctccccattacccaaagatatcgaattgatgttatgtcttatagtccatggtgtcttagaatttaggaaatatggtatttccattttggtctggggagtctgggaattcccaagtctctttcagaaagtctatgaggtcaaaactatttttcaaataatattatgtgcattttgtactttatcatgtgtgtacagtggggctttccagaggctacctcaggctagtgtatcttcagttttaaaaaaaatcacacttttattttctaataaggtaaatattcataggataaaaccaacaaaagaatagctcgttggggcccccaacaatttttagaaatgcaaatgggtcctgagaccaaaatgcttgagaatggttatcctagaggaaagaaacagtgaaagacaccactctattatataagggtttccttgaagctcattaagaaaaaagcatatattcctcctaagatagttcctggggccataagtcctgtccaaaagcatactgaaggagtggctgaaaatcttcacttcctctagagacccaatgcctgatgggtaccataaaagtttgttcttacaggctgcctcagaacaatcagcacgtacacactctctctgagtctgctgtgtaattgccactacctcatcttaataacaggcataattgctctgagtttccgtcgaccctttcttgcatctcctctctgaagcctcaattttggaaatggcacttgtgaatacacagaatgtttaaccacttccagttttcaatttacagtcaaagtcatctatcagcaggagatgaaggcccagtgtgaaaactacagaatgtccttcagactccacagctaatttgtttgtaaatttgattgttattgtaaggagaacatattgtacatgatgctacttacatgatgctacttgccgatttactgtttgtatctctgtttctcgggttttatcattacgctaaagaactgaaccctctcagcccttctgggggtgggaagaggaatatgaaaatgttactatgtttttttattttgagtctctattttaatttaattttacatgaattcattaaatatctactgtatatctagcactgtgggggatacacatacagaaggagaggcaatcagagtacacagttcaaggtaataagaaatcaaatttgaggctgcgtgatgagcccataaagtctgagataattcagagtaaggacaggacctctgctggtcttaacacagtaggaagtgagactcttgtcctcttgagatccaaggctttgcttgcataggagccagagacttataaagaagcccctgaaatcattctgcaatttgtttctgctgagaagttgcagaaacttgtctgttgcaggttgttaatattatagtattggcttgacaggacagaccaagcttccaattccctttggcacctaaagcaatttacaggccagaagtatgactgcacagcttttatgaaatggtctgatttcattgatcagccactctgagattatgttttcatttctgtagctactgctaacccttctttctgttataatatttcaggaagaaactattaaaaattttcaccatggagatgttaagctataagtgggctgggctctgaatgggaaggtaaacatcacaactcatgattgttctactcaaaagttcatttcaagttatactagaattccacagattgtctctctcatcttaactctgtaatgtttccaaatgatagggacactaataagagcagatggcctaatgaacatttagagggaagatttaactggtggtattttcattaggcctccagtgtgcttccgggttttgcccaccacttccctgtgtgtaatacaaaactgcactcactcaacagatggcccagctcaagcttcatgcttctagaactctggagatcggccacctgaccacttaccatgtgtacagaatcatttaaggaagcatgcgggctatagacttaagcctgaacaaaagcaaaaaatggtgatgaatagtgagtatctgagcttcaataaaaggggaggcaaaatcaccctcacgaatagcaaatctggctgaggtctcccaataacaggttcttacagattcagtaatgatgaaatcctctgtgacaaacagtccactctaattaatgtttcatctaaactgtaagcatatctgagtgactccagcagcaacaatgacatgaaaatctaacacctcattgcacagtgtgctagttattaagctactgtctcacagctcccaactcacccctttaaagatgctgctttgtgatgctggggttgggactcggcaatctacatttttcttttgccagctagatttctgataggtcctgacgatacagaaaataaagagattctgagaagctaaaggagggagaagggacttgatccttcctgcttgctttctgttcctgtcagtgtcatctcaacagtagcccttcatcctggaagcagtacctgactgcacttccagctcctctccctaccctgagaatcagtctcattatgctgcctcagaggcaccagaagcaaccagctggcatcttcttttttttttttttgagactgagtctcactctgtcgcccaggctggagtgcagtggcatgatcccagctcactgcaagctccgcttcccaggttcatgccattctcctgcctcagcctcctgagtagctgggactacaggcacccgccacctcgcccagctaattttttgtatttttagtagagatggggctagctggcatcttcttctcagaggactaggtcctacctccatggagcaaattctccaactttctaggttctgacaaccccaacctcttccctttgtttccccagtcggagagatggtggccacttcctacagatattatctctatctcttgtttttttctgaccctgtaacatctgtacatcacattctctatattaaatcctctctgttaaaataacgaatgtactttctgtttttctgactgcatcttttttttttttttttttttttgagactgagtcttgctctatcccccaggctggagtgcagtggcatgatttcggctcactgcaacctacgcctcctgggttcaagcaattcttgtgcctcagcctcccaagtagctggaattacaggcacccaccatgctcggctaattttttttttttttttttttttttttttgtagagacggggttttgccatgttggccaggttggtcttgaactcctgacctcaaatgatctgcccgccttggcctcccaaagtgctgggattacaggcatgagccactgcgcccagcctctgactgcatcttgactaacattcacaacattaacccacatacaaggatagaggaacagcaatacactattgtaggtcagtggtaacagaaaactagtaaaggtgaactggaagcagcaaggactattttggccccagagactttgctatgaaagtccagaaatccactgtgcttggatgttataaagttggttgtgaatgattttatccagagcttctctgactctggaaatgccatgtttatgtcattattctctagaaacttctcattcttgcaatttttgagaatgatttcatggtcgatcatgtgactctcccatgttattcggagacacaattctgtaccaaatggttcatgaagttgccccgtgacaacatttcctatgtgctcaattgttaacagtaatacattagatatttactattaaatttcttttatattcactcttgctagttttcttgtcagacattgcaattactccttcagaatcctcttctcattgatttggagttggaagtgtgttttgagatgcgccaaatgaacccctgctctttgttatgtatctcaagataaacacgtttcaacaggtgtagcctgttggtaacattttatatgtccccatgtttacttttccaaacacaccaacttttgcatgaaaagatggcactcttgctgacagccaaataactttctctttgagttgtatttccatttgataaagaggggttggcactgattcgtgcactttcccctctcataattaatagagagtgggagtaggtttaaaggtacagtgtagtctgaaatttagttaggccaactggcttgcattgggactcagcacaggatgttatccctagaacctgaagacactaaccactgaatttacttctagaactcctggcatcaggtgatctgcttgcctcggcctcccaaagtggtgggattacaggcttgagccactgtgcctggcctctgactgaatcttgactagtattcacaacatcaacccacatacaaggatagaggaacagcaatacactatcgtaggtcttctgtatcttagagagatacagaagtatcttagatatttctgtatcttagagagatacagaagtatcttagatatttctgtatcttagagagcttcaggttcacctcaggtcatggcacctgctgagcaaaatgtgtggaagactgagtggttcaaaagcaggtttgcaagccttgcatcttgtgacttgccctgaactttgaagatgcttttcctctggtgcttaatagttttaataagagctaacgtgccattgtcctttgtgtggaaagaggacactgctgagggagttttatttatgtgataaattatgtttttgatatagcattgagcacggtacttgacttttattttaaggcccctgacaactttggctatttgcttgtgtgcagacatttcagcagaatttggatatgctggagctgaggatgttggcctgctgttctctacttatataaacaacctgagctgtcactttggagggagcaatggaaatatctctgataacaggttattatattgtgattttacctaagagatgcaggcctgaaaaacagttaaaaaaaggtttaaataaatttggagaaaggatacaatatttaaatgaactctgcggatagtctcattgcattgtttctcccagtttatcattttgttaaatttggttttttttatatatataatagacttaagaaaactgatagatgtgttggaaacttgaatatcttgataaaaacagaagtcattagttagatgaaaaaattcatagaccaaacttgcttcaaaaatcctaggatgctgctttcttcttatgatatatcagcttctttccttttgacttcccacttagctgggagcctttttgttttgtcttgggaaagtcatattcttcatagtgacctagataaactctgtcttctttcttatgtactctaatatttatttttttgtgtgtgtgaaattgacccacctagaatggctgcaggccacccactgaatgagctgcttttttacttcttgatttcaaagagatagaggatgatctaacatcttacattcacagatgtataaaactcatactacattccagcctcagctccatagtcatcacaacagtatgtgaaagtagaaagaagatgaagtatttggggcaccattcaatgactatagtgaacattcattaagtgatctagacagagcttcacatcagcactagggagacaaaacattctgggaaggtcacagcaggttaagaccagtctctggaacatgtttgctacagcccatcacactcacctacagacagatatatgcctctctgtaaaaggtacacctatgtgaaaaggacagaaaggaagattatataatttctctatcagttctaaacttcttggtcccttttagttttgtaagctatcagttcaattctcttttgtgagcagaaggtcaaatactactactactactattactagtaatagtaataataataatgataaaataataatctattgaacgcttatgagccaaacactttgctaagtgatttatgcatattaccacattaaattctcacaacctccctatggggaaagtaacattatcacccccatttacagatacagaattttttcccaggggcacacacctagcaagtggtggatctaggatttaaacccaggcagtctgtattcccataccattaagctttactgactttatatattggtataattatgaagaacagtctaccctaaaggcctgattttgtctcttgcatcctctattaaaggattagagaaaggtttggctctcctttgccgttccagaaggtgtttttctgcatttgacagagccaggagactaggtctgggttgcataagcaataaataacattaagcaaaaatgcatttaaattagagactgacaactacagatattcaaaatcagaaaaaccaccttgcagacttacttggttcttgtgtcctcccattttagcaagtgtatgatgaatcaacagaaaatacttcatgaagatgccaattaacatcttacatcatctcttttatttgtaaagcccttcacacttttccaagtgctttcacattaaaaaagagaggccacttaatcaacaattgggtcatttatttaattagccttcataaggaggaataattaaccagctccaaaattctagtgtcagtttttacatctagtactgaatccaaaattatacagaaccttcatttgggtcaagaaatagaaaaaaatgatttaacatttttttctgtattaccatctttcagaggagagcagaataaatgatacagaacgaaatgttatttttctaaaatatagacccggtaactacaaatagtgtttatttagcattattatgtaattttcagccataaactctaatggatctctcatttacaggtgagtaataatgtggagagccactagggactctgaaaaaagcctttttaaatggcttttggtgctgttgtcaaatcagagtctaaacaactcttcctgccatctcatgctctgtgacagcataatttgattgctatgtagactgaagtttgtgccactttccttccacatgcctacctaactgacatggcaaacgtacacataaaagccaaggttacatgtaatgccatatggtctcttttttcacttctgatcggctccaacaatttatagttgcaagtgcctttcaaaaaagaaacttccttcatgtgtgttttctcatttaactgacatgacctccttaggagacattacatgtttttatcccactttttattggtggagaaactcaggctcagagatcttaattaacttgtctgaggtctcactgcaaataaatggcagaatatggactcacacccaggattgtctatactccttctactagaacactcttagtcaaaggaaaataggtgaattaggcaactgtccagagaagtttggtaaaacatgcctctgtactcctgaagaaatatgaataattgttccaggcttataaacatgtctggtagaaagtttgctcatttttattcagtagtcatcactttctgatttaaatactttcacatttaaggtaattgacatattgaggtctttgagaagagtgtggctaagttaacaatgccttcctgctatggttgatgtagattgagctccctctttatcttgtaggaactaacaagcactcccatttctgcacttataatataagcctttggatcagcgggaggaattggctgtgactcgtggtttgactgagtgcatgtggctcaaatgaatagaacaaaacattgctgatttaggatgcttatgtttggactcctgcaatagcccattgctgagcagttaaaattgctgctctattgttgtggtccaggcatgagaacggtgaaagaaaatgggaaaatacactggaggtttggttggtatggcttttaatgccatctaatctattagttgatagttactatgaaaatagttaattcaattggttaaactaaccatgaccaattaggatagagtaaatgtttggcataagggccaccaaatgacatttttcgttccattctactactccctgggcctcattaatttgctgtttgatcttctgtccactctctaatcttctcttatcctttcttcacctctctttttttcccacctatttgtgcctactgcacactggtattactgacccttgagaaatgtgttttcaaatatttcagatatatagctttcatcgtccctgtcttgctgtctacctgtaactcactctttccttctaccacatgcccttgtgtctgaattatctggagtgtggccagagaccttttctttgctttgacagtgagataagttccatagtcatggaaacattgagagggtgtggtggggtggaggtggtgagattttcatctttggtggcaagaacttttaaaataaactttcttttctttttcccctgggagatccctttattcaagcaaacttattataattcagattttcttgattccctacagagcttcacaaaactcacaagtctgtccctgcagggaatttcatttatagtggccttcatttgaaagatctaattctgttctctttcagtgtgcacatgggagactgatggaagtgcacaaagaaaagcaagtaatccatgaagaagttgagtttcaatatcatctgtatcagtatcactcaggatgatgaaggacattctgtagacatgaaagggttggcaagggagagagggaaagacaatgacagatgttaggcaagagtttaagaaggggaaaagaaggtgccttttctgttaaagaaaatttttttttgagacattgtttcactctgtcatccaggctggagtgcagtggcacaatcacagcccactgcagccttgtcccctgggttaaggtgatcctcccaacttagcctcccgtgtagctgggactacaggcatgcaccaccatgcccgactaatgtttgtattttttgtagagacgggggtttcgtcctgttgcccaggttggtcttgaactcctgaggctcaagtgatctgcccacctcagcctctgaaagtgttgggattacaggcataagccaccatgcctagccctcttctgctttaaaactactgtttttttttttcttttttttccacccagattgctgtaacttttcatgcctggatgactatgtgtgtgtgtgtgtgtgtgtgtgtgtgtgtgtgtgtgtgtgtgtgtgtgtgtgtgtgtgtgtatttaaaacaacagaaaatgctgaacccacttgtataaaattaaattgacatatagattttgaagaggaggctgcatattaccccttctacagagctgtgttattttatctgaagcttgcaaaaaaatctaaggacaagagaaagttgttttttcagttatgtagagagcagaagacaaccaaggaaggcagaggtctgctgcttggggcaggtggtatagtactgatggatgagagagaggggaaggttttgttttctctgttaaggagaatgacgacagagaatattgattcagagttaccaaagccaaaaatggatgaagggattgtaaaagagcatctaaattctttaactgagttcaagttttctagctaggaagaatcactccttatagagaacatgcaaatggggtttagaacttttttgtgtaattattgagaaatagtgggcaccagaagattagagatggttaaatatagttctgacttcaagaagaatcagaaatgtgccccacaacctgcatggagggagctttatgttgatttggaaaagatcttcaattgtattatgaaacagttgtttttttagctcttagatgaggaaatgatgtttacagacactgtgactagaaacaaattttttcaagtggttcttatttccttttaaacagagttaccaacctggtaaggtttctcatgacacctttacagataagttgggggaaatatcagtgaagagagtggctttcaaacttgttttgactgtgacactcactaaaaactgtattttacaccattatccagttgaaataaaaatattatgaaacactactcaccctcattacacatgatacaccttgatttttaaaattgtgtttcacctttttaaaaagctggtcataggccattatattgatttcccaatgtattatgaagaatcacaatgagtaggtgagagttcaaacacatgggttcataatctaacagataactagtctattggtgccacaattgcacctacctatccatcaattttataatggatgaaggcatagaaggcattcatcagatacataggcgacacaaggctgggaaggatagtgaaaatattagatgatatcagaagagtataaagaattggactaactcaaacaacatggaattgaatagagactaaggcaggacccagcagtatgttgtaaatcactaatggtgcaagtgtaagatgaggagatgggaatgagagacacgtgaatttttagttttctgtaattacatcacatcatatgtcaaatgtgtgatacagctgtgaaaaaatcccggtcaactttagctgtggttctttaatctgtgccctttatttctttagcattttgcaaaagtgcctttgaggtcaccatgcaagctaccatcacacggaagtaagcttgaataaagaaggttctgggacaccacctcttgtttgaatctgctgtttgcatctattttataaattgagactgatttgtttgaagtaaatgttctgtggctaaagttttttttttttaaacaatcaatgggcaaaaggaaaagaaacaatatagaaagggagttgtgacagttcccattctacctctgagtactcagagcacatctggattattttattcattctggaagccatggtggcttccattctggaagaatggtgaaggaactcaaaaccatgtaaaatgaagtatagttaaatgaagtgggaatgtgacttaagaggcatgaaagagttgttttcttgtactaagagggctgtcacgtggaggaggcagtttaatgtaatttggtgaaaataatgtgggctttggcgtcaggttgaccaggttcaaattccaactcagccacttattggttgtgcggccttaaccaagttactcaattcctctgaatcttgtttttcatatgtattaaaaacaggggaacataatacctatcttgaaggattgtcatgaggattaaataagataacatatataaacgtacccagtattgtgcttgattcactagtagattgatctcatagaatatagattaaatttataattcaagaaagcctgaacagttgcagtaagactggatggtgaaagttaaaggaagacaaaaagtcaaagggatccaagaagagcttgtcatcagtcagaggtattcaaagatggaatgtgctgcctgggggaggtagtactaattccctaacacaggaagcatttgaaaataggttggattgttactacatggtcagaatattctggagaggagtcaagcatcaaataactgagaagagtaagattcctagtggactagttcaatagatgtaatatatgaggacaaagtttgctcctccaaagaatgttaccttccttcctgcacaactatggatgatgcttcccctacccgtgttagacccatctgacaaatgggtgctgttggaaaccagtgggaaacacacaaatcatccaataagcacttatgaagccctggctgtgtatctggatgctctagacaaacacctcaaagtgtgtaccttatgggcagtaggtcaacaggatttcctatgcatgcaaaaggtccatcttgcttgtgtatctcctattgggctgactttgggaaaagcattaggctggctccaaggagtaacttgctatcccatcaagaaacttgctctaactcccaattccattctagtcaggcatcagatggaagtgagttaccagagcaggatgattcaaaagcagcaacagaaataaagcacccagtgtcttgataatcaactcatctcctgaagtgaaaggcctggttgcttatagcagtgcttacaaagggcagttatgcttcagagtttatactgagagttcagtttcagatttcagtaaatcaaaaaaagatattgattttgaacaaatggatgattttattgtcaaagcaaatttcatttcttgagatgattagattttattaaactctttcctaactgccactaaacacacattctgtgaataaacagcatattcttcaaccaagcggcatttgtcactcagctaaatacaatgctatttggccatctccagaggttggaaaaatgcacacttgggttcagaaagcttgtgccaaaatcttagttatatcactcaataactctatggtcatagcacaatatataatccctccgactaacagttttctcctctggcagatggggataataatatctacctctcaagggtggttgcattgtgtagacaaaatagaatagtgtaaattagattcttagcatagttcctggtacatagtgagctctctataagtggtagcagttattcttagacttactataggacttaatgatctgctaaagattaggacaagccctgagaactgattcttctttgggcttaggtttgccacagaaaagtacagaagatgaaggcaagtaagatgaagaggaccattctctcatatcactttctaacctccataggtactatgctagtatacatgggcctttctttgttggagatcttttggttttgaaatgctggaatgctggaaaggtaacaagaaactttagaaatttggttgtatttctgtggagacacctttgtggagttggaaggaaccttgagaaaacagttggtccattttcctggctccagagaggcctgtatgtcaagcattcatagattattgctatccaatatttgcttgaaaagtttcaaaaggtgggaactccacaaaaaatttttaaaaatatatgatgctgccatgtagtgttagaaacagtaagcttttcttaaggtctgattcaaatcttcatgttgcagcataggcctctattttctctcctgtccattcctgtcagcagaaacaatgcactctcatttagacatttgtctgtgccctcacccgtcaatatattttgatttactgaaatatgaaactcagcactgtgtaagctcagctggatcactgtaagtactactataaacaactggggctttgctcttggtgggtgttatgaagctccctgctcagctttcttctctctagctgaagatggcccatgttcttaagtacagtcatgggaaacatcggttgccaatctgtcacagttgtctaaacagatgggaagctctggtcataatggctgagcatctaggaagctgtgccacacacaggctttctcctggtaaactctctatcaactgacccatcaatttcattcggtgttctccagctttagtccacctgtgccacatctgggtgctgatctgcccacacctgagagctgatttgcttcaatgccaaagcctcttcttcccagccaaacatctcaaagaagtgatctattttccgtttctccatttcctcacttcctactctgccgctggtatctgactctcattaattagcactctatcaaaggtactcttatcagaggcgttaatgctgtgaaatctaatggcttctttaaaaagcacctcattttttatgatccctaagcagcatttgatactgaccattcccttcctcttgaaaaacttgcgtctcttggcttttttgacaccttcatggttttccacctaattgccaggtctccttctctcagcctcctttgtgggttctcattcctccgttttttcttgaatactggtgttccatagagtttggtcttgagccttctcctcttttttatgctgtgtaccctccgtgagagagctcatccactcccctatttaccattgccatgtgtaaactaatagcaatcacaactctaatctgtagttagacctcaagctttaaacctgtatccaatttcctgccagatatctttatctggatgccacacaggcacctcaacgtaccccaaactgaacccatcatccaaccatcaagcaaacctgcttctcttcctcttgtattccctgtaccagtgaatggtactaccatacacatgttccctcaattctgaaattgtcagtcaacaagttatttgatattggctccaatgtttaatgaatctatctacctttctatgagattttaggttcagccattaaaattgcttgcctatgtagcctgcataaagctgagcagtgtcatggaaagtctcatccagagttgtatcccaaagaaatatcagctgaacatcccaaaagcattggaaaacagcttaatttttatagcagtcccttggaaaggggctgatcatatctacattgatatgttttttccttgtcatacctggatttcttcaactgtctcttaagtggtctccctgcctctagtgttattttgcttcacttggttctccatgcaacagctagaatgatctctgaaaactgatttccatgcttaataccattttaaaaatgcatttcccttcttaacgctgttattatctcttcattgttcagtataacttcattatgcttataaggaaggcccttcaccatttcaccctcacttacctttctagcttcatctctcactactctttcatattctttttaccattatgtccttttggttcaggtatagatgttaactgtacctgctgagcccttcctatgcatgttccaggaacacacagtctactgtgggagacgggttggatacacagtttgccaacaaagatcaaattacatttaagcatggtgatactaaattccagtaagggattgaagcaacagtgaggactagaaccatcaaggaaggttcccatggaagaggtgaggtgtgaggaggatggagaatgggatttggaccagcagaggtacttccagactggggaaatggggccatgagaagtaggcctttaataaaggtagagggtgataatctggacactaatcaatacagtctccttgttttgagccagtctgggtggacaaattggatttactctttagtgtgtctcaggcacagaacaggaaatggtggatagcagcagagttactggccaaataatctggacataaaacctgctttctttcctggtaaatcctgctggcttctgccatccccttctcataccacacaacctcccctgcctccaaaaaaatctactgtatctctaaagctaaagttgtgtacagaaaggggaaagagggtacttcagagaaactgaggcttggaatgaaatgccatagagaaaagtttctgtctcctggttaccagggcttcttttcagtgggctgcattgtatttcccaacctgaaaaggatgaggtagattttatggtgggaattatgtttggaaagtgtcatgtgaaaaagaacccttctcatggtgatgatgatcatatgtttgctctactaagacaaataattctcttttcaacataacttttctacacagaaacagaaaagttgtttagagttgactgattgcaatactaaatgccctattttaagttaaaaatatcccacaagtgaatcatacatgtgcatcttctctgtccctcctcctccatacaaatacattcacacccttctttattgccataaataatgctccttttccttgccttctgcagcattttgaatcatggaaagttagactattctaggacttgatagcctgacccattcaagtctctattaaaaaagggtttgttcattttgtcagttttccaggcccaactccccatttcacttttgtagttgactatatatgaacatttcttgagtttctggggcagggcaggggcacatagagaagcagaaattcaaaacaggccagtgttttatagagttgtatgctcaaggtgggtggaggtggcaggagatcttagagtcaatgactaaagcaaggtttcttaggggtgtgttccttttacttactaatatggttttgctgtgtccccacccaaatctcatcttgaattgtaactcctacaattcccacaggtcgtgggagaaacctggtgggaggtgattgaattatgggggcgggtctttcctgagctgttctcgtgatagtgcatgagtctcacgagatctgatggttttaaaaatgggagttttccctggctaacacagtgaaaccccgtctctactaaaaatacaaaaaaattagccgggcgtgatggcgggtgcctgtagtcccagctactcgggaggctgaggcaggagaatggcgtgaacccgggaggcggagcttgcagtgagccgagattgcgccactgcactcccgcctgggccacagagcgagactccgtctcaaaaaaaaaaaaaaaaaatgggagtttccctgcacaagctctctgtttggctgctgccatccatgtaagacatgacttgcccctccttgccttctaccatgattgtgaggcctcccccaccatggagaactgtaagtccaataaacctctttcttttgtaagttgcacagtcttgggtatgtctttatcagcagcgtaaaaatggactaatatatttaccttgtttttctaggttttaggtggtatgacaaatgaagcaacaggaatatcataactgtggggtacactgctcattgcctccccagtagcaaccctttactccttgctaacagaactctgattttggtttaagaatcaggtagcaatgtgctcagggaaggggacccacttctaaagggtctgaattcactatggaatctcatttcccctttgccagtgactggtgaaggcatgggcatgtgactcaattctggccaatgtgacacaagaaggaaatttgctggcatctttgcctatctttggacaactcgttatgtgagataattaaactttattgtttaaacaacttttagacaagtattttattacttgcagacaagaccatcctctgtgatacactaatcaatttgaaaactctcaacatccactttagtgtttttgaaaagattatttaataatctactttattagggtcacaaatttatggaatgttagagctggaaggtttgaggactgtctaatctatttccttcatttcttgtttctgcagactaaaaaagtcagacactgaatgttgggactatgctgtatgctctataatctctttaaatgtctaatactgattttgtagaattgtggtaaaatcagaattttggacccagatgagagctacactgaattttcttttatcctcactggcctaaaaaaaaaaccaaaaaaacacagatttcctaaataacagtaaaatagatctcagaggggatgttgcttttacttaagaaaacttccaaacaccctagaaatagctatttatatacatgtgaataacaacatgctcatatattcattaaaaaagatgtctaaagagacttcgtagtcactatttttctaaatttcagtcactgtttcatttgactttcttcacagaattggataaaactactttaaagttcaaatggaaccaaaaaagagcccgcattgtcaagtcaatcctaagccaaaagaacaaagctggaggcatcacgctacctgacttcaaactatactacaaggcttcagtaaccaaaacagcatggtactggtactgaaacagagatatagaccaatggaacagaacagagccctcagaaataataccacacatctatagctatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaatgttagacctaaatccataaaaaccctacaagaaaacctaggcaataccattcaggacataggcatgggcaaggacttcatgtctaaaacacaaaaagcaatggcaacaaaagccaaaattgacaaatgggatctaattaaactaaagagcttctgcacagcaaaagaaactaccatcagagtgaacaggcaacctacaaaatgggagaaaatttttgctatctactcatctgacaaagggctaatatccagaatctacaaagaactcaaacaaatttacaagaaaaaacaaacaacccatcaacaagtgggcaaaggatatgaacagacacttctcaaaagaggacatttatgcagccaacagtcacatgaaaaaatgctcatcatcactggccatcagagaaatgcaaatcaaaatcacaatgagataccatctcacaccagttagaatggcgatcattacaaagtcaggacacaacaggtgctggagaggatgtggagaaataggaacacttttacaccgttggtgggactgtcaactggttcaaccagtgtggaagtcagtgtggtgattcctcagggatctagaactagaaatacgatttgacccagccatcccattactgggtatatacccaaagattataaatcatgctgctataaagacacatgcacacgtatgtttattgtggcactattcacaatagcaaagacctggaaccaacccaaatgtccaacaatgatagactggattaagaaaatgtggcacatatacaccatggaatactatgcagccataaaaatgagttcataccctttgtagggacatggatgaagctggaaaccatcattctcagcaaactatcgcaaggacaaaaaaccaaacatcgcatgttctcactcataggtgggaactgaacaatgagaacacttggacacaggaagggggacatcactcaccctgttgtggggtggggggaggggggagggataactttaggagatatacctaatgtaaatgacaagttaatgggtgcagcacaccaacatggcacatgtatacatatgtaactaacctgcacattgtgcacatgtaccctagaacttaaagtataataaaaaaaataataatagaattacttatcttggaaatattcaataaatgagattggccttaccctctgattaattcaagcttgagagactttacttaattgtatgtcaatattctacctgacattacttccatcctcgcttaccattttctcccaactaagcttttctaacgaggaaaaaagtaacttacataaagagaaacttctgctatctggtgttataacagatatgccaggcttccattctacctcatttctacatgagaaaattgttatccatttccatgatgccaaatgacaataatacttgaaaaccagtgatgcctacctgagtgatgtccattcctgagtcacagctcagtggttgtgtggaagtcagaccatttgagccgattacagttgtgatcacagcattctcatcaattttgcgaatcatagtcccatccacaaagtaaataaatccatgcctatcaactgtgatgcctgttgggaaagagcaaatgagcattagtagtctagtgaaccacatttgcactaagctctgtattttgaaaaaagccatagcaatggaaaggcattttaaagacatatagattcaattttgctcagcacagacaggacagtaatgggagaggtttgttggggcatacattcacttctttgtgtattgagaagaaatgacaaaaagtcacacgcggagataaagccaggtctaataattttgtccagttttacatttccacccccttgatacttgcttgcccccacaaacaataaaaaatcatctttaagataaatgggaaaagacggggagatcatgtatattacatttttttttagggtgctaatgcacaggctgctgcttattttcacgattgcattaggaaataactgacttgaaaagcattataattattttcatcaattcagactttgttaaaagggagtttgtaataactttgatgaaccgggctgagtttttttctccatattatctattaaaaggggagttggcgagcaaaattatagtatcacaaagggaatggctaagtttctagaaaagataaaagccgataaaattttcacagcagtttttacacacagtgttaattacagcctggtttcttaaaatttttattataatagcagttagaaggcttgggttctaatactgaataccccacttacaactaatgtgtgactctgattgagtcattcatttgcaaatttcagactcctctttggtaacatagggacaggatcgtctgccttacttagctaaagtgatctactgctctggtttggctgtaactgaggcagagctcagttttaaaactaggaccatccttgacaaaccaggatgagctggttactctatatctaggtatatctaggtgttttttttttttgtttttgagggagttttgctcttgttgtccaggctgggtacaatggtgcaatcttggctcactgcaacctccgcctcctgggttcaagtgattatcctgcttcagcctcccaaatagctaggattataggagcctgccagcacgcctggctagttttttgtatttttagtagagacagggtttcaccatgttggccaggctggtctcgaactgacctcaggtgatccacctgcctcggcctcccaaagtggtgggattacaggcgtgagatatcgggcctggccctaggtcgttatatcatatgaagtaatacatataaaaagtatcagatacactttaagaacatatggctctactcctatttcccttggtgcttttgacagtgctcttgaaaataaccacatggcatttttcaaactagtctacaatttagtcttttccccacttccctttatttaggtctggtgaaactcattgaatggatgttaaagtcagaatttctgtgctaacaagcgtgtccttttagcacaacacaacacacaaacacacacacacatgaattttctggcaaaatgtgaactcatctagagtcattttataaactcaacttaataaactgcttttagatgaactaattcattggcaggaagttaatattaagacttggctttatggtatactttgattaatcctgatgtttgattaatccttaacatctataaaagttacaaattcattttaatgtcccctgaatacttctaaagtcatctatgttttggtgagttctccaaggaaaccagcatgtccaaacaagggaattccatgtccataaatccctttataatttttagaggtataaggacccttaaggtggtttataaaaagacttttaagactggggcaagttaaatgatgatggcgtatgaacaattattttaatctccagaacattttggatgaggatgaaccaagggggaacttctgcctgttatttttgtgttttgcaacatcaatttcttgattgcttaaaatttggtgtggtttgtggcagacctattatttagaaccaccttctatgaccactatattaaatatcgctgagtataaaatttcaaatttggctgtcataaagggatagactgaaagatcaagactcaagactcaagtctggggatggaaagactgaaaggagatgtgctcgacatgtacgaaatcatgaatcatttactaaacactatgattactaaatcgtagtgaatgtcaccatgctaggctctgtgagggtataaggataaagaatctggttacactgaaactaagactaagaggaatactctggaactttagtaaattaaggatattaaaaataaaatgaagtgttgctcttatgaggaggtagtaaacttagaggatctgatcctctaaaaatttgagcaggttcacaaaaggtacagagaaataaatgtattcttaactagtatacatgggaaggtctttacatgtctttgctgatatcagggaggacaattcttttccttgactaccacacttctcatcccatcagagtgcaaagtttaggctgatccagggaggataatctgggactttacatagttttcttacttttactttttgtgaagatctaaacactgtgaacttctttgtctctgttcatgtcagctgagttccacagacgagtgccctttgaaataagtctgggcttattaaatactcactagttgccttcagggcttgttctgctgacagtttgtagaatattttcctttcatatatttgtgtagcaacttcttttatcatggtccaaattccaaacatacttctttttccttgagaagctttaattaactttgattgggttacacttatgtttggagttgaaaaagaaacagtagaaaaggctttgaggaaactatgtgataggtgcttcataaatgtaccgagcatattttatatgtacatattttcctctcatttgccttcccttaccaaccaatcaaccaaccaacacataaattccccaaacaacaattttgcaacctctttgctggtgaagcttaaggggtatttaattttcactgagggtaaaaatcaaattggaaaccccaggcatgaaaaagagaataatatttgtccatcatttggggaggtttcccctcccataatgcttattgttataacccagggatagtgatgatgctgtagatatattactgcttgtcagaatgagtgaaaggaggtgacacattcccagtatatattttaagctttattctttggagatgggcatgtgagtgatttcagatcacataaagccatctggggctagcaagatctgcagattcaatttactttccaattttgatattgctgtgcccagatctccaaaacttggtaaccaatgttgtgggcaaaatttgttccaacggtcatgttcattgatgtgttcactgacagcattttcattagcacttaaacaatcaaaggtacagtctctggatgagaaaagatttaaagatttaaactgtactaagaaaaccacttccaggtttaaaaattttcaaccggaattcatttttgttttcaaagcaagtaaaaatacagagatctctgatattaccacaaggttaggccgtgatgcaaggcaggtggaggtggaagtgggaagaaaacacacaatagcttgagtcccctcaatttaactttgaatttaaaaatccccctgcaccaaggaaaacactggcctcagatgcccagacagcatgtttagcttggagcacatttttacatttgggagaaaataaataaatccttgtaaattagtgcatataatgaaagcactgacagaccataacctggaagtgtgaatggtgctgtctccattcatcagcattaagccctaacaagctctttctatggagagacctgctcataaataaagtgcatcttgtaaaaaaattattcacaacatcccatgcaaagtaggggatattatataatatctgaactgcaggctcttttctctgtgaagcagtgctctgtatgaaacagctgcaaattataggcaaaattatttgacttcttcccttgtcttattatcctccaatgaataaatactttaattctttagatgacaattgcctaaagctggggcagcctggatagttacttataaatttatcacctgtgaggggaaaagatgctactgatcaatactgaaggaacaggggcatcctgatgtaatcactgagagtccagatgtggtgcttaatagcctggaaatagtagctaaatcccaaattagataacagtgaagatttgagtttttggctgtgtagaatgccaatttcaaatgttggcagaaggcatctctgtacttaattttttaaaattacagctgttgaggccacctacatttttattatttctatataaaaaatgaaacatctttcagaatataagctttggaaagcagtcataacattctcttcatctatagccctagcaacaagaaaactgaaatactggatgtttttctgccacaatctgctgtttaattttatcagacaaagataaatggttaaatcaacttccagggaaattcctaagcctaatatggtgtcagctcaatctccaatactgagagtgctgaattgtgtaactgattcaaaaatgttcttttagtcaaggagaatttttctttgttcatgtgcattccaattctctgaaaattggtactatatgtgtggtatatatggaaactctactaggcagaaaagtccattcttcaacccatctgactactgtccacttaattaccctctgggatcagaaaggcccaagttacttatgcataataagcctgttaagttttctcactatgtagccactaaatggagcttctagaacttggagggtttacagatttctgtgtgtcactagaggttggaaggaggcagagcttaatgacaagctgagatgatttcactgtgtggttaacagtggcatcaggatttctccagtaaggagacactaataaactcactgtaatattatatgactagtgaatagtgagttatttaatcagatattttgtttaataaaatgttctagtatattctacatagtaaaggtcaatttccaaagaacataaacacaaattaaaaatgataagctttcaaactaatattctgctgactggaatgtcttattttgattactcaaaaggcacttcaaagggcttcatagtcattataaagaacaataaatttgtgggctagttaaccaagaattctgattgagagaaagacagacgacaccagtgtttagcatttgtcttgtcttcagctccttgtgatcctctcaaaactttagacttcagctttgccataaggcaaagtgaatggacagcccttttaaatccaccaaccactatttttcttaaagcttactgagaaaaatgtttttctgtttactcattaacttattcaagatttattctgcaccctctgcgtgtgagcactgtcctaggcaatgagagtacaggagactataaaacagacatggcgttgctcttagaaagcctggaaactggtagagggagacagagaaataaccaggcaattgcaatgccattagataagcactagtttggggcaagtccaaggtgccatgggagcatccttgggggatgggccggggaaatgaaagtcacaagtgatttctcagacttaagtgataggtaagctgaaatctgaagaaccatgttgaattctagatgagcctagtatgtatgaaatccaggtaaacaccactgaaaatctatgaaagatgactaatattactaaacaataatcatttccatttgccgagaacactatgatattccaggtactgtgctggattccttacatagattttctcattcaatcctcccaacagccttgtggagtaggtactaatgtaattttttagatgaggaaatggaagtgcagagaggtagagtgactaactctaggttacatacctagaaagtgctagtttaaagcgatggggaaaggactccctattcagtaaatggtgctacaataactggctagccatatgcagaagactggaactggaccccttcgttataccatatacaaaaattaactcaagatggattaaagacttaaaagtaaaacccaaaactataaaaaccctggaagaaaacctaggcaataccattccagacataggcatgggcaaagatttcataatgaagacaccgaaagcaatgacaacaaaagcaaaaattgacaaatgaacttctgtacagcaaaagaaattatcaacagagtacacaggcaacctacagaatgggagaaaatttttgcaaagtatgaatctgacaaaggtctaatatccagcatctataaggaacttaaacaaatttacaagaaaagaaaaaaacaaacaaccccattaataagtgggcaaaggacatgaacaaacacttctcaaaagaagacatacatgtggccaacaagcatatgaaaaaaagctcaacattactcatcattagagaaatgcaaatcaaaaccacaatgagataccatttcacacaagtcagattggctattattaaaagtcaaaaaataacagatgctggcaaggttgtggagtaaaaggaatgcttatacactgttggtaggagtgtaaattagttcaaccattgtggaagacagtgtggtgattccttaaagacctaaagacagaaataccattggacccagcagtccccttactgggtatatactcaaaggaatataaatcattctattataaagacacatgcacgtgtatgttcattgcagcactgttcacagtagcaaagacatggaatcaacctaaatgcccatcactgatagactgtataaagaaaatgtggtacatatacaccatggaatactatgaatccataaaaaggaatgagatcatgtcctctgtagggacatggataaagctggaggtcattatccttagcaaactaatacaggaacagaaaaccaaataccacatgttctcacttataagtgggatctaaatgatgggaacacatagacacatagaggggaacaacacacactggggcctatcggatagtggagggtgggaggagggagaggatcagaaaaaacaactaatggatactaagcttaatacctgggtgatgaaataatctgcacaacaaacccctatgacatatgtttacctacgtaataaacctgtacatgtacccctgaacttaaagtagaagttgaaaaaaaaaaaaaagaaaatgctagtttaacacaagtttgtctgagtttaatgcccattctcttaaccactatgccatgtagcttaaatgaggttatcaattgctttaccacagggatggggtacagactggcttaagaaggttcagaaactccatgaaattatccacaaaatgttttgtgtatgggtattatcatggggagagagcccattggctttgttagattgtcaaaaggatctctgacccgtcccaaaaattgttaagaattcttgtattcctatagatctcttagacttcttcagaattattcttcaaaggtattctgtggcttcatcttcacagagctgatgagtttcaagaaagtactcaagaccttccatgtggtggggagttcagtaactttactattatcatagaattaccacctaaaaaggagaccccacgcagtgggatatcaactcacctaggtcaaaatagcttttattaaaaaagatagggaataatgaatgctggtgaggatgtggagaaaggggaatcctcatatattgttggtggaaatgtaaattaggatagccactacaaaaaatggaatgaaggtccctcaaaaaactaaaaatagaactatcatatgatctagcaattccactactactactgggtatatatagaaaataacggaaatcagtatatcaaagggatatctgcactcccgtgtttattgcagcactattcacaacagccaaaatatggaatcaactaagtacccatcaataggtgaatggataaagaaaatgtggcacatatacacaataggatattattcagccataaaaagaaggaaattttatcatttgcagcaacatggatggaactagaggttattatgttgagtgaaataagtcaagcacagaaacacaaatatcacatgttctcactgatacgtgggagctaaaaaagagagtagattagtcgttaccggaggctgggaagggtaagggaggatgaagagaggtatatttatacccattaatcaatgatagaagaaataagaactagggtttgataaatcagtagagtgatgtaggttacaataatccattgtatatttcaaaataactagaagagaataatttgaatgtttctagcataaagaaaagacaactatttaaggtgatgaatatcctaattatactgatttgatctttacaaattatacaaatgtatgaaattatcacacatagctcccaaatatatatatctatatgtatcaattaaaattaataaggtcgtttcattttcagtatgacagagacaatgctatgtgttcatgtcatcccgtttctctttctttctgagaacagagttagattacgtttctcagcctcctttccaagttaggtgtgggcagaagtaatggatgcgacttctaggcctgatccttaaggaactatctactgagtttctgtatggattactaccttccactgtaggctggctgcatgcagaccatccagtagaggactccaaggcctaaggcattgaggaatcactagatggaagaaggctggttccttgaatcactgcttggagcagagattcttccactccccaggcaacccacattaaattgtgatgtaagaatgaaataagttactatttttgttaagctattgagatactgtgtgtgtgtgtggggggggtgggggtgggggggagggtgtgtgtgtttaatatggttgttagcttggcccgagtattaacattcagcaacccaaatcctattcaccttttaaggcttttataggaagtttccctttcatgaatccttccctgcaaactccagttcattgtggtctgttttctaacccacagaagctgttacttatttatttatttgttaatgtgaattctccaatcatgatccatgtaggtaataagctccctgaggacaggaactggattttagaattagtttttatatctcaaataattcagtacacttgggcacaaatgttcaataaaccttcctgatttacaggactaaatttccatgcatttatactgaaacatatctaccttgaacaaaataaagcatgccaggaggccaagaactgcatatgaatttcactagaaatgagcttagaaaggatgcagtgacaatgtctttctctaaagtcctttaagaggaatacagtcccctatcaattagtgatgattggaatatgggaaaagtggggttgacaaccaagagcaaacagacaaaggaccatggatcaaattaactgcaaacaaatgtgatccatgtggatagctacaatgaatagctcatgacaccgctccccccaccacacacacaaatccagttgttctgtcaatataactttgtttgcgatcttgtgatctcttccgaccttaccatgttaggagttctgaagaaacagaagtgcctcaggattttttttcaggctgatttttcttacagaatagctgtagaactttggataatgcatttgaccgctcagtgtcttgatttcttaacttatatactacctactacacaaggtaacatggtgtgaagctcacaagagccaatgaaatgaaaggactttgaagaagataaagtattatggtggtgctaagtggtatcttaattgcctagttattgctataattctttctgacagtgacttttctaagcctagaatcatagtcaaaaatttccacacaggccctgcttgaacactttaggcttttctgtgttctgtaaataagatttaagtccatggagcattatgtaacccttgtcagtaggagagcaccctatgttagattcaccatagagacaattcagtagttgaaaacagttttgttagctcaggggaaatactacactattaaattattggtgtaaaagccttcaagcttttataagatggttaaagtttccgtacacagaatcaaataaatgaggttccatgccgtgcaactcgctaaggaagacccttggccaaggtggtggtaatgtctcaacatttaacagtgaaaccagacactgataataatgtgatttatttttctttgctttatagaggttggggtgtgtgtgtgtgtgtgtgtgtgtgtgtgtgtgtgtgtgtggagagagagagagagagattggggtaagtagatggtgctagttcaagttgaaatgcacatgtcttgttttatttttgtgttagagttcccactcaaaagatgcctgcaggctgagatttaagggttctcagtatatatgggctaagataaatgaggtttactaaatctgagctgcatattttatatctccccctttagaaattcctcaaacatcaagcaacgatatctgagacactactcagatacatttgaaagaactgtcgctgtcatcctaaggaaggcaactgccacacaagaacgttagtgaacaattagccctaggaaggaaagttcgtttattgcccatggaccagcaaaaaactaattgcagttgttgcactctagggaaaatgagtctatctcaaggtatgtgaatgaccaagaggttctaatataaaaagcaaactaagtataccttgtcccaaatactcaataaaagcaggatatgaggaattaagccaatagtgctcactattcacaaaagtggggtaactcaagaggaattaaaatttctttaggataatgatttgcatgtagtgcccattcaaaaacaacacagagggcccatttaaaattctccctgcatccgtatgtcttgactaatgaagctagtgctagaagagaagttcacaaagtcaggagtggtagacagtcatttgcaaaaggtaaggcagggtaatgagcactgcgtgaatacacattttaaaccttttaagtggaggttcaagagacgtttgggagaactgatttgggctcaatcaagaatatatgaatataacaacagcatacacacacagacacaggcacaaatatgacagcggaacaaaaagcgaaaaatagtcaaagcagttgtttaatgagataaacaacttcttttactgtttttacctttccacactctgacctacaagtgtgacaatctgtgggcacaagaacgcgacattgagaggcatttaaaatgctgggatgttttgttcaaagggggctggtgacttccttatccttgtcttgattgagattggagtttccaaggccatttccctgtctattttcctctaaactcaaatatccagacaagttcatcagagctatgagaggtggagtaaagagtctgggctagaagccagaagatccagttgtgagactgactgtgactttaacaaatttaaatagtctcccagtcctcaggttttgcctttgtctaatagtgagtagaaaagctgagctgctcatgtcagtggatgactgtaaagaccatataaaataacttctatgtgtgaaatctttctgaaagctcaacacaagtgatgttagtatttatttatgttttggttttattacttatttatagagacagggtgttgctctgtcgcccaggctggagtgcagtggcatgatcacaactcactgcagcctcgaactcctgggctcccgacatcattccccctcggcctctctaatagctgggaccacaggtgcataacaccacacctggcaaattaaaacaatttttttgtagatatgggggtctcactatgttgaccaggctggtcttgaactcctgggctcaagtgatcctcctatcttgacctcccaaatctttgggattacaggcctgagccaccgtgccccatcttagttatgccttattccttgatctcttatttcttttggagttcacttaacccatcaggaatagaggttagaatctagttcctagttcttttttacctttgtgtcccatcctttttcagattccttcctttttctccacttcttccctgttctcattttccccctttttttttctctccaaaccccaaccagctctccagtctgcgaatccccgtggtatttaaagttgatgcatgcaacctaattctgtattttagtcttttctaatgagtcctcccgtgtctccccaaagagataatattccactcaagggcagggaccatatcttcttagtttacttatgatttccaaatttgttgcttgaaaaacttaacaaaacaataaagctcagtgaatgtggttctttttctaacaagatataccaggcgcatgatgtggacgtgctacagtagctaaaaccagtgggaatcttatgaatagtaaggtggggccattgacactagtgtgttgttgacatcagtaaaataaatatatttaaagtattaattaatataatggcatctctggattcctgtcggataaccagtaagtttgtgctgcaacaagagatggttgtggtgtttgactatagcatttagcacagttcctgccatacaagactactttatatatataaacacactttatatgttcataaaatagatgattaaggtctattttagaaacataacaatttgagcaatttaaaaaatgagtaattaataacaggcagtgactctgataaaggaatgaaaacaaaacaaaactgagttgtatgaaaatacttccagacgccattgttacaactacagtgattcattccttaattcaacagctcaaacatctccagcatttccaggaactaggaagatatcattttagggccaaagcagaagcaagtggttttggtcatttgtaaattggctagtatttttttttaacattcaatacattatttgaataatgtcatactgttaaaattagatcagatatacttgggaaaaagtgcccagcattcgtaagaaaagtacaacggaaagaaacattttagggtgctaactgttgatctgtggtttctcaaaatttcaagtataacaagtgaaaatcagaagatttcaaagtaacccttcttctgtccactctccctggaaatgtccccagttttactactctgggaaaggtgagatcttgccccaattcattaaatagggctccagtagtagcctgcctgcagttctgattttactttgctcaagagaacacagagaaaggattatgaaaaccaatataggtaagcttagcagaatctattctgatggattttggcttgcggagggacaaagcagacctatcaatctattactatggcttcaatttcctcgggttagagatgctttccaaaatgagaaataattcctgcccactaagagaaattaccactgtagtcagcttcctttcctgagtaaatacaggtaaaatggggcacctacccaccttccttttcccccaaacccattagactgtttcccccaaatgcagtctaataagctttttgaaaattgtgttgcccctaaacacagtctaataagctttttgaaaaatcaaatggaatagctagtaaatgaaactggaagaaaaatagagcaaataacactggggcttcctggctaggctttgatatttgaggcttgaagataacctcacatttgagttattaagcctgtgattcctcagggggaaactttaaatgggccagaactcactcccaagggaacagtgactttcttcggtcaacgataaagctgactcattatacggaggctctctcaggaagttcactgtcagccatttaggaaactccacatatgggtacatactagaggtgctgaggtgatggtctctacagctaatggaagagcttcaaaaccaatctgttcagaaaataacggattaatgcaggggtccttgatgaacctgctccaaggccaaaactggtgtgtgttctcatatgttggtacctgtgcgttacaggatgttaaatattttgaccatcatttctataggagtgaaagtcttatttaaaacaaaacaaaacaaaacaaatcactttctgaaatggaatagtcaggcatacatttgtaagttgatttctaaaccctagttttgtttgtttgtttgtttgttttttgacagagtctcactctgtcacccaggctgcagtgcagtggcgcaatctcagctcaccacaacctctgtctcccaggttcgagtgattcttccgcctcagcctcccgagtagctaggattacaggcacacgccaccatgcccagctaatttttgtatttttagtagagatggggtttcactgtgttggccaggctggtctcgaactcctgacctcaagtgatccgcctgcctcagcctcccaaagtgctgatatttctaaaccctacttctgacttaaaatgtttcaaaattaggaaatatttcaactggttagaaaagtcagaaaataatattacagaccatcatgcatccaccaccaaaatttaatagatgttatcatttgcttcacatatctctttcttttttttttctttttgagatggagtctctctctgtcacccaggctggagtgcagtggcgtgatcttggctcactgcaacctccacctcccgggttcaagagattctcctgcctcagcctcttgagtagctgggattacaggcacccaccaccacgcctggctaattcctttttatttttagtagagatggggtttcatcatgttggccaggctggtctcgaactcctgaccttgtaatctgcccgcctcggcctcccaaagtgctgggattacaggcgtcagccaccgcgcccgcgcccggcacatatctatttcttaaaaaggaaatgatatggatatagccaatcccatctccttatccctatcctctttttccttccttctccagaggtaactactgtcctgaagttagtgtgtatcattcccatgcatgtttttataaattttccacatatgtgtatatatccatgaataatatatagtattgtttttgtgctttaaaaatttatgtaggagatggatgacagtgatggctaaacaataatgtgaacgtacttaatgcctcagaactgtatgtataataaaatagtaaatattgttatgtatattttaccacaataaaaacacgtaaattatattacaccttatgtatccttttgcaattttctcttttatccatgcaacattatatttttgactattaatggttttacatgtagatctagctcattcatttttactgttgtataaatgttccatcatttgaccaaccccctgtcaatggattattaggttgtttctattttttatactacagttaatatcatagcacatgtcttatgcatgtgtgtacttgtgactgtccatacactcttcttcagtcaagcaccctctagctcatctctctgatgttgcaatttttcccctttagttgaacaatgaattttccacgtaaacagaattaaattagggctgtgtctgtacaatcaatgaagtctgaaagaagaaaatttgaatgcagtcaaacaattttgaaaacaaaatgtttattacaaatcttgaaaataatctacttaataatagttattagcttaaaaaagtattttaatacttatcctctttctcatcatcatacttcattcagtacttattctgtgccaggcactgtttaacccatcttgcgtcatttcatcctctataaacccataatgaaggtaggtactatttccattttacagatgacaaaacagtggctcaaagatggattcaaaataaatttgagcccatttttatctgtactattccaaagtctctggttttaactactgcaaacacttcctaagttttccaaatttcacagggctcaaattggagaggcacatggtatgatttaagggtcactaaaaagtctgcccacctgccttaaatatattatatctttacgacaggaagattcttccagctggacacaaactctagagatgttaagaagatatattgataaatctgaccatatgaagttagaaaattctatagggttaaaaaaagagaaaaaaatgacaagcttggaaaaatatttggaacacatatgaaagacaaagggatgtttttcttaatttccagaacagaaaggacaacagctcagtagaaaaactggaaggggatatgaaagtgaatttaccaaaaaagaaatacaaatggtcacaacagatatgaaatgagactcaaattcattgataattaaaggaatggaaattaaagttacaagctacaagacaccatttcccactgctcagatgggcatacattaggaggtttatattgagagctgctgagggtattgcagactggcactctgatacactattagtgagactgtaaatgtgttcaatcttttgggaggacaatttggcaatatctactactgctaaaaattaaccctatgtatatactcacaaaagtgctccaaaatatatgaaccaggttattcattgcagcactgtaataataaaagattaaaaacaagcaacaagtatatcaagaggcaactggcttaatacattatggtgtatccatatgttataatatcgtgcagctcttaaaaacaaagaggtagaaatgtacctgcttttatggaaagatcttcaagacatattattaaataaaagaagcagggtgaggagtaatctatatggtatggtttccttttatgtaagggaaaaatatatatataggtctggaaggaatctcaaaagcctgttaaaattggttatctttacagagagagacctgggtgtgtttgtggcaaagaagcctgaaatttcttttgtatctttctatacagtttgaactatcaaaccatagacattttattacttttacatttttatgtttcaatgtcaagagtgcttatctagatgccttttaaatttttcttctttctcctactcttttttaaaaaaaataaatgtaatttaaatatcttttactactggcctgccaggattccttcaaggtcttccatttaggtttcttccttgacttacggtattgccccttcagcaggtctcctgtaacatgctcaggtgggagtaacccattgtcaaccatcagtactatgacactccttcttggagagctgtcatctatgaaaacagagagctgagtcctcagaaatcgggccataggacaagacagggtgtgtatgtgagaaaataacatacatgtatttttaagaaaaatacaaaagttgcactttatttcataactagacatcaactcaaaaaataatatctggtcttttgttgaattataataaatgctcagaaaattaaagagaagaaaagtcacttataattccttatgcccttatatagcaattatcattgctaacatttacatatactccctttcaaactttctctctctatatacatagagagaaatatataatatatagtaatatataatatatattatgtcatatataatatatagtactatataatatatattatataatatatagtactatatattataatatatagtactatatataatatataataatatatattataatatatagtactatatataatatatagtactatatattataatatatagtactatatattataatatatagtactatatataatatatattataatatatagtactatatattataatatatagtactatatataatatatattataatatatagtaatatattatatattatataatatatagtactatatataatactatatataatatataatatataatatatagtattatataatatataatatatagtaatatataatatataatatatagtaatatattatatataattatataatacatcataatatataatatataattatataatatagagtaatatataatatataatatagattaatatataatatataattatataatatacaatatagagtaatatataatatatacttatataatatataatatagaataatatgtaatatacaattatataatatacaatatagagtaatatataatatatacttatataatatacaatatagagtaatatataatatataatatatatattacccttacacccttacagatgaggcagcatacagtacatacagctttgtgtcctgaacttttcattgaatgctatcttgtgaatatcttccttatacctgcaggggcgtaccaaggtttgggggagcaggtgggagtggttggttctgggtatagagagtaaggggaagtgcattttctgttgaaatcttaaaaaacaataataaatctggtgaatagtaggtctgctttaactatcaacattcgctggaaattccaaataatgtcagtgataaaatacttcttccactgtcccatccccctttagtatgccacttatacccacccagttctgattagggaagagaggagacaaaaagttggatttctatctaggagagatagactgagggctgccgcaaggggctcagagttaggcagggagtcactgaaagatgggatgaagaggagacattttaaacatcccctattttctgcttagatctgtccagcttagataacttttaaacatatgcttgacgtaaaaaaaaaaaaaaaaaaaaaaaaaaagcggctgactatgaggtactcctgggtttttttttttttttcccaacaaaaaaacccagaagctgtctttatgttgcatataacttatgtcattaatgatgctgttgtaagtgccctgagtagtgacatctataaaccctgggctgaagtggccaaaaatggaatcaattgttcaattataaaataaaaaatgaacttctttactctatttccagctgtgttttagcctgtgacagtgttaaattcatagatttccaaagaaatcttagtttgctgcatgttgtttgaattttacactataaaactactaatttatccagtatttctggaggatccatgaagctaaaatgatcttttatgactctgctagtgtagagtgaatattctggattccctaggaagtcaacacactgtagacttcagattccttcaaaaatcagcaaagcatgctagtctcaccaggaaatgacttcccaatttctttaattttatagtcagctccatgcatttggtaatcgtgaaattactggaccatcttgtattgatggtggactaatatggagccatgatcaaagttcaactctaatacagctttatgttttagaatcttaaaaacaaacattttgcatggacagaagtgtcctaattaacttctgaagaatctgtacattaaaacatcttaccctgctggagaagactgataaagcaaacatactaccttttgctgaagagaaactgtatttagaaggaacttgctattctcataaaactttcaataggaagaagtgaatcaaatttcttaattaccattttatggttggtaaaagggcaaattacatgccatccatttctaaacttctaaatgtctctggtgcttttaattaaagctgccacctagaaactactaaagcaattttacacaattagttatttataggttaccataatacaccactcaaaatatgatttaagtgatttgcagcctattagtgtgtgatctctgtcacttttttggcaggggtggtgaggactcttctttttcatcagctgaggcagataagaaaagtgtgacattgaggagctgtgatagggaagcaaagttattttggctagcgatcttaaataaaaagaggaaccagaattccaagctgtcagtctttgcatgtaggcgtccaagtttcattctagacaatactgtggagatgaagtatatcagtgctattcctccacctcttcccactttgcagctattctgccatatacctagcaccacacttctgcatgctaccttcagtggttcccacctaggcttgtctttctcaggtgatcttgtcaatccaaacatatccatcttctgctccattccctccaggcccccattccctccaggcccccataaagtgttttaatgaagaattaatatgctgctctcctagacaattccctgcaccacatactaagtttgcatctgaagaaaatccttatgggaatgaatttaattgtgaaatagtacgctgctaagggaattactttagttagatgggccttgtggggctccccaaaatataacatgtacaaggaaccaacactagaattgctgcatctcaaggtgaggaggggtcggctagtcaaatcacatacaacatgtgaattccatcctaccttgactcttgcttcttctgtggcacccatcctacctagaaattatcaagtctcagattgacctacaaggacataatgtttccttccttccaaagtaacttattacatatatgggtcattattataattattatgactatagcaacaaaacagcaagactgagcataacagtaagtaatactgttatgtaatacagtaacatactttatgctgggtgtcacactaggcaatttacatacattatccaacaacccattgtgtaggcactattactagttttccaactttacagatgaggaatctgaagctcagggaagttaggtgacttgcctaaggttaaacatttaattagcagtggatctgggatttgcctccatttctgtttgactcaaaaacctgaaaaattatctaccatgttatctggcctctaaaatattacctctgtgcttgctagaatctgatgcatacatgaaaattaagacaaatgcagaagaaaaagtcatttaataatgcatctgtggctttataaaaattgaaaaaacttaatataggtcttccaaccatggatgctacctagaccaaacaggcaatgagccaaggctagatgtaagtgccttccttttgtctgacttctctcatcaacagcttatggctttgggattgcaacagaacaggccggaaggtcctcaagttccagttgctgacataatctaaggccaaaatcttttgactaccctaagcagatgcattagatgaactgtgcataaaaaacaggttaacctctaattctggttgtataacaggcactaactcttctgttgcagttacagtaagctgagagaccactaacagtgtttgagacagaaaccccccctaaatgaaaacagcacaaggtcattgagggataaacaacaaatattttgcctgaattttaaggctttatcaaacatgtttttttcaagatgtttctgattctaaaacaaggttgttggagtaaaattctcataagaaatgtcttgaaactgggctaggaatttggccatgggtggtagaatgctgtcttacccagaaggaagacttcagtaagtgcctctcctaaacctttcccacttacaccctcattttaagcagaacagatccacttctcagaacacggaggctatcaagatgaagaatcatcactcttctagcttctcctactacaaactgatcctcatccctataccctacaaataatcgcttcagtctcccctcctattctaggccgacttccttccagtttcctccatgctttgatttattccccgtcttctttatctttccattgactgataagcattgccacatctccccttatagaaaaaggcttcctgagttcattggcctcccacgatttatcactccatctctcacattcaagcttctcagaagagtgagcttcaccagtgatatttattttctcatctctcatgggctcatcaaatgactaaaatctggcttccacctctaccaccatccaaaccaccaatggcagggtcaccaacgaactcctcattgcctaatgcaatagctacaaatgtgtgacacttgatactgtttttcacacctccttgaaattaactactctctggcttcctggacagtgtgctcttttggtccaccacccttttttctgaaggtttctgctctgtttccttcattagatcctcttccattgccaatcttatacagatgagtactccctgtcatttatttgccccagttttgctccagcgcatttattaccctgtcgccaacattatcaaaaacgcatgcacaaggtgggcatctctcctgcttcaaatcctttccctataggataaaatccaaacttccttttcttgcttctgcccccctttcctattactctccaatattcttactctaagaatactgaattatttgcagtttcctaaatataccattctttttatccatgctatggcttacccgtaattttgttgagggctgtccccagtgtcaatctaaatggctttgttaccaagatggatcatatgctaaaggaatttaggaaaaaccataccacttccattgaacaggagaaccaaaagaacattctatgtctgtttctttactacactgtctccctcatagacaccagtgacatcagcaaaaagtcactgattatagccttagcatctttccattaaccccaaatataacttttcacaatagcatgcagatgccaggagaatgagtagggcttcaggatgtacttcagctagacctggatagggacaaaaacagattgtttgtgtctagactttgttattcccagatttcttaatttccaataaagttaagatgaatcccgtaaggttagtgtcatgtataccctaaaaacacttttggaagccgtcaagatttaaggatcatttccttcctatggaacagctcagaggctgtttgcacttgtctggatattgcctaagttctgctcctgctgagttctggcgtcagtttgcctgaagatgtacatgagaatagagatataacccttggtgaggtccaagagaaccaaattaagtcactgattaatttcatcctgtccagtcactccttcaccttccgtatctacttaaaaaaataaatgcatccagcttgtcacaaattttattttatatccccacctagtaccatttcacattctgcttaagtacttggtcatctattacatgactcattagtttcagttctctgtagaattaaagaaagttgcagtaaaaataataaatggaacctaagtttcaactacatcatccatgcatgttttaaaagcatctttcaaagtcaattcaaactcatatacaatgccagggattagtactccatcaacctcttttcgaaactttttttctttgtcccattacattgaagtattgatgagtaaaatggcaaatgtttctctttgttgagattcagatctaagtgcataaaactggatcagataaagacttcctcccaggagaagtacccagaggctatcacatgaaattctatttggggacgcttccatttttccttcaaacaaaatttgtagttactactgtagtcaagaaatttaataaaatgaagatttcctgcctgtgtcccttaaggaaaatttggtgaagtttctaattacagaatcttccaaagagaagtgacaaggtttcctggagatttatttgaataattacatttacagagtatgtaaacgctatctatgtagtgcactatgggtacactactaggtcagaaaaatctgagaaatggttttaataggaaaaggaaactagactaaaagttatttatcttgtaaataaaaatattttgttcccattgaatacatgtcctcagattgaaaagcatttttttcccccaatatttccaaccttcccagagatcatagattttagcagaaaggcagacagtgtggtatggtgaagtaaagtgtggccgaggtgggcggatcacgaggtcaggagttcgagaacagtctgaccaacatggtgaaaccccgtctctactaaaaatacaaaaatgagccaggcgtggtggccccttcctgtaatcccagctactcaggaggctgaggcaggagaatcgctggaactcgggaggtggaggttgcagtgacccatgatcgtgccactgcactccagccagggtgacagcgagacttcgtctcaaaaaaaaaaaaaaaaaaaaaaaatggcatcatgggtttttcggagtcaggcagacctggtttgaattccagtgttgttatctgtaaactgtgtgaaactgggtaaatttcttttttaaaaaataacttttattttaggttcagtggtacatgtgtagtatgtccaggtaaatttcttaacctgtctgattctctatttcctcttctgtacaatgtgactaatactatttacatcatgcattgttgtgaacatcagagaaactgtgtaaaatatctagcacagtgtatggcacacagtaggcactgaacaagttatagttacagttattttaatacattagagctgaaagggagatcatcctgaccccttcagtttacaactgaagaatttcaggacccagtgtttaaatgcccaatgtcataaaattagtcaatggcaccactcagcctgtctatcttcgtgttcgggtaaatgaaaccacagtgaggtacagtgacttgcacggagtcattgaaagaaaacatgggcattacatgtattgaaaaagaaagtccgggctccctcctttggtatttaccaaaacttgctgccattgctaaaaacaaaaacagaaacaaaaccaaaacaaaaaattcccatggctcctgacctgttacctttcgctgactggtttttaactccattggataatttactctgaatttagaatgaatgatctcaaaagcaaattttatttcatcctatttttagaacagatttagagagtaaattagctgtcgtacagattaacatttatttgacttaccttgcataattaaggacatgttggagaaccttcctataattgcaatatgttgcttgttaaagtcttggagcgagcaagctcttttccctaacctagaaatggtgctccctagatgtacatttccattttctactgatctacagcttttctttattagcttctaggtggagggaaaaatcaaacctctccttaaagaaattcattaaacgtttgctatctactaagtggaaggaagaaggagctgatgtacagggtagttttaaagcaaaaaacaaacaaattgggctttcttgagaaacaaagaatctgtaagagaacctcaaagatgaaatgagcaattagcaatactctcctctcattttgtacactgtaataactttttgcatgttttttccttttatggaagtctatgaaatcgccctgcagcatttcatttaaagagaatctcacttctaattcactgacaaaggtgagtgctgactatattcagcatggagataggtgccatagctaggcacctaagtgttctgaccagcattttcagagcaactgatggctggacagaggttctgccagctgagttattataaagatcactgacagggtcttcaaacattgttagcatggttgaaggagatgtggtggctacctagtgtgaaccacacatcccactcctttaagcattctagttcactcactggatcaaagcagatgttgacaacaccagcttcaggaacgttatgtgtaagctgtcccagatggattagacatttagctgtctgaagtctgggccagatgttatcagggctctcttattgctttggaatgaatgaagtgtaccagattatggcaaaggaagctctcggatagaaggatgagtaaatcaagacaaaggaaaatgtagtagtggctatgacaagaagaaaaacttagtttaatattagctttgatacataaatttcagcactctcattactgacgcttcaagagttcatgtaaatcctgttcatcagtactttattactgctgctttccaagaaaaaaaaaagctgcagtgaaccaattatttgctttatttggaaaagctaaaatattcattctctgtgtggcaggttgaatgcagtagttgaggtgaatggttttcagactagcagcaactcaggaggatgtcaatttaaggcacaatacaagcttgattcctctctattttttatgcagaaatctttataataccctcaagaattttaaacctgtgtaaaaggtgagacccagcctaatgtattttcttgaaagatgagctgatcacatgttgcacccgagttatttattcaatcattaaatacttattgtggacccactatgtataaggaaagagctggcacagagaaataaagaaaaaatttaccataatacttggggcggggcttgtgttcccttagggaaaataaatcaccccctgtaaacaccattgaaattccttttaggaattcctggcatagataagagttacttaattgatcaattacacaataagtatgtgtagtgggtcccacactatgctagaagttggtggggaagtggggaagattccataatattagatgtgatttcccatctcaagcgacttatttcagtagaaaaaatctcccattcatgaaagcactggaagcaaaagaaggcaaaataaaatcaagtgctaattgtgtagtgtagacactgttaaataaattcagatttaatggtatggggttagccagaggggctttataaaagacaaaggccttgaagaaagtgaaatctttaaactgtgatactagtaggaattcaatcccaatatagcaaacgtcaaatggttaaagagtaacctcttaaaatttaaagtaataagtgaccatctaataaattaaacacattgacctcactacatttattggcatggaaagatgttcataatacattgtgtaaaacaggttacagaacagcgttgtataatatgattctactgttacagaattaaaatatctgatatgcatggaaaagtctagaaggataaatactaaaatgtttacagtggttttctacatgtagtaggcttatgggtgattttaattaaatttttttattctcccttttctaatttttctgcaacaaatgtttgtattatttgtataataactaagaaaacactggctttgtaagcccagtaaaatgaataatttctaaaatcactaacataaatgcatacatgtatgcatgcatgcagatacacacacacacacatacacacacatacacaaacatcttagagaaggaactgagaagagcagttaaataattaagatgacagggtcaatgatatatgatgacagacttaaaagttgactatccttcaactttgtggcctaagattggcatatgatccagaaaatccagaagttaattgggagacacagatttgttcactagattctaggcaattaaattgaaggttggtctttgaagactgagaagtaaatttaggacaaataaaaataaggccaaactcccacagaaggcaacagaaaaaaattggaatttgttattctagaggcaatatcaactgaaaatataagtaatttccagaatgatttagataaattaatggaagaaaggttcattgaagattcataattttgttaagcaaaagtcaggaatgtttagggtctgtgagatattcaacatacttagcagtggtagaaggtaggcacagaccttatcgcaagcaatgcaggctgaagagccaaagcaggggtctgcaggctctctgctgggtcaggttaaccctttagttgctggactgtggggagtttccaggaggtaattctggggtgggttgtggtgccagggaggcactctgagggttctggctaatagttatttatcaactagaaaagaaagcatttcattcttttaataacagctataaccatactaatgaatattggctaaaaatgcattatgtgccttggatgtgtctactgggacagacttcaatattttggctctcagaggcaaaatattgagattagtggatgggctaaagtgtggcaacagtctcgggattttgtaaagtcaaataaaatctttagatgacccaagggtatatatatatatatatttatttatttattttttacctcgagggctattcagtgaagcttccgatgctctcccaccatctccacaatgactctggtcaaagggaaggcactgatcaccagttcctgccaccacttcaaaattcttggacagatctttcgtctccacaagagatttcaacttgtagactttgcgagtattggtgtctgatagatagagtgattcagacacagggtccatagccagatagtatttgtgagcaggacttgtgctaaggaagagaaaagtaaagttattcaaggcaatttttcaacacgaaccccctgggctcagccttttttcacaaatggaaaaatcttttgatagatgagtgaattcatttatcttccttcttaagtaccaaggagatggatacttctctgtttttctaatagtgggtctaggtatgaaacaaatctaatgtatactgctaattcataatgatgctgacattccgataccatccatttggggatagaaagaaacagaagacaggaaatctcaggaggtcatttttctcttattctccatactcagttatccaattacctactagatcactgctgggtgtctcagtcacctcaaactcaacatatccaaaacagaagttactttcttttcctgctttccccatccctcataaacctacttcctttctcttgggcttctcaccttgcttgtggacaataccatcctcccaggccccagttgtcaattgaaaggcatgtccaaagctcaaggagtgtcgctaagggaggatcatgctggagatctactgccaaacttctttccaagtttccctttttcaattgactaccacagttttctaatctggtttttgttctttcaggacataatggaactggttatatttaacctttttaaagttataatggcaatcatatgattgtgtaatcgcatagttatacctcctaaaagtgaccctaaagttaccttgtttggattctggcattcttgaaacttttctattacatactcacaaggaatctcaagttatttttatctgtatagatggctgagtttgtttattattttgattcttcctaattttagtttttcaatggctacaataaccttagttttggagacattttacttgaacctaaggtttgtgtaatactgacatcatccaaaccccaaatgtggaagtcatccctaatccctcttttgctctccacatgcaattgtgtctgtaaactaactttcagaaacattctcatcttccatccctatgccattacattagttctatctttcagtatctctggcctggaatattttctatagatcgatatgtaggatgtgtttttgaaatcttaaatcatttttttcccatgctgcctgcagagttattctgatcatttggctcccatctttaaaaactttttaatgtttcttggtgtgttagccaagcctttcttctcttaattcattcttacatgtcttttgaggctttatttgggcatcatctcctgaaggaagctttcccagtcttcccttctccagtctgggttatttgcattatcttacctctattctggggattacatatcatattaaattatttgtttatgcgttgtttgcatctccctctcctgccctgccagttgcaataaagcttggtggagagcaatcttgtcttgttcatctctgatatgttcattgcccatacctctgcctagcacccagttgtcaaagccagaaaccagaagccattcttttctacttccttctttccaccatttcccacatccagtgaaaggtggtttttaaattctactttctaaattgttttccagtctgctcacttctttttatctctgctgtttttactctaaggcctcatcatctctcatctgaactacttccttggtaccatttcagtattgtgtatttgtttactaattcattaaaaatcatttattaagtgcatacaatgtatccaagaactgtgctatgttctagagacctacttgtgtgcaagatacacacagcttctttctttatgaaactcacagtctagtgggagagacagataagtagacaggatatgactaccatgagtccaagtgttatgacaggagaaacagaaggagagaaattagtaaagaagagggacttgtgtcttagcagcacctattgtatggtattagcattatttttaaaacttattaaatgaagtccatacttattagatttccttagtttttacctaatgttctctttctgttccaggatcccatccacgataacaaattatatttagtcgtcatgtcttcttaggctcttctgtgctgtgacagtttctcagacttttcttgtttttgatgaccttaacagttttgaggagtactggtcaggtattttgcagaatacccttgactgaaatgtgtctgattgttttttcttacagttagacaggggtgataggcttttgggaggaagagcacagaggtaataaagtgccattctgatcaaattatatcaagggtacatactaccaacatgatgtacactaatgggtttgaccttgatctcctggctgaaatagtgttcgtcagatttcttcactgtaaagatactctttctcccctactttccacactttactctttggaaggaagtaactatgcgtagccaacacttaaggagtagagagttatgctccacctccttgagggtggagtatctacataaattatttggaattcttctaaatgggagctttatctcgtctccatctattattaattcaaccatttatttatatcagtatggactcatggatatttattttatactttgcattaaatccaatgctactttattttgttgctcaagttcttccagctttagccattgggagctcttttcgttgactcatgtgtccctttgccatatccccatcaatgagggattttttttttagcctttcctttctttctggcactaccagatgctctgggctcatctgctataccccctgccccaatcctagaatcagccatttctccaaagactcccctggttccctttattggagaatggtattagaaaccaagatctgggtgctgggtgtaagcactattttttttcctaacatatctttctctccaactacactgtgagctctttgcaggcaggaaccatattcatctctctattctcagtgccaacagagggcctgacaggattggtgcttagtacgtgctaaactaaactgaactgcaggatataaaactaagacataaaagagttcaggccttgctacttaggcaaaatggaggggagagggtggtgagaacaatcaagatacctttaaggactggaatgttattaattgtatttgtaattatatttgccctccaagcatatttatgtatgttaataataatcaggcctgcaaatactaatttgagactgtttatagttttaattggaaaaaattaggttcaattggaatacttaatcttttcctacttaccttcatcaagtaagagaatccagtagattccagggacacctccaaccctggaaccaccataacaggtgctgtaaataaactatgaagggccccaacaaactctagaattgatttggtagccataccagacaaggcatctctctgggaaaaactgcttcaataggggtttgagtaaaattctttacatatatagttaaatttttgccttcagaataaaatttttccaatgtgctcagatctttctagaaaaaagaaggggtcaaaacccttctttgaaacaactacaatattttgatagccagtttgtggagtttcaattcagtcagattagtcatgctttgtttaggaagagtccataggccatttttccaagagaaatgctattttgctatttgcacaaaagcactttggaatgcagtacattcattcattattgaatacccccagtgtgcctgtgaggaaagttagaattagcaatctcctcaaatctcagctggggaaacccagacacatagggagcttgtccggggtcactaacaagtttgggcctggaccaagattagactagattatatgtgattttgtgtgcaaaataccatcagaatactcttgctctgaaggcagcaaaacaaatcagcgttcctgctttctaatgagcaacatgtcctattttgctcagccaggctgttctcaaactttgtgtactggcccttagaaaatagaatagcccaacataccaaagtgaaatctaatcaatgttattttcttgatagccagcagtcaggaaggtccctcctatcaatatgtaacttgccatttcatgtcatttctcaagtgtactttagctcttttgaggctgatttctttctactttctgaaaacaagccacacctgagaaagaaaaaaaccactggactatattccaatttgctttaatcccttgtgtctcaatgcaaattgcaatttgagatatgtgaagatttcttttacaacttgggtgttaggtttactatcaccttttggttagttttacattcaagcaatgctcttcaacttagcaaagatcacttcattcatactagttaaaaatcacatagattgttaaatgggcaattaatgtttataattaatactgtgcaacattttaccagtaagctatttgacaaccaacttaatttgcttaaggaatcagttatgccaaagtagcaaggctgatcgtctgtactggcatttaggaagtggcattgcccaaatgaaatccagattagaaaccccatcagtgccattttgatgacaattggcattcgggagtgaacaaattcaattttctcctttgcaatttcaggcaatttagaacagttttgacaagtgtaatgcgtaaacacattgaatagaaatattcattatgattaatttcagagctatgtaccattgtctgcaaacggtcagtttaaggttttcctattatttctttttggtggaaagaaatagaaacagtgaggtcacataaaagaaaaaaagaaaaaagtgtattaaagaaggtcatcatggtcactgtctcttaatacacttaaaaactgtacttctggatctagggagattgctgtattacctctttctctacctgcaatttgaaaacatcaaatctatttgaacttaccaactcatttgtgttatcaccttagggaaacataatgaaacttaaggccttgctttcccatgaagtactcaactgtcagctttcacttatgaattgttttctttttagtatgttttgatcctccagcaaatcctacatagtggacccttcttcttttggaagacacttacctgagttataacttccaaatttatgttcacactattctttaaccttatttaggaagaaaaatttccctattaacacattatcaggaggtagtctcataggcaagagggggcattaggtagctgctgatgtgatttgcttacctatgtctggtatctctgtttctagggtgcacaaggtatccacgagtggcaagcaaaagcaaacagagagtcatcagtatcattgaacatgccaaacctaaccagacacaccaattcctaactcagattgcggcatttagagagactctatggggatcatttagtcaggcgtgcaagccaaagttgatccaatccctccaggctttgcctcctaagatggtgtcaaggcgattgcatattttgtttggtggatgcgcaaagttctaaggcagatttttcaaaaggttctctctggaccatctgcatcagaatcacttggattcttgcacttgtgcactttcctagggttctccctagccctactgaatcagaatcttgggtggaggtggggcctggaaattttacttttaacaaagttggctggcaattctgatgcaaaataaaatttaggaaccattgaactaggggttgaagaagcagccacggcagagggactaaccattttaggctttggtttgatagccataagcactctatcaaagtgtaaaatcactgttttattatcaaattgtgtgtacagacagacatcccaacactaaccctaagccacttatctgatctcagagataagataggaacatctgttgtgcaaattccttagcaatattaaagagctccttaacaagttgaaagtgtaagagttttcttttagaccatgacagaatatccctgacagcaaaactgctgatcaaaacaacttcaataaaacacattgtacatcaactattagggctttgtgtcttctagccatccatgctctaaagggcaactggggtaggcactagaggactgttgggccagaagaaggacaatactttggtggctcctgatctgtaagcctcttggcacagggtattgcctagggcatttcatgatgggacctgatatgaggtttctcacacagggagtgcagtctgtgtataggcctgactttgggtcaagtctgcccagaattaaaaggctataatcatctgtgaaatacgatcattttaatttttaaaatccttttaaatctggccctatgtcattttgaaaacatagagataaccatttttttatctaaactaggaaatggtcttattctttggaatctcagggaagaagaaaatatacaaaatttttcatctgaagttatctgctacagcagattcaactctttttaaaaagaacctttctgagattttactagttgggccacaggtcaaggttcactgacttttctgtttcctttgctcatctcaaaagggtaggtatcctgtgggttgaaacaaaggtgaactgataaggatgaggagctctgattagaaacctggccgcaggcatttacgcctctttcaatttgtttgtctctagaaactttcatttgcacctctttcaatttccttgtctctagacacttgcctgtttttgtggcctctaaattatagaatgagtgtgtttgagcctagctgtaatcactgtggcataggtgctcctcctgaaagtttagttgtgaaagtactagaaggatctcattaaaatatggtttcatcagcagcagattctcatggtacagaaccatttgtgtggctacaaagggttttgaaattcttacatgatggcaaggagtgagagggggatggtttgactttcttgcagctgcttctgattctgccaataatgtcactgtgaatttggaaagatgtcccatattatgcagagcagcttctctcattaacatctcagagggaggaagtgaaaatgacggaatttatttccagtgtgtgaccttgttctgtctcagaattacttttcgttaaggatttaggactgagccaccaccaaagtcagtctgctatctagctaccaactgactacatgctgaggtgtcagtgtgtgagctcttcacaagggcctgggcccatccgtgggcaccaccacctggcaatggaccaacttgaagcttgccatgagttaggaggagaaagaaatggaatttcaaatctttttagagcaagacatgcttccaatgataaagtctttaagttgacctttgattttctcaagatccaggtgatgaaagggtcatgtactcttcttttttaatttaaaagaaaattattgatatgatttatataccataaaattcacccttctaaaatgtgtaattcagtggtttccagtacattcagagagttgtgtagcctttaccattattcaattccagaacattttcatcatgctatgaagaaactccatacctatttgtggtcacttcccatttttcccctccctcagctccaggcaaccacaagaatacctattctggatatttcatataaattgaaccgttaaatatttgtccttttatgtctagcttcttccacttaacataatgtaccatctattccttttatgtttttgtgaggtaagggatggaaaagaggacatatgccaattttggagctgttttctagtgacctggcatcatgagactctgactggcctgcactgtggtggctgcagccctttacttgttcttcatgctgttctcagcttcttttcatattcctggccagaaacatttgacattgaagaatggtctgcccttcctgctcctctttccttggtcttcttgctttagacatcagagcacactcctgactgtcactgacttctcaggtcttccaactccagcgaccctcatccaagactaccttcccccatgctctggctctgttccttgcccttatcacaacttacctgtcctgttttagggccctgttttcagctagcagtccctttgaaaagcaatctgataaatgaatccatatcaagggactcgtgaatgcttttagcttgatgagccattctaaaagaggttcatgttttcggaaatcttagagatgcaatatttcaattcaaaggaacatatttcttagagtgaaaattttgggcaccatggaaggccagtgaagatgtctttgggtgaggtggagggaatccttgagtaccactgctaatacatgagatcaaactggggaggtaaccacctatttcatctacacgtagtgtttctagtatttgtagctccaatgctgttgacaagaggatggttcatggccatttctgagatatttgtagagctctcaaagctccatttccatttgttccttcagcggagagctctacaagttctcctgcctctcagcattctaactgcccctaaatggctgctattccagttctactccattcccagtcaatgacaggaatcaagtccagagcacaatgtatgaaatattaagcagttgctggaaaagaaacaggaaaatctcaagagaaattttcatatcacattgacatttgttgaatccaaattactcaagataccaagaagcatttgccaggctcttattttcttatctctttcacttttaagggaaggacaaaataaatatctggagaataacaaaatcttgaacaacagcagcatgaggtttttataaagaataaatcatttccagtcatgcttaatgagttttctaatagagttgtgaaattagaagatgagaggggtacagggggatattacatatttgaattcttgcaaagcacttgatatggtgtctcctatttttacttacataattatccctgttggtttcagaaaacttaaaagtggtcctgaggctataacaatttaaaaagtcagctaagtcataattgatgggaaatagttgaaggacttgtagatgtttagactgaggaagataaagctcaggaacctatgacagctctcctcacacttgtgaaagttgtcaggtaaaagagggaagtgacttctgtactgttttagatgctaccatttgccactactgagtgaatttttcacaaacgcagattttggctgaatataaggaagaattttctaatggagcagtccaaagatgcaacggatcttgagaagtattgaagtttcccatgattgaaagagatcaatgtagagacaacaaaccatcaggcatggaatgggcacaattttggacctgataccctcatggatccttctaatactaagctcacaaatctgtgatgtcatttttgttctactgaaatctgtgtgtgggtctgcatacatggagcaaatccctagtgaaaccaactcctaaactatctcacatagaagtgaatctatcttaaaatttttttcaaggatgtatttttaaagtcgcagaggtttaattgtatgatcttataagctttccttctttattatcttacctcaatctcccactggaaggaagctttaagatgcatacatacgaatgaaatctgcaggaaacaggcaaaggggtactatatacttaaataataagaaataatattgtttctcttggcagatttctaatgatagtgatattgctgacttttccttttcctccttgttctatcaatggaaataaatgattggcaaccaatgaaaatgaagttatttttgaggtcagatgtttcaattggaaacgtttcggatcaatagggctgaggcagaaaatatctacagtcctccaatctttaaactgccaagggacatctggaattactcgatgtggccaaatatgaaacaaaaggatctagaagggcatccattaggggcaaactatatgtcctcccaaaatgtcatcaaactttgggctgagagctacacatctgtggatctctaaacaggttaaattgtatgtgtcatgtaagaggatgctcaagtataaacctgaagtcaattttatagataaggaagagaactactagagaacatagtacatcagttacataatgaataacctggcagaggatcaaaatctataaggctctctatcccattctacaataatctgttgacaatattgcttctccattcacaattttaaatacaaccaataacataatggctatattcgtctgtgtttccaaggaaacagatgactcaaccaagtaaagtgactaatttgcatggggcacagagcaattaaattaactgatcttaagaaaaatactggtatgaagtgaggtttttatctaactacagtagaatcaatgaacattatggttcttaagatagcacagccttattaaatcaacttatttctctccaggaagtttaaatttggaaaatttataaagcaaatatataaatccacaaattatatgtacaatgtacagtacacatataggcaactgatcaggatagatgcttttttttttttaaaagtgaatctaataagagctatattagcttctgagtaaacatgacagctaatgacagctaatgtgtgctgacataaactggtttgatggttttgaatatagtcaaacagttagggagttacctgtcaattagatcaaaatgatcatgtatattccattagcttatttctttgatggccaatcacaggagtgttggaatagagaagaaataattgccttttctccttgaacctaatgcaggggatattaaccatgagtctatcaaagggcttcatctacagggactggttgctggtggggcagtgggaggcagggaactctaaggaagggaaaaaaatgcgatcccttaaatcacatatgccattttgtgtgattttgttttctctagggagagggtccatagccttcagtagattctcaaaggagtctaacactaataaaaaaaaagttaagaagaactactctaaaggatctcaactcagaaaagccggctagcttgagaaaagctctcaagctaagtgagagagccttgatgtgtaaattcaaagtgtgtgcatgcctaagtgaagagctgagacaatgagagaaaatagtgtcatggaataagaatgaatagaggcattggatagtacttcaaactgtcaaaaactaatttttctttatactgtgaaaatcagtttgcaattagagtccaagttattctattttatacttcaaatggctttgtattgaaggtcataaggtactttggactaaaatgcaaatttgtaaactgttaaggatccttgaccaaaagagaatctcatcaataaatgacaattgctccactttaggtaaatttacgtttaaattacaaagaaaaggactaaatttagctggagtttaaaaaatattaatataattttttgttttgtttttgtagataattttactgtttttcctttgaggagttagctatataggggttagctatacaggctttatagggttaactatgtagactcagcaagaaaaggtctctgtctacctgacagtctggatgactggaaacattcagatgttgaatgaattgttcagcgctcccatctatatttggcattatatagatagagcatccctagggttttgaaaacaatgtggactgttgtataaatcatttccacatccaggcatacaagcaaccatcttggccttcctgttgactttccagtaagtaggtgcccaaagagatatgctgctggaaatgacaagtccccatgaggtgtaacattctgaggtacatgaacacttgattagggtagggtgctatgaattagtacctctctagactctctaaaagtgctttgtctttattataaagtcttaactttacagtctgttttttcattagctaaaggatttaacagctttcttccctatgacagcctttgctactataattaagaaatgtattaaaactggagtgaattaatgtgaaaaatggatgggggcttgggactagaagatttccccagctaggtgttagggaataacactcagtattagaaaatggaggtatattccatagcaagcatgagaatctgaaaaattttgagaaatgccctttggactttcacatgcttgtgtgaaagtaagtgttaaatgaaaatgacccaagacttttcatgtgttttaattggctttgatgatgccatgcacatacaagttgctctgtcaatgtctatgctcttctagtcactatatttgatcactatttgtcaggtcattgaggagatgcctgaagaaaaaattgttttatggaatagttcataggatagcatctagatcttctgaacatagagaaacttaaagccaaatgttccagaggcatgtgtcaggaatacagctgtcataactagaaagaaggctctaccagtttacccaggggaaaggaaacaggtttgtttattcttaaggagacaggagttgaagcttcccttttcttttatttatttatttatttattttttattattatactttaagttttagggtacatgtgcacattgtacaggttagttacatatgtatacatgtgccatgctggtgcgctgcacccactaactcgtcatctagcattaggtatatctcccaatgctatccctccccccttcccccaccccacaacagtccccagagtgtgatattccccttcctgtgtccatgtgatctcattgttcaattcccacctatgagtgagaatatgcggtgtttggttttctgctcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccataatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaggtgtctgttcatgtccttcacccactttttgatggggttgtttgtttttttcttgtaaatttgtttgagttcattgtagatcctggatattagccctttgtcagatgagtaggttgcgaaaattttctcccattttgtaggttgcctgttcactctgatggtagtttcttttgctgtgcagaagctctgtagtttaattagatcccatttgtcaattttgtcttttgttgccattgcttttggtgttttagacatgaagtccttgcccatgcctatgtcctgaatggtaatgcctaggttttcttctagggtttttatggtgctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggtaatttacagattcaatgccatccccatcaagctaccaatgcctttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaaaaacaagcattggggaaaggattccctatttaataaatgatgctgggaaaactggctagccatatgtagaaagctgaaactggatcccttccttacaccttacacaaaaatcaattcaagatggattaaagacttaaacgttagacctaacaccataaaaaccctagaagcttcccttttctataacaccagaagatacacatttgtgtcttataatctcagaaagggaagaaataagtgaattaagccacagtcaatttagtcataatctttgtggaacttcaggatatggaatactaaaagctacgaattccttacaaaaggtgtcaaaatactttgtactctcaagaaaattcctaaaccatgtgagaaaatttaaagataaatgctttaattatcatggggtagggctttcaagggtaaagaaccatttctccctcctttatcatgccatgaaaaccagatttccgttttcttgtttatgaaatgaccatttccaaagattggaaataaaaacttatgaagtttagccttttggatctgacaatacctctcccaactagaatggaatagttttgatgagtcttcacagtggctagcagtgaatgagtgacttacttgagtgcttggaagtattgagatccatgtcagtgtcagcactgtttacagggaaggacatacatacagggatgttaacacttcctgcttctccaaagtagtgctcaaaggatcaatccttcaagtaggaagagtgagcatgttgacctttgtccctattcctgcatcttaactcagtgctacaataggggcaactacattttctgcttctactggcagtgctttgtcttttcatattatcttgctttttgctttatctgctaagcaaatatatagagattagagaagacttaccttaattccaaaatactaacggagtttcccgagggaaatattctccttacaaaattgaagtcgccaacatacacactgccatcagggccagaagctaaggcgacaggagcaaagagtttgttgttgtgggctgggccattgcagttggtgcaggctacactcctttggtgtccattacccattatggttgatatgactgggggctgctgggaaatgaacatattttctccattccctttatgtatgattcctagattcaaggaaaacaaaaagagaatttaagaaaagcaattaccacaaaataatctcagcaatattttaatttattcttcatcatcccaagcaggaaggagctttggcctggcataagagaacctgagagtgaaacacacactttcctcggttttgtttaactgcataaccacaacaaatagtagcataatactttgcctcagtttgtccatctgtgaagtagggtaatacaaccagtccttgtaatgttgattctaaatgactcaataaagcatttgatgactaacttttaatgacctattcactctgggctctgtgaatcatctgtggctacattttcatatctggctggctcttttctgatgcctagcacatacccgtctgacttcaaattaccctcactatgaaaccagttcctgaaacgagaatatcggtcaattttaatattaaccttagcaaaacacaatcaggaaggtaatctacttctgtgaaaagaaaagaaatcctactgctagaatgcacttcaaagaaatatgaaagaaacttgaattttccactcttttggaccatatcgcactatcatcagtgcaggaaatagagatactgacttatgaaaatgctttgcagacattctgtgtgggcaatctcatccatacccacggctttaactcccatttctatatgctgaaactttctcccatccagagttcttaactgacatgccatttccttctagacctctttacttggatcccccgcaattacttcagactggaacatacaaaaactgaactcattatttttctgcaaccactcccaaaccctgctcttcctcttgtgttccctaatcatcttgtgagtggttgtaccatgcatacaattacctaaattggaaatctggacatcaccatggctcttctttccccccattcttgaaacctgattaatcattaactcccattgagtctatcccttaaaatgtgttgaaaccagttctttctcccctattcctacattagtttagtttttcttaacttcttggtctcctggtctccatgcatatccatttccagatcttcgtccccactcctgccatagagattatttcagtctgtggtttaatacctttcaatagctccatatccctttaggataaagggcacattccttactgttaaggcacaaaaagtccttcatgatttggcccttgactacttcttcagtctcccctctcatcatgctttcatctatatcctgagatctagccagaacaaactacttatggttactttcacctacttccattcctctatgtttttgtccatgctattgtctttatcttgaatgccttcctcatcttgtctgcttggggaggttctattcatcctttaaagctcagctccagttttcctcaatgctccatccaggcagagtcagttactccctcctctgtgtgcccatagtttgttttccatagctctgttataacatttaccacatgtgtgatacagtttttattacttctctgtctttcccattagaacatgaatgagctccttgaaggcagatcctctgtcttactcctttctgcattttagtgccaatccctgtggccaaatcattataagtgctcggtaaatgttgaaaataggctttgagtttctcgtagtttccttgtctaaattccaatgattttgcaaacctgctgagcctgggcagaaaatccgaggaacaagtactgctgtgctaaatagctcaagtcagcccagagtgagccagggcaggtgaaacatccatgttgtgggaaggcatgcccatgtgtcagactgaagtcactaatagcaaatgaatgaatgcagttatacagttaagccttatttttttctccctttccccctgctgtctatctccttgcattgcctgttattctccctaaacatttcctgaaatgtctctttagttttcttccaactttgggtaccacagtcctaccacagaaactattgatcactctgaggtaggaacattgctggcaaaaataaacaagagggtaaaacatgctataataccatggtggaatatatggttggaaagggccttccagcaaacagaaatcccatccatcatatagtattggatttcaaatttaagcatttttacttttccttccagggtgatttctggctacttttgcaacacatgatttgcaggagcagctgtgagtttatgccctaacaaattggtcttttattgcagaactatgagatatcttgaggatcactactttcttattattttattaataactttattaggtagtagggacctttcttaagatttagaatagttaattaagtaagatgaataggactgaatttcttttctcaaaaaacatttaattgcagtgtggtcaatattgtaattcaaataaattaggaggaggtgaatgagaactggaatgacagttgcacaacatcattgaagagaaatctcccgatgattgctaacagaatattctacaaatgagactatgatatgttctttaataaatgaggaaaccactgtttagcatgtcagtatttcagcaatgcactatagtgtatatcattcaaaaatctttccaattattggcttggaaataccagatttgctattaacatctattttcacaggtagatctccatttttttatatcaatataatggtatagttaacaattaccctcaaaatgacatgttattaccagcctcctggcaattttagaactaaagatggctattctaaaccattcttctaagcctgcaattctaaaactccccttttctattagaaagcccaacactccatcaaagaagaagaatgattaaaggaaataaaacataaggcaatgtactttctgattacatctcaacaattgatgtctggctttcatgcaaggtactaaagtgcccgtgtactgaaatgaccatttctgtttaaagctgaagcaatcaaaacaaaaatgggcaaaccccttttgtattgccctggaaaaatagatcattttgaagggtgtttttgttgtttcaagaatctgtttaaccttccattacacagaaccagggcataccatctagcaaccatgatttaacaccaattcttttgcaaaatgttgctttgaaaatattttgtttatgttcctagaaatcttgatcaattactgctgcctcctttccagtttcttctgccacacatgctcattttgaaaagggaatccaatgatcctaggacaacacacattatttatgtgaaggccaacttcctgctaaggattgggtatcttgtttacagttaacgaaaccccactgaatggggcttactgcacattttctcttcaaagttttccttttctttgccaaaaagccaagcccattgtataataaggtaagcacacttttaaacataccagtcataccctcttgctactttgttcagaacttcttttgatgcttataaatatgtctgaaataaaaaatctccttgaaagccagtgggtggtgctttatgctgatttcaaggaagaaaccatttttcagatttatgaacaacaaagagacacaacacatatttctcttagtacttgactgagaggatataaacacaaactgggaggtatgccagtgtgatcaatggacatttacttctcctcccagtaaaaccatttgtcggcaaactactggcctattttggaggataagttaaaagaaattctttaccaattttgagacagatgacaatacccacttagtgccctagattgttctttttaataattttaaacactcgactgccaggaaaccctaggggatatgtttggtaaaagatacaccaaacaaatagcttagttctgtaacagatatgcacaactttcttataattttaaagaactgagttttcttaaaatgaatgaatataccctctttataatcactaagaagatgaacttaaaaggaataatgttgaaaaccacaagtttctgatgtttttatctcagtgaaaatcagaaccatctttatatatcaggcctaatattgggaaacaattctccacaaccaatggttaactgtcaggtaaatataattgcagcaatggaaatgacaaatggtctgaaaacactgcctgctagaaactacccattgcataatgattttggagccaaagaaaactgaagaatagaatggcaacagacatccagtctaattacaggtgtctttttaaccagtgagaggaaactgggggaagatagattcttgtttttaatctgctatctgtctctgatcaaaaaagcaggatgcctaaagagttacgtttttttccagagagaagcagagtgggggaatttggagagatgttgctcttgccttaatcagcttaatcagtcagaaaagactgtctgacccgagggggaaagagcattgctttctaaattggtcttcccaaagctgctccatcacacttatcattcctgcctctaaaactgcctttgtgggtgggatttagacttcgaaaacatcccaagagaggttttcgtgtccaaggtcaggctgaaaggcagcagcagagctggcttcagatctgtttcccggcaagtgtgatgagttcttggttggaaatacacatctacaaatgagatgataaaatgaacaaatgttcctttttaaaagactatccaaaggaaggcttctttctcagaataaatttctcagaaaggtagaaacacaagcagatttagtggggctgtgaatgagcacacaaaatcttttgggggtgataaaaatattctaaaactgggttttggtgatggttgcacaactacaaatttactaaaaatcactgaagtgtacatttataatgggtaaattttatgatgtataaattatacttcaataaagctgttaaaaattctcagaaataatttgatgcctattacctaaaaactaattactggtgaattggagataacacatttgtgaaaatcagggggccccccccaaagccaactttctgaatgactcccttctgttctgaatgtttcaagtctgtgtgaagcaaatggtaagaggatacaagactgggagcacacagctgggggctggctcgattgaggtcatttcccactttgtgtttaatgtcaatgacaggcatttgaaagagacaatccatacaagccaatataagtgagtggaaaagaaacggctgcttaaaatgtcaaactctttcaaatcaaaacagaaaacctaataatttaataagtggcatctgccctttcatttttgtacttttaaaactgtggctttccttttgacaacagaaaaaagttgaccttttatatctcagcctgaatctttgctcttaaaaaaaaataaactgtttgatatggaattcagaatcttccttgaaggaggagaaagagttataatgggggcatacagcaatagactcattcaccttcagagtcccacactgggactatagtaggcggtctctttctatggttgaagtaaatctggttagctttgccattcaaagtttctcagcctgtggggctggttgacatagctgatttggctatagtacagatgaagtgatatcataggtgtgattataaaatggatcccttagtttggtcagttcatggccttataagatcgcctcgccttaaccacctgttccacaaagttaggatggatacaaggatggctggatggaagtgtgtaggggcttcagtacattctgatccccaattctggaaaaataacccaatgtacatgtcctactatagcttgttcagaatctgtctctttagatgaaaagggatatgatttcacagtagacgctcagaggaaagctgtatgaaaacaccagtgacgggtttcccactaagatgcaagagtaggtgaaggaacttggatgaaggagttataaccagggtagcaaactcagtttgtctgggaaaagcacaaactcaggggccacctctgcccccttctcctgatttgtttaacatttaaatcgcaaacaaggagaacagcagggagagtggtccaaagaagggatagattaagatgagagtgttccgattcttaccacactaagagtaattcaaaatagaattattatgtttaatgcggtcatctctaagtagtattctcacaagtaatttttatcttgtactttccaaattttctgcaataaatatgtattatacagcattaggaaagtagtattcatacaaatttaaaaagctacttaccactttgaggattcaaaatgtgatgcttattcaaagaccagcctcctaggttagaagcatccatctcaaaaccttgtaaaacgactgtcctttgctcccagagaataaagtcagggcacgtttcatattcatatcccacagatactgcaaacaaagagttaacagcacattagaaaactgtaaaatatttgcttcatgtttatactagttgataattctgtggatatcactttggctactgaattctgattagagttgaaatttgactgcaaatttctttcacctagcacagtacaacattgcatctagcatagcattggtcactcaaaagtgatcagggcatatcggataaatatatgaaggagtgagtaaataaatgctcttattaggttggtaccatatgtttatggacattaggctttattttgggcttttgggttggaggctgtgctgtaaaactgaagagagatgctttctgcaggattaagctgtggtagtatttctctctgcctttgtaggagaagtgcaggtagggctggttttttaccactatagtgaaaaatgcactcagcaagctgcctttggagtactaggtcacttatacagcaaccaactacatatgcaactaatacaaatggatttgcccaatttatgttttcctgtgctaactggcttttggtttgctgagactaagtttgcttagagtgttgcaagtgtaaattccactttgtgcacgttatgttttggtttctgcatataactaaccaatgggacatcacccaacatttgtcctcaactgctatgcagcacagatgttgtacattaaacgtggaacctcggtatgccactgaaatgtgaaatgcagaatgtggtagcttgagagtctttgctctactgaactatgtatagcttaagtataccaagtcctagccattttccctcttggaaacctgctcacctgttggaaccccagatttctgattcttaaatttacaatgctttctatcctcataatgttctaagcctgagaacactggctcattatactgcatatcctgaagcggctttccctctttctggcagcttaaaatagcccctgttggtctgtggtctgccatagctttcgagtacctgcctctgcctgactctttagatgcccctgaagagctcagtccttcctttgtcatttggttatgaaaactggaagtgaaaatgcgtgcttaaacaatgccagaacaataggtccgaaagtgaaaaaataaagccaactggttttggtttttggcattaggtgaagggaaaagatggtaattttagtcaaactgatttgtgtgtgcatgtgcatgtgcatgtgtatgtgagcacattcacagagaagccaaaaagtccctgtaatcacaaatatccaactctctgactttgtggatcatttgtggccaattttaaattgcaggctggcttctctttgtcctccactctaccaaagcttataacagggatcagggccatcttcatggatacgacccatgcttaggagggccccacacttgatttaatgctctgcagtcactgtcttgaagtttgtaatactttttaaacaagaggctctgtatttccgttttcatttcactgggccctgcaaattatgtagccattcctggcggggatgcccttctatcagccatcagctggtaaagactcatgaaatgcagactcattttaatataatcctcaaccaagcgttattagcaacagaggccaacggactgggggcgggggaggaaactaatcgtctctgtcaatgctgttctctattaacagtggaaatagactctcagaggggaaagggatctcaaaggtaatctagttcgttacacttatggtacaaatcaatactgtctacagtctccctggtatctcctacagcccctctacttgctaaaacaactctggtaaagtgcaaagagttggttttggaccaagagttagaaaagacttcaactctcagatctatcattaactagctgtgtgggctcaggcaagttattctccatttctggagttgggcttttcactggtagcgtagtgggagggagtgactagaactggtggttcttagacgcttttgggtcagggagcactttgttgtgagtctaattaaagttatggacattcttcctggaaaaatgcatatgcgtacaaaattttctatataactctagggagttcactgactttctgaagtccaaataaagatctcagatcaaagacaactgtagtagacaatccttttaatccttctttagcactaacactctaaattgcattctttctagattacatttggtaacttctggttgaggatcaaacccaaaagccaaatagaacactgaatcttatgctggaaaaatcaggtggttagagagcacactgagggccatgttggtgtgtaggataacacagtttctgcttctcctgccaacatttaaaagtcttgattaataaataatcacaacgacaataattacaagttcccttaaagccatcatctccttccccacagtactcctggcaattactggatttgccttctgtacattgtaagtctggtgagctctcctaagaatcccttctccggaaggtgattgcgcagttttgcaaataagtagtgtgccctggtgacctgtgatggtggtttggagcctgctttttctctctcagtaacagttaaagatcctcccaactctgcagcaggaaatgcttacataaagcatcaattaaggagttctcaatgcagtggtaatgagacatacatactcttttcacctcctcctatctgctctctgaattgctctccagttcacaacaaaaaagtgcattggctgcaaaccccacaattatattactttttttccccagccacagcaaatagcaacaaggcaaccacttactaagttccctctaatttttattagatttactttctcccaagaaagctctatgagctaatgaagttataatttatatttaagacttgtccaaaatttccagctgactttaatgaggatagctgtgtgtcggggtattttcgtatgtggctccttgctcagggtaacaaggcaaagtttctttctcacagcagcccactttaacataatcctggaacttgcaatcagcttatgagaaggcaaatgtttcaccccatggagttgagcttctctccaagctcacaagaactagcaaatacagtagcaactaatcctagactttgtcatggaagcagactattatgcactaaatgcctacttttttcacataattaaatatagggaaaaaaggttacactgcagctggcactgaaaaccctgtcttgacaccatgctctgcctgacactatgacagctgagcctcagctaaataagcacagtggaccactaccatttcccaggcggcctgttgtctatcacgtctgatcatcaacatagcatggtacagggcacggattcagtctctagcactctggagtagggactagggagaatagtgtaatagaaaggaaaaaaaaattcattaacatctcagagaagctgtagaaagtagactagactggcagtgagcaggaataagtggataaggggtcctggactacacttcccaggggttagcataatgggttcgtgctggtgtgcatatattgagaaggcagttgagagtgagtaattattatggaataatactttctctgagccatgtgatcacctcccttgtgactcttctaatttcatctggatttctgccttcctgtattctctccttcacctccacacagagatattaacggaatgctccttaaccaagagtcactaattgtctagatagtcgtgttacttttgcagaggattctatcctctggtcacaggattgcacctctgacttcactgttagtcatcttgcaaatattacactggcttgtaaagaagactgagtaaaagattgtagcttgctcctccaaagccatttgacattggaaaaataactgaatgttcattctacttatcagagcagcagcatttgtatgacatggggatggcaagaaggctgagggtcacggcgtccctgataacttagtttagttactgtgacattcatctataagggctaggataggagattgacattaagtagccaaggtaaaggtgccatgcaatgaagctgacgtgtgaaatatgacaagattaagcagatgactttcaacagcttcaggctaaggcctcagaatttataatggttgcatttatgaaggcaatatataattacaagtcgtctgatagtcaatgtgagaaatttacatgttaccttcatgaactcagggaacatctaaaaataatttcatgatatttaaaaggtacctaattacaagatgaaaatcttcttctccgaaaggaattattgaatatagcaataaatattttccattcttttaaaatacaagattaatgcaaaaacaaaaacaacaacaaaagacaaaaaaccgaaagaaccaaatgaaggccatggcaaaatagaccaatactatgtagacaaaatactatctatgtaaaacaagtacctgctctcagagattcttctatctttccctattctctagtgatttatcgtaggataggatgagcccagaggtttctcaatttgacacactgcccagtggcctgaaatactttgtttatctattattcctagcttactaagagtgtcagaatcaggtgttgaattttcatcaagtgtctttttgacacttacggacaaattcacatagttttcccctttaatctgttaagacagtgaattatagcaatagatttcctaacgttgaaccatctttcttgccctaaaataaactttacctggacatgatgtattatcctttcagtgaatcactggatttgatttggcaatccctgacttaagatctttaccctatctatttacaaaaataagggttaaatatgatagtgttagagtgaggcagttgaatgaagagaaagtacaggtaggaaattaaaagaatccaggagtgagacagctatgcaacacttttgccaagaggttccgtacagtaaaacctgatattatgagatttttttctggctgctttgtccaagcctagctgcataaaagccaacatggataacctatattgccatcaaaggcagagtgatatactggctcatgtataacatttgtgagtgcctttgtgtacctgggcactgccctcctctctctgggcagacccaccattccattatataggcaaggctaagggatcaccctgatcctctgttggtattcatttctttgttcggtcattcaacaaatatgcaatatttcatgggtacctcttgttgacaggcagtttgtggggcactggggatatgaggttgaacaagacagcatccctccccccagtggaggttatattcaagtgggaagaacaaatataaaagtaaaacaaataacacacacacacacacaaacacacacacacacacacaaacacaaattgtaataaaggttatgatgggagaatgctgagcattatgagagagtgtaaccaggaaatttatgttggactgtggaggcaaggaaaagcctctttaccaagaaagggtttacctttataggggagggcattctaggcagagagagtggcatgtgtggaaggccttgagacttggtagctattgagagatttaaagaaggtcagggtggctagagagtcagtttctctccagtgcatcaaaaacaagtgaagaacaacaaccctccctgtccctacccagtaaaaaattgtaagattactatcccctagcagtatttaggcatattttgaggggaggcaggggttttggaaacagactcaccttgaaaatggactggctatcctttgaaacaatgtgaccgactaaaagggattcaatattgtaatggaaagtgaggtgctgttatttaatgacacagcaaaccttcgccaagctgctctacgtgccaggcaggtgatctgtgaagcactggagatatactgaatattatacagggaaggataatttttcatgtgagagaagccataccttgaaggattacctactttctggaatttttttttttttttttttttttttagacagagtttcactcttgttgcccaggctggagtgcagtggtgtgatcacggctcattgtagcctccacctcccaggttcaagtgattctcctgcctcagcctcccgagtagttgggattacaggcatgtgccaccacgcctggctaattttttttttatttttagtagagacggtgtttcactatgttggcaaggctggtcttgaactcctggccttaggtcatccacccgccttggcctcccagagtgctgggattacaggcgtgagccaccatgcccagcctactttctggaatttttatcaatgatctccctaataattaccacaaaataatatgccttacatttgtataatacataacaattagatatgtttttgtgcatatgacctaatttgaagactcaaactcatgaggaaactatatttactccagtttgatagatatcatagagactcaaagaaatgaagttattaagtccaaggtcacatggttagtaaatggcaaagccagagctcaaacccagtaattcataggcaaatgctttcatctactatgctagataacagctactaagggggaagacccgcaattcagtagtgctaaataaataactttttatttgttcagaatttaagagacaaggactggaagctagggatagccttgaagtagaggtgccatgtaacccaaatggccaaaaatggtgcttggttatgttgttttcttgatgtaattattaacagtatctccttttactctcaaaagtatctggtttgaatgataaattatgtggtcactcaatgttgaaggcatacctccgtagtcccctctgatatgggttggtagaggggaccagaagacaagaacagtcataaatgctgatttggaaaataagtcacatggtttgataagtcatttaatttttctgtttctgggcttatcatcttaccaatggcttttaaactttcatgtctgaaagtcatgatgagaaacacaactcgttaattgtgacccagcatccacatggggagatacacacacacacacacacttgaagtttttctgagacaatactgtctttgtagcatcacattctggtatgttctatttaattctgttcacttcggttctattatattccatcacattctattcaatttttcaaaacgaaaacgctggttgactcaccaaatagatttcacagtctactaatgggtgtgaccagcagtttgaaatgggcacaagaccacttgcttatgaaagtattagtgaaggccatttgaaaaccttggtaggaactcttacttttggatatcctatatcttataacccatattaaaatgtatacaactcatatcctacattaaacatatttcatatgtaaggatgaaaattgagttgtagttcacaagctgacatggtgctccatttttcagacacttatttaaacatttattaacgttgattttcagatttccttttcatcttctggtgacaataaactggttttttaggtagcaaacattttgtaggtccgtgaaaatctcatatccttggcactgtgcctatgaagttgaatggataaaacagccctgctttcagttaacgattatgaattcatgagtggagagaaatgatgaaagattattatctctgctagcttctctgatagaaaaccactggggcattgaattgggtactcagtaaggtgggttggttactttagtgaggagaggcagcattgaaaggcatacacaactcaggactgggagacctgagtttgaatccctgctctgtacaggactctaggccagttactttttctttctgaccctcagtttccccctctgcaacatgaagatcatgctaattctgccatgcctaccaggcaggaatgttataaggattaaaatgagataatatatgtgaaagtagtttgcaaattgtaaagcactactcatttattattaaaatattcagtggatgctatttttgtggctgcccaacctgcttaggttttactgaagggaaatttatgaacgctaaagcatcgttctcaggaatgttttgtgtgcacaaagcaaccatagcttagcacctattactattaatgttcccctgtttctctctaacacaatttagacagactcctatgtgtcgtgaacctttaggaagtctagttttcccagaaacaccattcttcgttgccaaactactatactaaataattatgcaattgttgttgccaataaccttgaagaaaaatagaattgtttatagcagagctactaacagcggatggctgatttcctgaacttccaggactccaaactgctgcaatttaatttaattaaaataaagacgaggcagaatgcattattacatattgataatgtatgcagacacaggcggacatcgggaattattttgacaaaattcacataatggatgcagatcagagcccctgaacaagccagtttgtcaaattaaataagccatctctagaattttaacagccctgtgaacttaacagtaatgatttttttttttacattgttttgcaagcagcagagttgggaaagaaactaaataaaatacaatgatttccagacatcgtactttatttagagtcaaagaataaagcactaagtccaaattatttaaaacgctcacatggagtttttagcaggggaggcttgtctgtgtatcagacaacaaaatctttaagccggatgaactagtgactgtgacttttgtactggaaccctggggatgattttactcttcttccacttgatcaatattgtacttggattaatcaatcttatcagttaccactgatacttctccaaggaaggagttcatacaacccctgtttgtaatttattcactctggtattatcccttcagttgcaaagtctgtttccttacaaaaaaatggtggtatatcctaggatctcaagcacttcttttctcattttcattgtctctcaacactctattcttctcttgtgatattctagcccttagagattataccaattccctacagccgagctacatggaaaacaagagtcccacaactatcaaactaatttagatattcaccatcactttaaattcagcttgtttaaacctgaacccttctttctccatcacccagaagtgagtgggccagagattcatatttaactggcatgggaggagaaagagtgggagatctttctagtcacagttttaaccaaaatcattgctctaactggactgcatgaatgctggtcatgtcttatattagtttccaatgtctgctgtaacaaattaccaaaaacttaaaggctttaaacaagaaaaatttctcatcttacagttatggaggccagaattctcaaatgggtctcactgagcaaaaatcaagtgtccatagggctgagttcctttccagaggctctaagggaaaatccatttctttgccttttccagcttctagtaggtgcttgcacgccttagtttgtggctctcttccctcatcttcaaagccagcaatgttgcatctctctgtgcctttcttccatagttatatcctcatgtaactctgacctccccttccactcccttctctgtttataaggacccttatgacaaattgagcctacccagatagaccaggataatctccaatctcaaatcagaagctaacaatctcaatttcatctgtaaccttaattctcttttggcatgcaacataacatattcatggtttccaaggatggacatctttgtgggggtggctattattctgcctaccaaatagctatactagtatttctgaatttgaagcaaatctgaaaagtgtcagatgcagcactgttgctggtgcaaaattcagtctatttcctcccatatcagttaagtgattacaaaatatcaccaggagtacaaatagacatttccttctttgtttatttagatttaatcataaatattaaggtatcagctcaatggttgtatatttgatcctatgtgtttccactcatttatcatctgaactatttatcatctactgtgttcttatggagctcacaatccatcttcagagtagtagattctccagcttcattctaccaactgttcagatgctttaccatggtcagaaaatggatcttttggaaacattatgccatgaaaaacaagccaatagataaatccatatagacaaaatggagatgagtggattctaggacttgggggagggaggagtggggagtgactgctaatatgtacagggttactttgtggagtgatgatgaaaatgttctggaattagatattggtggtagttgtacaaccttgtgaaaatactaaaagccaatgaattgtacactttaagtgagtgaactttatggtctatgaaatatacctcaataagcctgttattaaaaaaatgcagctgagctgcatttatgtgaaccctagcaagaaatgactactagatgctgtactggtcagctcttcatgagaggactgagaaaatttctaagtgtcacaatttaagaaaaaaagcaaaaaacaaaaacaaaaacaacccccatcgaaacccaactggggtctaaggaagatcataaagaattagaaaatatgaaaaactatttaaaagatcaaaaaattcaggtgttggttttttgaaaaattagtaagatatataggccactagctagactaataaagaaaaaaagagagaaggtccaaataaatacaactagaaacaacaaaggggatgctaccactgactccacagaaatgtaaataaccatcagaaaatactatgaacacctagaagagattaataaattcatggacatatacaccatcccaagattgaaccaggaagaaattggttccctgaacagaccaataatgagctctgaaacggaatcagtaataaatagcctaccaaccaaccaaccaaccaaccaacaaacaaacaaaaaccccaggaccaggtggattcacagcgaaattctagcagatgtacaaagaacagctggtaccattcccaccagaattattccaaaaaattgaggagggaatcctccccaactcattctatgaggccagcatcatcctgatgccaaaacctggcagagacacaacagaaaagaaaacttcaggccaatatccctgatgaatattgatgcaaaaatccttaaaaaaaaaatttgcaaactgaatccagcagcacttcaaaaagctaatccactatgttcaagtatgcttcatccctgggatgtaaagttggttcaacatactcaaattaataaatgtgattcatcacataaatggaactaaagaaaaaaaccacttgatctcaacagatgcataaatggctttgataaaattcaacacccattcatgttaaaaactctctataataaactaggtattgaaggaacatagctcaaaataataagagccatctatgacaaccccacagccaacatcatactgaatgggcaaaacctggaagcattccccttgaaaactggcacaagacaaggatgccctctctcatcagtcctattcaacatagtattggaagtcctggccagagcaatacagcaagaaaaagaaataaaaggcatccaaataggaagacaggaagtcaaactatcctgttggcaaataacatgattctatatctggaaatccccatagatttggtcccaaagctcctttagctgataacttcagcaaagtttcaggatacaaaatcaatgtacaaaaatcactagcattcctatacaccaccaacagccaagctgaaagccaaatcaggaacacacttccattcacaatattcacaagaagaataaaatacctaggaatacagttaaccagggaggtgaaaaatctctcaaagagaattacaaaaccactgctcagataaatctgagataacataaacaaacagaaaagcattccatgctcatggataagaagcatcaatatcgtaaaaatggccataccaccgaaagcaatttacagattcaatgctatttctatcaaactaccaatgacattcttcccagaattagaaaaaaaaaaacctctaaaattcatatggaaccccccaaaaaagcctaaatagccaaggcaatcctaaacaacaacaaaaaaagctggaggcatcacattactcaacttcaaactatactacagggttacagtaaccaaaacagcatggtactggtataaaaacagacacacagatgaatggaacagaatagagaggccagaaataaggtcacacatctacaaccacctgatcctcaacaaagctgacaaaaacaagcaatggggaaaggactccctattcaaaaaacagtgctgcagtaactggctagccacatacaggagattgaaactggaccccttacttacaccatatacacaaatcaactcaagatggatgaaagacttaaatgtaaaacccaaaactataaaaaccctggaagacaatctaggtaataccattttggacacagcaacaggcaaaaatttcatgaggaagacaccaaaagcaatcacaacaaaagcaaaaattgacaaatgggatctaacaaaatttaagagcttatgcacagcaaaagaaactatcaagagagtaaacagataacctaaagaataggagaaaatatttgcaaactatgcatctgacaaatgtctaatatccagcatctataaggaacttaaacaaattaataagaaaaaaattagcaaccctattaaaaagtaggcaaagggcatgaacagatgcttttcaaaagaagacatatatgtggccaatagcatatttaaaaaagctcaatatcacccatcatcagagaaatgcaaattttaaaaaagtcaaaaaataatagatgctggcaaggttgtggagaaaagggaacaattaaacactgttggtgggagcataaatttagttcagccattgtggaaagcagtgtgtcaattcttcaaagacctaaaaacaaaatttccattcgacccagaaatcccattctttgggtaggaatataaaccattctactataaagacatatgtacacaaatgttcattgcagcactattcacaatagcaaagacgtggaatcaccctaaatgcccatcgatgacagattggataaaaaagatgtggtacttatataccatggaataccgtacagccataaaaaagaatgacattgtgtcttttgcgggaacatggatggagctggaggttattatccttagcaaactaacgcagaaacagaaaaccaaataccgcatgttctctcttataagtgggagctaaatgatgataactcatggacacaaagaggggaacaacacacactggggcctatttgagggtggaggctgggaggagggaaaggagcagcaaaaataactattgggtactaggcttagtaaatgggtgccaaaacaatctgtacaacaaaccctgtgacacgaatttacctatataacaagcctacacacatacccctgaacttaaaataaaagtttaaaaataaataaattaggattataaatcatgctgctataaagacacatgcacacgtatgtttatcgcggcactattcacaatagcaaagacttggaaccaacccaaatgtccaacaatgatagactggattaagaaaatgtggcacacatacaccatggaatactatgcagccataaaaaaggatgagttcatgtcctttgtagggacacggatgaagctggaaaccgtcattctcagcaaactatcgcaaggacaaaaaaaccgaacactgcatgttctcactcataggtgggaattgaataatgagaacacttggacacaggaaggggaacatcacacaccggggcctgttgtggggtggggggaggggggagggatagcattaggagataaacctaatgcatatgacgagttaatgggtgcagcacaccaacatggtgcatgtatacatatgtaacaaacctggacgttgtgcacatgtaccctacaacttaaagtataataaaaataaataaataaataataaattaaaaggaattggaaaataaggacctatagagaaaaattggaggaattttggattatctgcctagtgaaggaaatgctgtaggataatatcatggagaagagaattagaggctttgagtatgattcagtgagggtctcagcaggaatgagatgtcgcacttgtaaatgttcaccgcagagagttcgaattaaggcatgggcagagttaagagaattatcaaggaagggagagccacctaagcactggcataactggtaagccttctgggcttgtagggggaagaggatggagtgatgatacagaaggcaagagagagcatggggatttggaggaggggctactagacaggggctgctattgtctaatgtagtctgcagtaaagcggggagagggataaataccctgagtttgttctctttctacagtctctagatggtgccactcattgaccaaatcaagtgggaagttaaagagcaaggtgttcagggaatgcagtccatggaagccagcctctcagagcacagagaaggacagaaaagagattatgcgtgtgtgtgtgtttgttgggggcggaggggtggggcgggcagggagggcaaatggagagtaagtagcacaaagtgcttgcctgttatactcacaacacccttcttagagaagctaaggcaacaaatacctgcatagactccatgctttatactatgtgatcacagtaccctggccacaacaaaatgaaaaaaagcaataccagcaactgacatttgttgaattcttacaatgtgccaagcattttatgttactcacctcatttaatcattatatcataacaaacctatgagtaacataatctttatgatattcactttatagatggagaaactgtggcatttggagattaatttatccagcgtcacacagctcgtaagtagagaaggaattatttgaacccggggaaggagtctggctccagagttgttctcataaccactacactcaatagaatagggattaagcaggactctgtaggctggtcagcaactttcacggcagcctaatgctaaagttctgccttacaagggtgttctggactgcacagtaaatggctgacacaatacaatattttctctaagaggaacctgaatatgagatacacagcaagttagcagaccacatagaatgtgaagagctgagagagagaaggagggtagttagtatggcaggaggagagatgaagtcagtcttaagtatggctgagtcaccactgtgggaagcagtggacttggaaaaacttgagctggttttaagttgacagagcagatgcagaccttctagaaatgcaatgtgtcctgaacaaggctataggttttgagtcctgcttgtgaggctaccgatggtatttcttgtactttcttatttttttgtgtgtctttacaataatttcccatttactgaggtaatatgaacctgtccatgttccttgcattccagtaaagtccaacacaaatgagttaattatttaaatatatgagggtctcttgggcagagaagagtcattagtctctctctctctctctctttctctttccctctgggaaaagaaaattgacatactatagtctaagaaatataggtcagctctgtaggaattataccatgctagacacttccaagggaggatgtctaaatgtctcttttggagagctttaaaataatcttctcatctgtccaagggtgatctacatgagctgcttcctgaaggtacaaggattaatggctcccaaactgcaggtctacagacctgtatcagagatacagaaaccttaggaaggtttctctgttttctacagagtgagagagataaagactttggtgttagtttatctctctctgagtgtcagggttcgattgcttgccatcatttcttaaaacagactattttttttcttttctgctattaaggtatccctcatatatgaaattatggtagtggtaggaatagtatagtatagtgagttcttttaaaaatattcttacttgacaaaataaaacattggcaaatctatctctgcctcattttaaaaaaatgccttttgtctgggagaattaaatacctgaaaaccataggcccaaaggacctcttaaggtccctgctatctataagattctaggttttaaagtcttgagattagagaaaatcaaaaggaataggaaggcaggatgattttttatttaacctgaagaagtaacaagttaatgaagtctaaccatcttagacataaaagatagtaagtggagatggccataagttagaattttgtagtctctaagtagaaatgacagtctaaatgtcaaatccaaaaacatggccttatagaacgccacaccaaaggtcacatttagaaggcagcatttggctctggtgacagttacaagtcagatattgcatgagtccattggtacgcagccatcatgaaaggagaactaaaatctttttgaagcaaaaatgtgtcaaaagggaactctaaactggcctcaaggtagtgtttaaattaaaaatgccttaggtcctttaaacagaagaaaatcagtaattattccaaatacaaattaacatgtaacaagtattttctgttctgtgcatgtaatactgctatttacatataattagttcaacatacccaaagcctctgccaggccccaaaccttctgtccatagatgtcggtcttgttccaagcaaatgtgtagacaagattaattgcggcgggaaaccacttctgtgtgagtcgcccttccacagctactgtgaggtgtacttttatcatgcctacaggaatcgttgaatgtgtcagaaggatccgtagcagggttttatacccaggggtgcggctgctcaggtaactcagcctcacaaagctggagggaatgggaatttcctcctgtacaacctgaaataaaaaaaaaaaaaaaaagccaaataggctcttgtcagtggtcgcaggtagatgaggatattgcatgctttgttgtctttgaaacatgccaaaggagagagcttaaacaggtctaaggacgtcaaggcatttgttcttgaatctttgtgagactgtatgataataggttttgaattttgcaccaaacctgaatggagacaagacccaaccttaaggattgcatttattttttccccatgccaggaaagattgtgtaaggaacaatttcagcttttcaatagtgttccaaaaactgcttagtaggagttgaaaaagatcataccgctgaatgtcaagcaattcagcactatgggctccattaaggggtctttttcttatacagacatacacaaaatcttgtttggtgttaagtcatatatcataaaaccattggtgtaatccttattcaggctaagctctctaagaggaagaactcaagaagcaggcccagcaagtgatattttatgacaaagattatagtttccctagaattaatctttaccgatgccatcaaattcgttttccttggagctttgaaatgaccctgaggccaaatttttaatcaaatttttcttacatatttctctgtgcctggatgtagcaatggctgggaacaagtttctccaagttggcacttgtgactgagaagcaaataactctcaccaattcctctgcaaattttacactaaacgttggtctcagagtaaaaataccatgtggctttaattaattgttattacttgtttgcttatcaccacagataaagttaaataaccaaaggtggtaactaaaattgaatcatgtgttctttgactttcatctttcaaaagacctctgaagaaaaagcccatcctattcaatacacttaaggtgacatgaatagcgtagatattttcatgctcttattcatttttacctcagaaccttgttctctcttacttttccaaacttgtgcacatagaagaactgattgttaaacatatggcatctcatattgtccagcatttttggtctttctcctgtttctgaggacacgataccttttgtgtacactttgccagtttttcttcctctaccttagccatttgataccagagttgtccaccagctgtcttctcagttggtgacagaagtacaatagagaaggatagcctgacactcaccaacttagtagttcattttcctaagaaaacatgcaatcctaaataagcctggaaactttcgtgctgaaagaagacccgtacttcctaatgacatctgtgaagggattggcataccaatcaaatgtactcattaaacactgtcttgttttttctccctttgtaagcaaagggcaatggaaaagataaggggtagctctttggactgcttttcctgaagggcagtatttttgtgtgagccttatctaagtggtattctctaggcactgctaagagctggtgggtggtgttatgatgaaagaacaatcaattctatcttggagcatgcatttccttctggatttctggatctgttaagacctatgagtccattttggtggtttccacatttaattatcattaaaatgtttctataatgtggtgagggaattgtactatggttgaatagtttaatattgaaatgacaatattgaatgttcaataaagaataattctcaggaatgttaaaatatcgaggttcaaaaatgtcttctcctgactataaagcttgaacactcagaagcaaagcttttttaaaaaaaaaaactgcacaggcttgaaaactacatttactttacacagctagatgagagaacttgtcatgtcttctaagaacaatgacaatgatacaaactagacaacaggaagaaaagtagatttctttttttttttttttggagacagagtttcactcttgttgcccaggctggagggcaatggtgcagtctcagctcactgcaacctccgtctcacgggttcaagcaattctcctgcctcagcctcctgagtagctgggattacaggcatgtgccaccatgcctgactaattttgtatttttagtagagacagggtttctccatgttggtcaggctggtcttgaactctcaaccttaggtgatctgcccaccttggcctcccaaagtgctgggattacaggcatgagccgccacgcccagctcaaaaactaaatttcttaaggagctttaatttcagaaccacaaacagtccaagctcatggattatactgttattactaataagccagctagctttgttcttagagcacagtgtttattaggtcaaagattggagtttaattcttatgaaagctacttaatcttgttctattccatggccacagacagcattctaatgccctgaccaattgtcttaaaaatgtatgccagaaaaacatttgaagacttctcttgacaaataaagggcagcacattataaggatggtaacaagaataggaaaaggaatttagctattatacactgttgaccactccatgatattattattttatacattcaaaggccaatatactcacctgcagctcaggaacaatagttcccctctctggacaggaccctccaaatgatgtgagcggtgaaggaagcacaatagggtttgggctgataaagttggagatatcgcaggatggcgggtctgatacaactctctgcatggtgactttctctaccacaataaactgattccaaggcaaccagagtgttctcttctcaggcaggaaaggggatcggtcgaagattaagatgacagagatgccaccgatggccacgaggtcaaagctaagaaggaaaaacataagacagttgcaatcaaatgaaaaattaaaaaattacagttaaaaaataggttaatttcagtgccctttcctttttggggggactcaactatatccacttgtattgtctattttataaattctctctagcaatgtattcattccgtagatgacttcttttcactatctagtggtcttctaggaagacattccatgtcaccagttgatattcccttgaaatttgtaaaccaattttttttttttttttttgagatggagtcttgctctgtcaccccaggctggagtgcagtggtgtgatctcggctcactgcaacctccgcctcctgggttcaagcgattctcctgtctcagcctcccgagtagctgggactacagctgcataccaccatgcaaggctaatttttgtattctttagtaggcatgggatttcaccatattcgtcaggttgttcttgaactcctgaccttagatgattcacccgccttggcctcccaaagtgctgggattacaggtgtgagccactgcgcccagcctgtaaaccagttaattttaacactatcttaaacaaaaatcactgcatgcatttctgcaaagccaaatctgacacagctgctccccttatgctaaagataacagaaagatgactatctaacatttagcagcatctttgagaatgatgcattattcattttccaaaaaatcctataatgtaacataagaaaagtaaggagccaaaaggttaaatatcttgttcagggtcacaaacatcgtgtcagaaagcagacagtgtctttgagatggcatttggagaaagatatcagcagaggacaattgttagggaaaatttctttgaactcagctatgcccgaccaagccttctacatttgactaccctctttggcctcctagtctacttgcacctcagatttaagatctctggtttgcttcacaatggtttttggtttctttttgtaagacagcctgtaatgaaccctgcacaacttcaccaacaactccttctctatccatgacaaagcaagactacctctgctgtaagccagctctgtctatctctagatgtggtctatgacaagactattgcattggagctgaacagattcagatttcatttcattctgcactagattacttctcttttaagtataatgacgtctttgagatgacgtacttgagagcatctgaaaagcataaactcctatataaaaaagtaagataatgataaattattatcatttttatgttaaaaatggataaagggcaatatgatgttacttaatattcaaggcaacttaaatccacaggagagagatgtaagcaattgcctgcattaaaaaagatctttcagcaaaacactttttcaacgataaaaagccctgatagggaatcagacttaattatggacatctcatcactctcttcctatgacatttattatatttattatagtattaccaatcgtgttttgttgcagaaatcttgcagataaagataaatgaacagtaacaaaggatggataataccgtgttttttattgctgctttttcagtaaagtagcttaatattaaggcagtttccaaaaagaggatttgaagaactgcattagctacagaaaataatttaggtttgaaccaaaagaaaaaagaaaacacaaacggtttatggtttaagacagagggtctgaattcataatactacaggaacagtttaaggcaagtgtagtggggagaatctgacactacttgtcaagaaacctttcctctagttcaccttctatgtggatttaagtatgtgttcttggggaagtttatctgcctcacccaaaccttgactcttgactcaaaattgaagtgcttatttatttaaaaacaaaaaacaaacacaaacatgaaaactaaataaactatccagataaaaacataggtgcctggaaattattctctctctttttaaaaaaaaacttttattctgtacttctggaaagattacacagacaggccaggcatcttgttttgtagaaagaatgtgggtttggtttcatatatatctgggtttgaatcccagctctgccctgttagctttgtgtctttgggctagttatttaaccttcctgagatgcagttttctcgttagtaaaatgaagcctctataatctatctcttagctgctattgtaaatgaatgagataaagacttaagggtcaagcatatagtaggaactcaacaactgttacatttcttctcaaatcagattcattgccctactacatttgccatatgttttcttttttttgtagttcaagtgaactataggtcagcttttgattatctccatgagcagatactgatttttaaggtctccttgggacttcccttaggcttcttatgatcgttcattttatatctctattgcctaggttatagttctaagttatttaatgaaacaccaatctaggtattgctgtggaggtctttcggagatgtggctattatctataatcagttgaatttaagtaaaggagatgatccttgataatgtgggtgggcaaaactgtttctgtgaggaagaagaaattcggccttaagaccactgcatctctttcctgagagtttccagtcttctagcctgcccgacagatttcagacttgccaatccccacaatcttataagcaaattccttggaataaatccctctctcaagacaataatatcaatatctatatctatgtcatatgttgtttccctggaaagccctgactgatacacttctcatctttccacctcgcagttatacacagtaaacactgcctggctgactcattaattgacatggagacggaaggtggaactgtggccagagatccatctaaaccatttccaatgccaaatagaatgctgaatgattacttctttgggatttctcccaccacaaaacacctccatttgcacgggccattaataacaggttattaagtcatatgagagtggatataaaagacccaagggagaggatttatttgtttggagattgttgtcaacacataagtccaaccagtcctatctacagatggaaggctattgacacctatgcaaattgcttatctctctctgcctcatggtatccataaatgaataaacttttgccttgaggagaatcaaagggaaccctctcttcatcttctagtcttcagaacaaagttcttgagacctttaatacttctcaagaaacttctaagaatgtcgtcacttcacctgttttgcttatcattagctgaactatttacaaatagttctctttcaacacttgactgaggactggttatatacctaagttgaaggtggtaaatcatagaagaaaagagcaagattacttgggtttaaatcttgaactctatccttattatctggataaattttctcatacaacaaatggggaggatgataataatgatatttatctcagatagttgtgaggatgaaaacagagacattcatgaaagtgtctaacatacagtagacactcataaacattcacctttcctttagaataggcttttttcttttctgctaagtagtcccttctctatgtgagtatctaatctcttcatacttttaaagggctcagtctttcaacaccatccttccttctgctttgaataaattactttggtcccatgatctagaccttttctggttctttagggaaacttgtcagtttacttttgcaagtagttgataatgggggtaaatatttctacatcccacatgacatatttgcattcaacggggactttgagagagctgacagcttcacccaaagcagtgataccattggtgaaaagtataagcactgtggccgactggagggattgagatttggacatggaggatcctatcagcaactctcatatcacactctctactaggtatctagatgctaatctcagcctttctatactcttttgacctcaggtatatttttcttttttcttttttttttttttttgagacagagtctcgctttgttgcccaggctggagtaacgtggcgcgatctcggctcactgcaacctctgtctcccaggttcaagcaattctcctgcctcagccacccgagtagctgggactacaggcgcccgccaccacgcccagctatttttttttttttttgtatttttagtagagacggggtttcaccgtgttagccaggacagtctcgatctcctgacctcatgatccgcccgcctcagcctcccaaagtgctgggattacaggcttgagccaccgtgcccggccgacctcaggtatatttttcttatgattttctacttttgaaatgtacttactcaaactgaggtagcaacaagcagagacatataaatggaaactctcatcacactgtcactttatgtccaggaaatgacagtggaacagtctggttggcatttggggcccatattttgaatgtttacacctttatggagcctgaggggagttattgctagaggggattctgactagtatctgtcatctacataaactcagttgtcactgtgagttcagcagaggaggggcttggggcatttcacttaaaactaaagacacaaaaataacaacaaagattaccctctttaatgttccctgtaaactgtacacaaacatttttagactttttaggtatcaagattcttttaggttcttgtgtgaatatcaaataattcaccgaaacctttgtatgtaagctaaaaaaatgaggtcttaccaggcctccacgagaagtcaaagtcaaatgtctcagaagacatattctatttagagaaataacccatttctcaatttgtggcatatggttgaagatgtttgcaagggtgaggctagttttaagcaccagttactggtgagtgcactaccaaaattccgttattcaatctaattgggagaaagacccatttgaattaatagagaactctgattatagaatatttgaaaggaaatgaagttttatatatatatatatacacacacatatatatgtgcatatatatgtacatatatgtgtgtgctaccaaaatagttctgctgagcttgttataatgaagagatggttagttagtaataagcaatataatttatacataaataatttatataatttactaaagtccttaagaacagtttattttcttaagtaggctaaaactctttcttattatctttttaaactaattttttataagtactttcttgacaggctcttggaaaaataaatccggcacagcccaagttgaacaattaacatttctaaagtgtctaggactaataaggtttgattgtaggttcttgaaatgagatagtttctcacagtgtgataaagctcgaagccaacaggtctttttttgcgtatgattattgaagtggcttgttatgagtaggacattttaagggtagtcacctggagactagggcacctcaaagccattattacagtgtccctgagagtcataaataggtacctttaagctggacacatgggcctattgacccaaatattctgaatcaatgtctgtctaaatgacggcaacaaaaatgttgttgtgagcaaatccttttccaggatgagaaggttttacttcaaggtcttgcttctcagatcttagagaacccccttagagagcagcctggtggttggtgcttcaggataaatcactataattaagtaggctggccaagcttgtctatcagttgcagccaatagtcaaataggcagcctagggaggacacatttttaaagcttctccattaatgtggtggaattctgtacttttggaagaaatatttttgatgcattcatttctgaaatatttgggggttactatggaaaaatagcctatgtgttccatagctccttatttatcatttgcataatgtcactgatctttgaagttggatttatagatggaattagataaaggatagaaaacttttcacatggcctgggtttcaagaagactcgagaaggattagaagaggaatccagtttgaattaattaggaaatagaggaaataaatatcaccaatgactttttgagatataacttgaagaaagatgggtttaccatcactgtatcatctgagccctggttttacccctggctagaagtcagtaattggcccccacaatgatcagaaacaacattgacataccttccatcttgccggctgatggtaaacccataatcactgtggtgcaagaaactgacattcactcccactagaggagttccatctatggccaccacttggcctcgaatcacacaggcacgcctgcaacacaagaccaaaggcaaacagaaaagcatgttgagactagattctagaagtcaagttgtagaaactttggaaaacagtcaagtataacaaagaaaacaataatttcaccaaccagtagaaaactactaataacattctggggaggagtttttttttttccccatcaaaattagaatcatactaagtatggttctgaatctagatattttaaggttaaaagcatattattaatattgtccaatgtatttagaaattccttaatatatcatttttgttattatataatacacccttaaattagtatcctataacttgcttaacctacccctgattttcggacattttgttgtttcttaatttttttctgccttaaatttcttattatttccttgagagagagtcctagttgtggaatgatacttttctcttatcaaaattaaagttaattacattagttaatacataaatatattgtaagataagactaaagtccctactgaccgcctttttcctgcttcttggtgttctcatcagaggtactcagcactattagtttgttgtgtgcattttctatgcatttacatatatagtatgaatatttttaagcctcctgatatacactgctaaagtgcctttttctggtaaaacaaccagccaaccaaacaaacaaatttagttgagcacactttaagttaaagtctgcaaaagagacatgatccctgacaatggtatactgcttttcttgcctaatttaaataaaatatttcaagacactttccctttaaacaaatgagtcccatccttactaaaaaatggaattccattaaactagtccctaaatagggctctctttcagggacatagtccactaaaacatacaagactttcagcgctagcctggctgacaagctgtaacaaatttcaggaggctggcagttaagaagagtgccctgggacaaatcccaagcaaggatttttttcactggtctgctgggaggaagggacagttttttcaccagagtttaatcctagtcttggcagccctgagctcttggacatgaattttatagctggagctggcagggttgaggaaggttgagcaaggtcagtgatttttcctagggcatcaataccacctttttttttttttttttttttttttaaccaagtgggattctgggtatccagggcagctcaatcttggattaaaggggaccatgttattcagacaaacatggcttttcagattaatcctaatcatttcatcctggaattatacattcttttaacagaatcagaaagtaaagggaggaatgtaaaggctcatggccacaaacatcatttgagagaaagtaaaacacctttgaataagctacagatggtagcttataataagccagagttggttgtatatgttttagccaataaacctcactactaaattctgttgcaatcagaggaattggttataagttatgctaataggatttatcctcttctacgtaagggctttcccaacaaaagttacaagccattaagtattacgcaaagtaagcgagtgtaattgttgctattagtgtttgtgtattttctgaactctcagaccaacattcatagctctgtgacatagatcagtggcttttttccagtgagctgtccattttatgaattatgtaaatcatggttctgagtggcatgcaaatggcatactggcacttgcttcgccatgtttgattgtcccaatttctgtatcattttgaaatcccatttgttctaatagagaagacatttgaagtcattgagttctggattttgaactaattctggcagatctggtcccaggttctaagtccaatgtaacaagaaatgaaaataaaaggacatctctgattttatacagtaaccttttagatgtctttacagagcaacttttgacaaggtgggtgtagattgaatggaaacaagctgagaaaatctcctgcaaatgacatatggattggttccaggggggctgtgaagagactgtagtgatgccaaacaatttagaaattagttaagcattgtttcctgagctctcaatgctgttagctgctttgggagtatggtgggggttagttattaccttgccaagcctccaccagttaacaaggtggcctttacaacaataacacctacctaggtgcttgctgattccctattcgcaagacaattccaaagtcactctttttatttgctcacattaatctagacattgtgtctttccacagctgtactaggctcaattatttttgtttttattttgtcaagcctagttggcattattttctcatattttatgacacacacagacctgtctctcctctctgctgttcttttattttctatatggcttatatttatgaaggtccaagctggtgagtgaaagtctcataaaagttatcattattctgtgcatttcccttgtattcctctcttccttcattctgtatctcgttctgagtagacttgtcttttgactcttctgcttcttaatattcctcatgttttatgaagcacacatatttgtgtgataatgactcatcaaagtcatcattattcaagacactgtctacctgttcttcttttcattcatttcactcttcatcactcataaataatgctcacagacttgtctttcaactccccttctttcttattcctcatattttatgatccacacaaacttacagcatatgataaaaccccataaaacttatattctacatttatcagtattgaactccctttgtaatgtattagactttaaatgttccaagattccctgtatcttgctgcatttgctcccattatttatacactccatgtcatccatttttcacgagaataactcttaggtctttttattcctggattactagtacttactgtaatctttgaacaatatcagtcatccagtgtcagtttaaattgtctaaatttcaggacagtattaaagtattctttttaatttgcagtaatcttgactgacactgcatgcagaaatttaggaaaaatctacctcttaggcaaactctccatttcaaaaagaaagctcttgagtgtacttgctttcccaggcaggctacatcagctccaaatggccattagggagccttcatatatattctttggaagtatggcatattgtgccacttcgttcagctcaactgccattttgtgcactcccagattctaaattctattttcttaataattgtggatggtagccttgtatctggtttgtttttcctgattccccacagccactaaaatatagttccttccctcccatttatataaactattttgattatgcttcttatatctaaggcagcctgtatagttcatttttttccaaagttagatcctagctgagtagtgaggtatgtacggtgagggtctgcctttgatattaccacagtcctgctttctgtgtttttcctattcccattatggtgcctccctgtttcctcttccagagagtccctggcttcctcaaatcaccattgaaattagtcagccctacttggcctgtacttggtctgcctcgaggaagcatcttgagttcttgaatttttgccacatcaaaactaccttcaacctgagttttggtccttaaaaatttgtctttttctgaaacattttcaattcaataatatatagaactcttctaaatctttcaagtaagatgatagaagctactgtctggactgtcatgcggctggccctgcacatgtgtacagcagctatgtgcccagcataactgtcgtttgtgttggttttgtgtgtctatatgtgtggtcttgtgtacgctcaacggcaggcattgcatactttctgtctttgcttgggctctcctttgattcacagacatgaatgagatggatgctttgcttggttgaacctttgaaaacaagaacttctccctgctgttgttggttagagcaagataacttgaacttagatgggcatgtccaatgtgactctagaaacatgcatggggaatatcacccctcacaagtgtcttttttcctgttctctagagaatacaggctgctgccaagctgtctacctgctgtcactatgctaaagcagcaaccccaaaggaattgcttctccactttaactaaatgctgaatcctctaggtgtttggagcttggtctgaagaacagagcatcttgggaaatgcaggtcagaatacactttactgggagccttatttaactaacaagctgcttgttagacagttctgatgcaaaaggtctaattcattctgtatttgttattttcatggaatagtcaaattatccctagccttcaatcaactcttggttccattctcctcttcccttatttgttgtcttttgtcttcggtgtcaaatctccgatattcgtttaacacctcaggcaacaacattaacctcaagcacaatagttggtttgaaaaacaaggctgaaaactaaattgctgaaagaagatgcaatttactacattgcatttctgattaatgtctttcgaaagaaaacagactcagggctagaaaagttacagcgatttccttttgttgctaacaggagcataagcagcctttgaagggtaacattcaaaatcaaggacctagccagcaggggatctagcagcaggtgggcaggttaggttgttttttttccacaggaacagatgaaatcctttctacagctgacagctctggtcaaaaggtagcactgagaaggactgggctgagagaggctatatgaatcctctgctcactagtgtttgaatcctgccccgtaaattcctctttgaattgtcagttggttcaagtctccaagggatagaaatttgtcacatatgaggtgtgactggaggattcccctaacaactgtagctactggggtctctgttggaatgcaaatatctctgaatagttaggacaaagggtttgtgatgttcctgttaccactgccatcacatagtgaataaaggggcttctctttagaaagtaattttgggattgtggtgttggtcctcagtcctgtatgataatctctctctcttatagatcagtgattctcaaacttgattgtccacgagaatcactggaaagccttattgaaacacagattgctgggtcgtatcctcagagtttctgatttagtaggtctggtgttggatcatagaatttacatttctaacaagacaaacctttgagaactgctgctttaggaaaagcaaggccataacatactcagccaattaaggcatatgaactcctggagagggaggcagaaggtataaaccataaaaaggcaggcaaatcgaccactggttcacaatcttacccttatgaaatctgtcaggcatgaattttaactcttccatataaacttctggaaaagggtttgcaacaactgtagtttggggagtcatgttgaaactgtcatgacaaaaggggtggctgtactacaagatgaactacagggtcttcaaattcagagattataaaatggaaatatgttttagtccaatttatttgtcccaaataagtgtccatttctcctccatcctcattattcttattatacaatgctcatacttgtgttattgcacttatcataaccggtcttggatgacagttttagatctgtctgtctttttattagatagccagggcaaaaactgtgtgattttcttccctgtgtccttctcagagcctgatgtacacagcacatgctcaagacaggttcatagaatttcaactcaaatatttaaaaatatagttgtaagatccttgcaacctatgctcatggcactgcttcaagcaagggcttcagtgactacgttgagattcctgtgtaacagatgccttacactttatttattagaagccaacactctggattgagcattaggacattctcatcaggagtgttttgtttgatacttgactattttagggaattaaacagtacctattgtgatcgggaagatgaaatgattagtcttcaaatgcttaatttatgcacgctagccccattcttcctttatatattattatataattactatttgctattttataatttaaatgcatttgggacttctaatatccagatattttgggggtttccttacaacacgtgctacttttgatatatgttatctaacctggtacagcactatgaaaacacttaatgttatagcataaacctatttccatgttctgaaaattcaaatgcagtgaatgctcatatgcaaacccaatacaatgtcctcgttagtttttattttaatatggtgggttgatttaatcctactcagttggtcactgccccaaataaacaatgcctaccaagtgggtagcattaaaagcagctgggagcattagccatcaacattctaggactctgggaaaggtggtgctattgaaaatgcagatagatttttaagcagaattattttcctcatggctagtgatgtttcaagtaaaacaaaatgggggcactcaccctgaggtagggtggctattttcccatctgccttggtaattgcttgtcaaaagtacgcttgctttggaggtctgagatccccaaagtaatgggaaaaagatcaagtgttttgaagcaataagaaaactgacgacacagtcacattttcaggactgcgtaagtgccagtttgcttcatttagacacatgattattttcgtccagaatttgaatcctgaaatatttgtcctgtaagcccttgcaactcttgaatagtctgaagttagtttttcccttaaaatttttggtttgttttttgcttgttctacacatgactcaaatgttttctctttgcaatcagccttatagggttttgttaacctcattaacctctcttgtcacttctctgaatctgcctttcgactaatggatagtcattaaatataggacagatccttcttgttggccatctcctgggcatatattactcttccctccacagacgaagaagtgtgtctttgctctagccacagctgtgttctagctctggcttgctagtaaccaccattgttgacttttcctaagaaacagaattaactcttagctctgtttgctctttatgtagggtgggaatgttctttcttccctgacctctccccggttacctcacaaagatgtcatcatagtaaaattacccagtaaaatgatcacttttgaactaggcctttcaaattctattgctatgtaccctgataattattagatatatatgttgtataaataaaatatttattatactatgaatcaggtactatgccagatactttccttaccttatttcatttaatgtccacataaccctgagtaggtaaagctattaggcccatttaaaaaatgaagaaacagactcagagaagttaaaagttttgcacttaacacagctcataagtggtggaggggtggagatctcttgacctggcccccaaagagcctgagctgtattgcagatctttctgagtcaagatataaacaatatggctacaaatgaaaagaaagtgatcgcctacaaagatggtgctatctacagaattatggctacctggagaaatttaccaactgctgagcacttcctatgtggagtgtgtgtagtggagatgagctatagcatgtcatttgttctttcttcccaaacttgcattcactttgtcctctccagggacaaaatgagatgacagaaccagctagagagtcattacaagcaaatagtatgactgagtagtaggtaataaggatttgagccttttaactttacatcctaatggagcagcaagtaggatagataaaatattagaaaatacctattcatgctgagataagttgtaggtagctactggtatcattaattataactgttaagcatctcagaacaactgagtttcaaagtatcataaatcatcagttgaaacagccttttgaagatctgtgttctgatttttcattcttctttgcccaagagcatttgcaaagaagtgaaagtctcacattgtttctttttggtacctttaggtgttgactgctgatttcaggagacagtcagcactataaatctgggaaccttctgcactttgtaattttttaaatgtgttttgaacatgtgttttctgaattttagcattagacagtatagtctgaaaatcaagagatcccatcttcagtaacacctttcacatgaagatcaaagtgctttattaggaagcagcaacaaccgtacttcccaattaggacaacaacttcagaggtgataagcaagggagattgctcaggaaaagcaacggggacagacaaacagaataacaagtaaccacggccaatccaaaacacactggaattctttttccaaacgtgagcaggtcatctgcagtgccttcctttagaaaggaaggtgaacagaaggtatatttgaggatgttgatgctctataaagagcttacccgattcttagtctattcaatttattcagcaattgtcgcactgtgtatttatcaacccctagttgtgtacttggtgtaatgtttttcatgttcctagattaaaaatacccaaaaatctgccattagcaagtagacttagaggtctttaacaaatagattcatgaaaaagctaaacgcaaggcatatggattcaaatttgtacctcagtgaaattacaaatgtttatgttgtcgaccttctggggttactcgtagatagacaaaactgcaacatgttaattctgtgaatgcttgaatactgtaatagcactatatttccttttaaatattttaaaatataggcttatcttttaaaaataattccaaatcagtaagtggtttctcaatatttgatttattctaggattaacactaattgatgaagatctgctatttttttctgtcatgcatgagttaagtggtctaaggctgttactgatttctctttccaggtcctagtcagttggtctgaggtattcaaattttctcaatgtcctcctggagggcaggcacctcatccatttatcggtaaaacccagtaaccaatatgcagtaattccttgacaaaggtttgttttacttttccattgcacattatgtcacagaattttgattcaacaggcccctaaaagtcaacagcaggctccagtttctgttaaaatctattgcataggggtccaggtggcaagaaacatttataccaagatcatctaatatacagatgaatgctattcagggttctgctctagtgtcacctcctcagagaggtgtccctgggccactctgtgtaaaatggtccttctctgtccctaacttttatctcaccttacagtatttataccttcctgacatttacttttttcattgtttgcctccctcactagactgtatggggaagagattttgtccactataacccagagcttagaagagtacctatcactaaatgaagaaatgaaccaagtaaacattataatgttcatacatttaaagagtgaaatgattaatcttcccccaatagggattgtcttgaaagaaactgtaggatctattgttttaaatgactccaaagtgtggttaatggggatttttttttcattgtgctaaatgggatttcttttggatgattgttttttttttcctggaatttatgtttggtacacacatttcaaattgtagagaaaattatttatagccccaaatgtcaaaggatgatgaaactgtttgcatatagttaagctgttcactgtccaaataagctttgtatttttcttgcaagtcatcaatagtctccagtgtgtgtcaattttagcagctcttcatgctcacccgagccaattagtcccatctctggattattgctgaaaacttccaggtcagtttcacttctatagttgtttaatgactttgtctaatttgccagaatacttcttgtcttacagggctacctgtcttccccatcaaaacagttgaatttggactcctgagctgatgaactccaagctcccttagaaatctgatgttccatgatccatagacttactgcaattcataattattttaattatttatgtatttacttgatgttttgactgcttctgccactacaatgtaaactctgaataaggggactgtgtttcttttgtgtatctccatctgcacagttcctggcataaagtgagtactcaataaatgttgttgtatgaatgagtgaatgcatatccttcatcactcttgaaaaatgaattgatattagggtattatattacattaagaatggcagaagaatctggtatctcttctatctctttctgaggtagtaaagtcctcagtttctctggaaataccaatattgtaataaaatatatacttaaaacagtaattagtatctgtcaattatggttattcttaagtctcagtctttattcaagatcagcagcttctgcagcgatgaccatcttcctgcaaccttccctcgatctcagtcttgggtcaataatttgttttgccattcacagaatctcaaatggtatacattcccagctcaactgagggcagaacgcatgttacattaaacaagttatgatgagtaattatggctgtcaccaggtatcatgactaatcgggaacaagaatcaagaatgtattattgagtagggtatagtaaaggaggatgaaggcttaggtaaataaaaagtttgccaaaattccatgttcaaggcatttgaagtacttcagtttgttttagggcacttctctttggttttcttgcgagacagaataatgatgcacaccaaagtgagccagttagcagcagtcttcctgctgacctcctgatattgctccttatattccacttttctcttagcactaaattttgattatctaacccattgaaaacagaattattgatgcatacacaaaatcataaatgatgtcaattattggcaggttgtgacagtgatggaatatatcacaagttttaaaaaagaataattattttgctattgttatattatcactatatctttcatgaattttgtttctctgctatttggagaactgtaatcttacctttaggctggttctacatttgagaattggattatttaaggtcctaatatcatttgtgtgttctaggcaaccaaaatgagtttttcattagcaaatatgagaagagcatgatatagtttgtatgtttgtccccgtccaaatttcatgttgaattataatccccagtattggagatggggcctggttagaggtgactggatcatggggatggatttctcgtgaatggtttagcaccacctcttggtgctgtcatcacaagagtgagtgagttctcatgaggtctggctgtttaaaagtgtttgtcacctccttctctctttctcgctcttgctttcaccatgtgacatgcctattgccctatcaccttcaaccatgattgaaagcttcccgaggcatcaccagaagctgagcagatgccagcatcatgcttcctgtaaagcctgcaggactgtgagccaattaaacctcttttctttataaattacccagtctccagtatttctttatagcaatgtgagaatgacctaatacagagcactcacacttcaaaatcataactaagctactcactcacttgtttttcacctacttcatgccaaatactgtgttaggatctggggatacagtggtatcatagattaaaggtggccaaaaattatttgatactgctctcatcaagaggtgggatctatgtccttccccttgaatctaggcaagctctgtgactgctttgaccaactgtgtatgacacaagtgacactgtgacaatttctggacccaggtcttaagagactggcattttccatttcctgtctcttggaacactcactcttggagccctaggctaccatataagagctctgacaaacctaaggctagctaccatgccagtaggaggcccaagtagtcaaatagagaggctacctgtagagagaaggatttccatctgctgtccagctgttccagcccccagttatttgagtcatcccagctgaggcttccaacatcatggagcagagataagccatgctagccatgccttatctgaatgtctgacccatggacacatgaaataggatgatactgaattgttttaatccattacttggaacaatttgctacatagcagtagatattcaaaacaagaagagaacaaatcggacttggtctttgtccttacagaacttaagatttagaaatgatgacaattcagagctaacattgtacatcctagggtgaaccaagaaactgaaatgcagcaattccaaagaaagctagaagaaacccatcatcttgtttcatttttttttttttttgcttgttaatattgctattatgtgcctagtgctgtactaaatttggtcctaattctagaaattttcaattaagggtaggcattccaccagagtgggcagaagaggtcaacacaattgattcagcaggactgttgcaagattttagatctttaagctgttcttaaaatttactctaagttatagacataataatcaaattcctgcgaacatacacattcttctcataaaatgtggacttttttcctactttggtgggaccgggattatctgatataatgggtgggatgttaagacatcataggttaagatccactggcctagaggagtttattagcctaaggtgtgaggcagagtgtataccaacttattcatgagatatgcaaaggtactccagcgaactaaggggagaaatattgttccattaatgtgatttctagatcatgttcagtcatctttttcctctttttaaaccactataataaaagttcaaaaattaagtgaaatgataatgttgggtatttaaaggctctcagggaaaaagatcagaaagaaaaacaaacacttaagatctttccttggaaagctgcagaaactgtatagaccagaaatcacaaactcaaatgccagcaaggccaggcatgacattgaaagtgaaggacgtgagtcaagtgagtggtgagctagaaaggcatgccatgtcccatccagaggggcagctggcccttaagcgtcagaccacctatgccgtgcccatgcatcctaggttgcccatgcatcccaagctgtgtaaattttctggagaaggaagatattctgatttttatgttggatctcctaatttctaaatgtcaggacaaacaaaatacatctgtgggctgattttaagcaacctctgatatggacatctgacacggattgacgtgaggatcagcctctcatggttacaaaacagacagatgagtttggttagaccttgctgtcagccgctgcactaaccctggtaagattttgtttttttaaatgcacttctccactagtgatggcgagtgaaatgtctggctttgcaaattactgctgtcatttagtttaatgtactcctgcttttacatatttataaaaaccttttacattattaatagtgattaaatgcttagacactaaagatcaataatgcttctgttcacctatttacatttttaaaaagtaataagtcgtacagggctcgtagaatatgtggtttactttgcagtcatgtttggagtagttgaagaaaacaaactcgagctacaggatataaattgcatttaggaaaaaaatggcaactcagttgagtttgcccaagatcttcaccatgggcagggtgcacgttcacattgttgttacaccatcacacggcacagaacatacatattccatgggctttcacatgtgggtgcagctaactcaaaacaagaaggtctggtctctcttggttgcacaaggataaacaattttttagcttttgtgtgtccttgcaacacttagtcacctgtgtgccaccatctttagctccaaaggtttctgatggtggcaacattcagcagcaaatcagctgtgtgggtcgcattttgccggtaggcaaacaagccccttcaaaatgctttcttcacccgcctacccagctctctctctcaattatgcagcaaaaactaaaaagcaaagtggtttgttcacctgattatggcacataagtgtcctagatctgcctgaggagagcaatcctacagtccgagatgtataagagccataagtatttcacattcagctagcccagctttctaagtagccaaaatggcccagcatagtggtttagagactaggctgtcagcaccagttcaaattctgggttcgaaatctgactgacactcattaattgtgaccctgaacaagtcatttactgggcatctctgttcttatttcctcactgacaaatggagatagtaatagtacctaccatatagagtttttgtgaggattaaataacacatgtaaaagtttagcatgagatctttgacataacaaatgcccaaggacaatttacatgtatcaaaaggtccatttcatgagtcactcaattgtgatctacaaagaaaaaattcattagcactgatttgaagtttgtaaatgatgtcactgaaatgtattaaattgaactggatttttaaaatgtcatttggtttctaagtttcttgtgttgacccaaataccatttacctagtataaatttggttcacgtcaccaggcttatttaaggacccattgaaatggggcagctgtggcgtaatggaaaggttacaagagttgctacaatgcaagctttctgcatgtgtgatttggggcaagttatttaatctctctgaacctcagtttccttatatataaaatgcacctaatacaagtatctactttacagggataatgtgaggataaaaggacataatgtatgtttgtttgctttgtaaactaaaaagtactatatagatgtaagagactgtagctattatgatttatatatatgatcagagttggacttattttgcccaaagatatcccaaataaaaatgcatgtgttgattttttagaggaaatagaattagattgtttgtcctcagctactttcctcacgaaaagcctttgccttttctgatagaatggatatatttgtaagagctgagacccctggatgaaggagacccatcgttctgaatttaaatgtgacttgcagagccaaatgataacttggagcattttacaaaagaatgagggaaactcaatcaaaccaggaggaggagaagggcattaaccaccacaagaaataggtttattcactctgagcggctggcaagtgctgctgatgcatgaagctaaaccgcagggatttaagtttgtcctcacttttctaagtttattgctcacatgctctgctctgggtcacaatgacttgtctcttgtctctcttaggtcttgactttctccccttacttgagtttagtgagtcatttaacacttctccatgtcatggaggttgttatttctttcacttcatttcttttttttggatcaacttttctctatgagtgaagaaagctacagagttgatgtcttacctctaccttaaataggaaaacagggataatggttgctttttgttctttttgttcctctggtgtataataaataagtctcgactatctaaataatcactttgactataccacatctgaaagtcactgcagagttgttattgaagctggaagaaatacttcaaaatggagatgactgaatctcttggaagaaggaaaactttgactagatcccctggcagaaaagccctttcttgtgattcactggcagttggattttgggttctgccagagacctagagagtcagaactacacaataaaaaaaaaattttaaacttttaagtttcaataacagttctagtatacaactgaagggaagggagttgagagtttgaaatttccatgcacatcttatttttccccttttctactatgtataggtcaagatggagttgtaattttcttagattgtcactgatatcaatataaactcttgaccaagttattcttggggaatgataactcccaccaggctgcaactgagggagtgggatgtagacaggagttcctggacaaatactttccatgtttcttaaaaattcctgtttgcaacagtctacaaagccagtgaaatattgacttgtggaatgcatacaggagaacatttttgtgtctggaaatgttgactttagtgacttacctctaatgctaattagtaaaatatatcatcgctgaagatgaattaaagaataacagtgagcaaattcatgttattacacttcatataagtaagcttattttaaaaaaattatttgccttatgggttgggctttggtctgaggtcttaagtgacaattcatgcatttgagctttcccggaagacagatttttcacgagtcttgcatttcacactaggatgtcaaacttattcaaccctttcctatggaaacatttttcatcatgaaataaaacttaaaatttagtttttgaaattcaagattttttcaatgaatcaatccagaagctaaacaataaatttgcaaattatatttccctcctgtttttgttattaaaagccatattatatatatacatacacaaacatacacacataattttatgatacagaatctctagaaatgagttttttccttaatcagtaagggttttggctttccagagaagtcctaaaaagaaatgaacgtggattatgtggaatgggaagtaacctgatccttagaagatatcttcctttcgtagttcaggaaaaacatgaccattgttcactaaggaataaaataaatacatatgtacctgctgtcaaatgacacctcaggaggaatgacatgagtactgtccttgccaatgaggaatttgattcgatcataaaaaagtcttgaagtgtgctgagagaagagagtttggctttgctgaatgaggtcaagaggatctggtgagccctggcagagaggacttatataacagttgctttgttgacaacagtcaggatccacacagtcggttaaaccatctggaaataaaacccaaaaccaatattgattatttagcttcaagagaaaaatatagtttaaaatatacataaatggagaaaattctaaaatatagccaaagataatcaaccttgttttgagttcagaatttgttaaattcacatttttcatgaattatcactcactctgagttcacatggcacctcagagaaattcaaagtattttgttcataaatttttctttcctgaattatccagcatttatcagctggagaatatagtttatatagttattgtttagagtttgggtaaacaattctattacatatcactgtttagaaatttcttcttcctcagtgagaccattctttccgaatgcgatgatttcttgtaagtacacctagtacatctatgagcacacaattaacaagtacttgctacctgaatttgtatttttttaaaaaatcctcccaatattgttgtctactggtaatgctcaaaatagaggttgggattctcatggtgaaaaaagatatttcgagcaatgattttcaaatctgttgtcaattacctagggagcttataaaatatgcatattcttgagctccacctactgactcagaatttttacagagcccaggattatgcatacttaatctgggtgattctgaagcatactaaagttgcagaaccagttttttaaggaatttatagaaggaactagagttaacatgcctaacagcagttttttgatgcaattactattctattttatttattttttgagacggagtctctctctgtcgcccaggctggagtgcagtggcacaatctcggctcactgcaagttctgcctcccgggttcacgccattctcctgcctcagcctcccaagtagctgggaccacaggcgcccgccaacacacccggctaattttttgtatttttagtagagacggggtttcaccgtgttagccaggatggtgtccatctcctgacctcttgatccgcccacctcggcctcccaaagtgctgggattacaggcgtgagcaaccgcacccagccgatgcaattactaccaaatctgacatacatgaatgcgatgactttctctgtttcattttctggcccttcaccatttgctgtagactgctgaatccactgttgtaccacaaataaaactcatacaaaggctttgttctttggtagagaaatgatatagggaacagggattgtgaggcagggagaccactgagaatctaacaggtgcaaaatactgttaggtgcttgcagaggtgaagagataaaaatacccttttcctgttttcaagagctctgggcttagtaggagaaagagatatgtaaacagctaactcttatactagcaaaaatgtaagaagtgctttaagagagttacatgcaaagagaaggggttggagtgattaactgagcatatggacacttcattccatgccccataagcaaaaaaattaaagttcttcccaggtccttaaagaaggcaagtggctctaattcagttgtttaacaagggtaaatataaagacactaatcttcttggcttgccttggaataggaaggttcggatggatcaccgtctccttaaggctgctgctgcagcaagttactagcactgatttcctgcagctcttttgcttgctctctctcccccacttgtctgctcccgtggagttagaggcgggtgtaccacagctgggggcaatgaaagcgaggaacaccaagagagtagacgtttggaacagcagccctagggcacccaggaaatatttttccccacatgtggtcctttcaaattccctgtactatagacactactttgatttaaaatgcagtttgctttttttcttgccttccctgtttgttcaatgtgtttttgcccctgatttctatttctctgtatacatatttttttcattgatgactttttagtgtgaatttgtttcaataagaagtttctttctgcttccccttttcccatcattcagcaaattatattaacagattttttagggattttagataccactaccacctctccctccaatacgctgttctcagcctcttattagcacattatctctttactctgctaattaaacatctggatgcgctgaaaagctggcaaaaatatcaggctgattaagagagttctctgatgtctggaattggtgcataatgcactaaacaatgaaaaactgcttttcaaatgggcagtcacttttacatttttattgaatactgaatttgttattgagctaatatatgtggaagtatccagtgtcatgcctggcaaatattaacaaatacactagtaataatcacattgggcagtcacaggtttcaacctgtcaaccacaaaattccgacttatttttgaaaataaatagattttaaataaatattaatgccaaaaacgatcttaaaaaaaaactaaaaaaatctaaacatagaaccaattcataattgggactcacattctcatctagtaatgttctatacattccaagctaatgtttcatatttaatcattgcctattatgtagggctgaccctttaagacctctgttttctgagacatcagcaaggctcctgttgagtctagaaagacctcaggcaagccgatcaataatggcatgcaaaccccgtattataatttgtaggtaagtccagcacacgggcaaagatgaacttaccaattatcacattgactaacaccccatatagtacgtctagactgttgcaaagaagtgcaaatgacaatcacactgaatatgtgccttgttttttggctattaacagtttttttttttttttctaattgttcagaattggaagctgtggcaccctactgacagccaagctcagcgtcgtcagatatgggcatgtcaaatattaactgatttttacttttagggcctgttctcttcaaaggaataaaaatactaggtagctaaaaaagagggaggttacactgacttgaaggactatctatggcattcattgatcctagctttgccaaccagtttgggactttgccagttggctcaattggtgttgatgaagcactggtttctttgctgcgtgatcaagtcatcactagtaaacttatgcctactaattgtatgcccttggctgaaaggggaaatggatgaaggaatatgagtgatacagaggaaacccatactttctaatcctgaaaatgaatttacaaatatatatcctttagagacagcacttgtattatcaccttgataataatgggtggttaattcatggtaggttatacaaaaggatttgaaaacacgtacagattagttaatatttgccaggcactaggtacatccacgtatattatctcaacaaatcccttcaacaagcctgttaggttgatattctcatccctatattacaaacaaagaaggggaggctaaatgtagttgcagtgggaagtaacctgggagtcatatgaacacctagtgttatgcatgcaaatcacacattcacatcatcatctaaacagtgtgtattactagtactgatctaggctgtaggacttccaagtgcatgactatacataggtatttagagcacatgaagtggttaaggtaaaaaacaaaacaaaagaaaacaaaaacagactactttggctctatttttttttttttttgagacggacttttgctctgtcgcccaggctggagtgcagtggcgtgatctctgctcactgcaacctctgtgtcctgggttcaagtgattctcctgcctcagcctcccgagtacctgggattacaggcacctgccaccatgcccagctaactttttgtatttttagtagagatggggcttcaccatgttggccaggctggtctcaaactcctggcctcaggtgatcaaactgccttggcctcccaaactgttgggattacaggcgtaagccaccgggccagccctgctttggctctaagcttaacgttgccacttacaatctgtagaatcctagacaagtcagttcctcatttgtaagatgtaaataacaataatactcactctataagttgttgtaagtatcacatgctataataaagatgagattgggtgcactcagggtggtatagccatagactggagaacattaggctaagtgaaataagtcagtcatagaagggaaaatactccatgattgctcttatatgaggcatctaagatagtcaaacatatagaagtagacaaccgcatggtggttacttggggattggttatggggatatgaggagttgtttaatgggtataaagtcacagttataagatgagcaagttctcgtacaacatagtacttatagttaataatgaggtattgtgcagttaacaattttttaagagggtagacctcatgttaagtgttcttaacacacacacacccacacacacacacacacacacacacatacacacacactccaccccagaacaaagggacaagaagaaaaccgttggatgtaatggatatgtttattaccttgtttgtggtgatggtaacatgagtttatacatatgtgtaaactgaccaaattatttacatttattatgttcaggttttgtacaccatttatacctcaataaagctggaaaggtaatcataataagcttactatctagtacataaccagcacttgataaatgttagctgttgttattatatcaaattctaaaacatacagactgcaaagaatctaaggatagagtcttaggggtagatgtcaatggtttgcaatggcagcttaaagcattcaaccccttttattgaagttgccttatcactggccagagggtaattgatttctgtgtagcacgttccagttgttggaatgtgttcattttatgaactatgcttggttaggttgtcaggtaggtaggatcttatgtgactctgagtagacaaacactaatactacagaaacttttcattcattggatttgattgattcagaatttgtcaccatttggacaggggttggatttaagcttaagcttttcagcatctgtagaacagtgggtctgctgagcaaattaatagtgaaaataaaatggaagggctgatcattccaatgactcagtaaagcaaagtcttcttaggcattttagaaagccataagcaatgaactaactataaatcattcataactctttactaaagcaggcctcctactaggcactcctgttagcttagttgttgcccttacatgtattgaaggtaataggactgtatttcctctggaaatagtctataattcatattcttcatttcttcaggctgattttcacccctggatttactgtattagaaaaaagaaagtgagagagactcaagtgcactcaggattggcctgcccaaatcattattgttgctataaccacataccattaaacttttctgggttgggaaaatacgttgtttgtatgccactaatgttcatgtcctcctggtgcctacctgccattgatggcttttcatatcacttagaataaaagcctaagtctgaacaatgacttattacctcacagtctgattctttgccatctccctcttacctctcagatcttacctcttctgatccacccaatctccttcccactcctctggctgttccttaatttcccaggcaatgttatcaggacgtttgcacacactattcctatgcctggaatgttcttctccctggtatcaacatggcttaaccttcacctcctttgggtctttattcaaatgtcatcttcttagtgagattttctctggctaccttatttaaaatttccccgtcctacactccctgtccttccttttcctgccttattttaatcttaatttttttaattttaaatttttgtgggtacatagtaggtgtatatatttatggggtacttgagatattttgatacaggcatgcaatgtataataatctcatcatgaaagatggggtatctatcccctcaagcatttatcctttgtgttacaaacaatccaattatactattttaggtattttaaaatgcacaattaaattattgactgtagtcaccctgttgtgctatcaaatagtatgtcttggccaggtgtggtggctcacgcctgtaatctcagcactttgggagactgagggggggggtggatcacctgaggtcaggagttcgagaccagcctggcctatatgatgaaaccctgtctctactaaaaatacaataattagccgggcgtggtggtgggcatctgtaatcccagctactcgggagactgaggcaggagaatcacttgaacccaggaggcagaggttgcagtgagctgagatagcaccattgcactccagcctgggcaacaagagtgaaactccatctcaaaaaaaaaaaaaaagtaggtcttattcattctttctaactatctttttgcaccattaaccatctccaattcccctttaaatccccattacccttgccagcctttggtaaccatcttgcctttaaaaaaaaaaaaaaaaaaaaacaaattttcttcatcacatttaccaccttctatcataatatgtatttttaaaatttggtttaatttctgcctcttgtaactagaatataagctttatggaagcatgaattttatcttttttatgcattgctatttcctcaatgactagaacagtacctggcttaaagtaagcattcaaggcccagcacggtggcttacgcctgtaatcccagcactttgggaggccgaggcaggcagatcacttgatgtcaggagtttgagacaagcctggccaacatggtgaaaacccatttctactaaaaatacaaaaattagctggggggtgagggtggcatgcacctatagttacagctacttgggaggctcaggcaggagaatagcttgaaaccaggaggtggaggttgcagtgagccgagattgcaccactgcactcaagtctgggtgacagagcgagactccatcctcccccccaaaaaatgaacattcattatatatttgaataatgaataaatggatgccataaaagtcctatttctatgacatttgtaaatgtgcccagagattaacaaatgtccaactaatatatcaaattgttattaacagattcttcattgataacacacttttattgcccactttaaatgactgtatttcaactcttttctcattcattttcatcactgcaaagtagacagatatcaagtatcagtagccttagttggtagataatgtgatgggcccagtcatacagtggtgaacagttacagagttgagattttctactttgcagttgcatctggaggcacttgggcagtttaggctcttataactaagtgatgatccattaataaatgggttgcttcaaaattaaaggggtatggtgagaaaagaataattagaaatatgctttctgatgccaagtcttttgtctccaaccaaatctcaaaagtaaatgtgaagatgtctgcctcttaaatagagtaaatgttataaattcattgttccttctctttcattttcctatttattaaacactgaagcatgctggtgccattctaaacatgaggctcattgatccatgagcttgtatgtgttcataactcacccatggtgctgttttctggatctagaaacactacatcataaaagaggcttgcaaatagctattgctcttaatgaatggtgacttgttatgaagaatgattcctggaagatcattctcttttaggcaattaacttattgattttaccaatgaatatgaatatagaccactggaagagtttataccagagaagcttggacaaacgtgataaatacttaaaagatcagagaaaaaaaggctgtttggattaaacactcttactctacattttttgagcctccttgaaaatatttccacaatatcagagaccactttccttcctccataagtcgagtgaatgaaatggaatctttgtatggtaactgaagatcttgtaaaactcacaatgttctgtatgatctggcccctgactacttttctatactaatctcttcctgactcatgttccagccacaaagacatgccttttactttagagcctagtacatttccacctcagggcatatatacatgctgtttcctctgtctggaacgtttttcccctgactcatgtgaggcctctctcaccacccagactaggtcaggtccccatgcacatttatagaattacacaattttaaaattataaaatttttctagcactcttcacagttgtaaatatatagctatgagggatcttcaaaaagttcttggaaaatgtgtatcatgagaaaactatgcaaggagttcaaattttttttccactaaaataaagtcatactaacttgttgtaacacatctgaacaggatctagtttgaggcactaagaaggataaggcatcattttgaaaagagtccctgtcagagcaacatgaattttgctgaaattgaagcaagaacaaacatcaaatttacgatgaaacttgggtggaagaatgatgacatcactgatactttatgaaaagttaatggggacaatgccccaaagaaatcagcagttcacaaatagataactcattataagaagagacaagatgatgctgaagatgaagcctgcagcagcaggtcatccacatcaatttgtgaggaaaaattaatcttgtttgtgctctaattgaagaggatcgatgatgaacagcagtagcagttccgacaccacagacatctcaattggttcagcttacacaattctgactgaaaaattaaagtcaagcaaattttccacttgatgagtacaaaactgttactcccagatcagcagcagacaaaagcagagctttcaatggaaattttaaataaatgggatgaagatcccgaagcattttgttgaagaattgtaataggagatgaaatgtggctttaccagtatgactccgaagacaaaatacaatcaaaacaatggctacaaagaggtggacgaggtccagtcaaagcaagaatggactggtcaacagcagtggttatcccagcactttgggaggctgaggcaggcagatcacttgatgtcaggagttcgagatcagcctgtccaacatggtgaaaacccatctctactaaaaatacaaaaattagtcggaggggcgggggtggcatgcacctatagttccagctacttgggaggctcaggcaggagaatagcttgaacccaggaggcaacagttgtttggggtcctcaaggcattttgtttgttgtctttttggagggccaaagaacgataatatctgcttattacgagagtgttttgagaaagttagccaagggtttagcagaaaaacacccaggaaagcttcaccagagagtcctaatccaccatgacaatgctcctgctcattcctctcattaaacaagggcaatttgcaagagtttcaatgggaaatcattacgcatttaccttacttacagttctgatttgcctctttctaatttttttttgtttcctaatcttaaaaaatctttaaagggtacccatttttcttcagttaacaatgtaaagaagactggttaagttcccaggaccctcagttatatcaggatggactcatcccttacaaaattgtcttgaacttgatgtagaagtaaagtttatatttttgttgagaaataaagtttatattttaaaatatttatatttcaagtctccctttccatgagctttttgaagtccctcatatttgtgtggattatttaatatctacctgccttgctagaccataagctccatgaaggcagaaacttgtattgtttatcattttctctccagtgtcaagcacaatagttagcaagaagtagtaatgaattaatggaaaaccaggtacttaatgtgaaatgtttggcctaaaggtaacatttgagtgaaacatttggatcatcactatccaatataacttctcctaaagctaggaatgttctagtactgtgctgtctagtacagtagctactagtctcatgtggctactgagcacttgagatgtgactagtgcagttgagatcctgaatttttttatgttatttaagttaaatttaaatactcacatgtggccagtggctaccatactagacagtgtagattttgatgtctgcaaatatttagatattggatggtctacacatttagctaaacattataaaaaagttttacatttttactaagtcaaatttattgtttttttttcctattatggtttctttttatgtttacaaagtgctttctcattgtaagatctatcaccacttttttttttgaattgtttgttttcttttacttttaactcattaatccagttgaagtgtttttatttatcttattctttaggtatatggtatgaattaaaaaatctaaggcatttttcttaagagttgtcacagttccgtttatttaataatgcttattttaccccattgatttttgatgccagttttataatatactaaattttgtacttgggtgtgttctagagcttttattcagttgcattaatctgtctattctcacatcagtgccactttgctttaattatcatagctttcaaatatgccttaatgtctgatagttctatctttcactattgtttgttttagctattctgactcagttaatataatgtccaaactttttttctgatgttaattcatatgtgcatgtaatgtatggtgatcatatgtaaccaactccaaattaggacacatgattaacaaatgaaaatgtggtcaccatagtaagttttttcctccaagtatagggttgtgcatgtggtaggtgcttcttgattaaagagatgaatgaggtcaagacatttcataggtttgtgacttctatagtaattagttcttgtatatacaatacataagatagctttccttttttgcacttaagaaaaaacatccaaaggttattttttctctgttctgtttttactgttcaaggagcttttaggtagtttctggaccagcggtgtcacccacatattcaatgcagcccaattagttactgagaatcacaatgcattgaatcagagggtaactaaagtcaaagcttcaggaagtagcagcaatactaatgagtattcaaagctgattagaatgcaaaaaaattccaccattctttaagtatcagttataatatggagtaatcaggtagcagctacttgaagcaaatgcttgaaagtgattttttttgattgggaagatttcttaagaattacatttttaaaattagaactactttttcccaaaacggttcaattggtgctttctaatgtaattaaaacacacacatatacacacatgcacaaacaagtagactaatattaatattaagcaaatattaataattagtcatatttaactaaatgaaaccagccattatggatagctggaaagctgagactaccaaatgaagggcatttaatatattctcaggggtaatatttgaacagtataaaaatgaaattattggtttaaaatcttagtcatggggctttcagagtttattcaatctatctttccatctcaaagtagaactgaatctatatttatcatcaatatcatcttaatcctactatagggaaaaatggtaatcggaaatctcaaggagctttccccccgttccctaaagagacgatcataaaaatatactgagctcatattaaggtctttgatttttaatttgcatatagatacatagttttaaggaatgttcacaggtcaatacacgttcagtgaaatcttctatgtcttctgaatctacatagaccacaggcattgagaattgataattcattaattcattaatatttaattgatccattctttaaacattttggctgccttgagatgaccttgaggccataaaaaatggtgataattaaatattcaattatttttattactttactaaggcaggaaacattggctcaaccttaactgagccagaaattataattgcataggttgttaatgtgttttctgagcataacattttaatcaatacataactgagaaattcctattattataccaaatcctttttagaatgaagcagactacctaggtttatatccaggacctatcatttgcttactatgtgatttttaacaacttacttgacttctctgtgtctcagtttcctaatttgtaaagtagtgttaatggtagttcctggccaggtgcagtggctcacacctgaaatcccagcactttcagaggctgaggcagacagattgcttgagcccaggagtttgagacgggcctgggcaacatggtgaaatcctgtttctattaaaattatagaaattagccaggagtggtggtgtgtgcctgtagtcccagctactcaggaggctaaggcagaaggattacctgagctccagaggcagaggttgcagtgagctgagattgtgccactacactccagaatgggagacagaacaagaccctgtctcaaaaagaaaaaaaaatgttcctacataatggggattaaatgaaataattcacataaggggctcagcacagtgcctggcacatagtaaatcctgaatacaagtgagatactattattttcaacatattgggaatataactatgggcaatgggtcatgcttaacatgcaacaagaaaaccatatacagaatataattaggtgtttgattgtatagtgcatattatcaacaccatgggtaattgaggaggtggatgtcagaagtttcatgggagatatggtttaagttgagacttaaattatggacagagaacaatgggtggagaagacatgaagatgtgccaggtaaaaggtatataatgaaaaagacaagaaggaaagtgaagatgagtcttagagggccataaaaataaactaaatagtttatcagtggatcattagattgaaaacttcactccggtttccaaaacaaggttttcaagttatatgggtagtaaacagtctcttcagaaaatagtctcttctatttgtgtgtgtgtgtgtgtgtgtgtgtgtgtgtgtgtgtgtgtgtatgtgtggtgtagtttactatctttcaagtggctcacttgaactatctcatttaatacttattacaaccctattagacagtgtgtgtctaattattcaacctatccttctgtctcaaagtagaactgaatctatatttatcatcaatatcatcttaattctactatagggaaaaatggtaatatcatttaatatcatcaaccccattttagaaataaggaaatggaagcacagagatatcataaaacttgtcccaaatcatgcagctagtataagagccagagctagtatctgaatccagacagtttaacttcaaatctctgtgttcttaatcacaaagttgcctccacttaattttgataaggtcttaaaacttttaaaggttaactgttagccagaacaagtaaaggaagaaactcttataatgcagtttggtgcttaagccatgactgctaccttattaatataatcctgcctcatgtctgaattcaaatgacaaggaatgcaattgtctaagcagatatagaaatgtgaagtgtcaaatttaataatatacttcattttaagctaatatacagaaattcaaacaaaattttttgttaattttatgtttcctcgagtagaaggtatgtggaaagtgaggatttgttgttttaggctcactcagaggtggtttgggcagttttgatgtctgatcatacagtgtgttagatgttttgttggctttcctaagagaagtggtaactctgaggtcttggagccacagtggttttaaaaaatatcatgcgcagctccttgattaaatatttaaaattctaccataaattgtctcgatgctatgtcctctgaaaggtataaagtgctactaaaaggtagacacacaagagggagttccaaataactaacaacaaagaaaaatattttagcatgtctagtgcaaactatgctaacatcaaacaacttgaatagtggtatgttaatttaatttgatatgataaatgccatgggtatgggaggtagcatggtgtagtagttgagaaaatatgctctgaagtcacatagccctaaattggagacttggctctgctactctctagctatgtgattctggataagtcacttactatccccacccagagcattaattttcccatctacaagtggggaaaatagtaatacctatacctcatagggttattgtgagaattaaatgatacataacacatgcaaaaaaaattggagtactgcctggtcatagtaatattcaataagtaatgtcttcttaatgtgattgagactaaaaggtagcattaccctatataactcagtatcatttatactagagattcctaattttcacccttggccaggttgattaccactgtgctagaggctgggctattcctttcttacgtgaacattttataaatgactcacctccatcattgtccaagttatctccacaaagcatttccatgacaacattgcagcctgtcccactccaacccacctgacacacacagtgccaaccattttgatccagggtacatcgtccatttccaaagcagagccctgggcagccatctgaaaagacatcagagagtaaccatcacagagacatcagaatgggattggccaacaatgatgtatttgcctatagggaagcatctaaccatctgggccccattcagatgaggtgttgaataaatggaagaggagcttgcttgcctgcaaaaccttcccagggaacttgttatcccttactctgcagtggttttccttagagagccaattaagctttattaatgctaaccccaattcccaacccctggttcatataggaagaaaactatggcaggggcaagaattctttttttcttttcactaaacatatctcctcatctcaatcaaaactatacggatgacactgtatctagttatggccaatatgttgggaaaagatagcagtccctatgaagagaaactttccctactacttctagtctgtgctgattttcccttatgatgtattgcttcaggacttaagtatgttggtatacagttcagaccacaccattaagtatttgttcatatggtgccttagaaatgtgctgtagttgctttatatttattcagcttttctcttcaagattattattcatctgcgggctaacgattgaaatctttacttccatggtatctctctcaaaagcttgcatgatattatgcttataacaataatattaaatgttaaataagtgtttatggaattaatacatgccagatctagactttctgaattatagagaactggaaaatatcaagtcaagaggaaagtgtagcatttaaataacttttatccattgataaagcattaacactgacaatggttcctctttagactttaaatttctcagggatgccctactctttgtacccgtagtctggagttcagctctagcaaagggtaacttcacatgcgccacatgcgcagtgggcagatgaatggagaaagcaactataatgctactgggtattttcctagtagcaacacaggaccagacgtgaattttactgggaatagcccagtcaatattcatttcggtttctttctttgaaagaaaattccaaaagcataaagagcaaaacaaaaaaaagattaaaaaatctgtagaagtaacccagtgttccttctaaatagttttccaagcaactatcaacagacaagaggaagaaaaaatttaaaaataaaatgacagatggttgttagaaaatatgaaaagcttgatgtacgtaatatactcatgacatggcatatgataaacatacataggtttgagaagggaatttttgtagttctattctaatggataggcaatagataattaaggtgaaataaagaataatttgggacatattaaacttctgaagctgaggtaatgaaaggcactaggatatctggcagaaaaacccttgctgtctctgttaaaggaagctccttggagggatggatgatgggatacttctaggaggataattctcctgcccctgtaaggacttaggagtccttgtatatggacttggagccatattgttatgttaaagagaaagttcatcttctgaaccaaattatttaataattattaaattattaaaaattatttaataattattaaattattaaaaattatttaataattacctgtgtaatacacacagatccagacacacacacatacacagaactcaatataaagacaagaaaaagtagtccttaaaactgcttatcagtccattctatactacgggaaaaagtgactctttgatgttgaaaaaacaaattaccttttagtgtgactattttagcatgaaactgacaacattatatttaaataagattgccaaaaataaaaacaaacaacacaaatgccaaaaaacgctaccctttctttcttacatgcatattttcttttaaaaatatatttctgttataaaattagtgagaaaaatcttacctcggacagcatctaagtagtgagctaaaagggaggggaaaagagtgatcaaatgaatttctgagagactaaagctatacaatatgtactaatggtttaccatctgttgcctgggaggagaacagcaaactgcgcactgctgaaatgcctgcagctcaaaagttgggtacatgggcctgtgtagtttgtgaataatattttctgtgagaacaatattaatggcatttctgcaagaaactctattaggcttcataaaaagtgtcatatttcattagaagtataagaactgcattttcacatttcagtaataactcctgtgaaagagcactggcttcaacttcttattagtaatatctttagaagagagttctggagtaaccacctatggtaatcatcacaatatttaaatcctcttatgtaaaggcaataaacttactgtagtacaggaatgtaattacttaagctacacatctgaatctcacccctctccacctttttaatgaatcttaaatatttcccacagttgcagaacaagacttactgtacctttagtagagaagtaatgcagtttatgaagattatatgttatatgtattatatatattatacattactttggcaagctccaaccattataacaaaatactttcacctaaaaatgaaagctgtagtatagtctagtgagggaaaagcctacaaacaataaattgggtatccagaggcccacatttgcctttgctctgcatgaattttctgtgtagtcaaggaatgccactggaacactctgtgaccccctttctttagctgaacaatgggaatcatacttgttactctgtattaatgacaacctttctatgcaaagatttcttgcatagaaaccttagcggtggatagaaatatatgttaagggctttgctttttttcagaaaaagaaagtgttttataactgaaatatttatttttaatatcttttatagtgtgaagatcacatgataaattaattattacataggcttttccatattcacagatcattttccctttgtgaaattagcaataaggggtgaagggagagtggtggcttcaggaccaactctctacactaccggataaacaattcaacacacatgttctattgatgataggtcagaagtgccttcctcatatacattaaagacagcctctaatgatatcgaatggcccctgttaaagtagtcccatttaatgaaattgcctctaagtgctttcaactgaaacaacctatacttttcaaaaggaaaaatgggcagagaatgttaccttcactacaaaagcacttttcttattaactaatgacaccttattccaatgtaacatctttcacttgagtaactcaaagcacttgaaagcagaaaacataaggaatactgaagtaataagaaaggaaataacacaagaaatacgtagaatgtcatcgacaaaagaagaaacctaccagttcacaaaactttaaaacttgtaaccaaccctccttctcctcccctactccaacctcaaattctactaaatgccttgtgattgactcactagactgctcttaacttcaactaatccaacttactttggttaaagtatggtggtacttaccaattgtgcagtggtcgccctcccatccagggctacactcacattttccatctttgcattggccatgctcagtacaatgagaatgacaggagcgttcctcacatgttggtcctacccagccttcttcacactggcaaattcctcttgagcagactccatggctaccacactccatggtacacagctctgtggggaattcaaagaagacatattaacatattttgttaaaaccagcatccattcttccaaaaaacattataattaccaaaaatccctgtctatatttatattttatttatttattattttaatagagatggggtcttgctgggttaaccaggctggtcttgaacttctggcctcaagtgatcctcccatcttggcttcccaaagtgctgggattacagatgtgagccaccatgccctgcccatacttatattttaaacaaaatgttaataaacaatttatataaacaagatgtcacaaagatctctagcatctgaatgaatgtgcaagaaactctaaaaagaggtagttaagtctctaagaataatataaaactctaagccaaactgattctgagaagtctataaaatgataatggcattcaaggcttagaaatgagattaatgacaaacaaatgccaagtgggtttcactaaaaattcattaagatcacagataatgttgcaggaattttatgatagtataaggtatcactgggggaaaaatcccaataaaacagtgccctaacttcattcagaaagacaagttcattaattggaaagataataactttctaataaaattcataatatacaaaaggtaaagatgccaatgatgacaaccagctggtttccctgatcatactaacaatatttgcatttattttaagcatataaaattaaccctggttgattaaagtacacatccttcttatcttcaaatgctactaagtatttagacagtataataatgatgatgtgtactggctctgctgagtttctttcctttgtccctttgactttttgttgagaaatgctgaatattaataaagtcatgacagtagataaaccaacataaaagcatggcaagcctctttcgtgatctaattcccttgctggaggaagagaagtaggataaaaacctacggaaagaatgaaatatgttttgggaacaataggccacatattcctgaaaggaaaagagggtgttctggaagccaggttgtctctttcacagtctcaaattctgaaactagtttaatatatttagaggcattgatattaatattctccacagatagcagagttatttttcagtagatgacaatattcttctgataaagccatgattatgagttttattataatctggatcaatttgttcatgggtttactcacaagtattctttgaaggtcagggtatgatgggaagagtagtaaatttgaaataaagataactgcatccttgattcctctgcttagtacctatggacccttaggcaacttactaacatattgtcttaatctctgtttgcgtaagaatgcaatagaagtaataatacttatacatcacaaagctgttggacagatttgaaatatagtttagagatgtaaccaacaggacttgctcaaaattggatataagggatgaaggaaagggaaaaataaaagtttggcttaaacaagtggatagataaagctgtcattaatgaaatgggaaaggctaagggaaaaataagggtggaagatcaaaaagattaaccctaagatatatgtaaaaagccaagtgaaaatgtcagtgcaaccagcagaatatatgattctgacaggccaggactggagatataaaattggccatcattagcatataggtggtatttaaaggcatggaaataactggttgatacctctaaacagggaatagaagagccctgaagaaagatcaggtagaaaaaaagaggaaccatcaaaggaaactgggatggagatggcagtgagtgataggaagaaatccaggagattgtggtgtaactaaagcacaagaggacacttttcaataaaggagtgtttaactacatctaatattgctgagaggtcaagtaaggcacgggcagagaagtgcccattggatttatcaacatggaattcgttgatgactttaggaagagctgtactgataaaggtgtagttgaaaagccaaattggaatgggtggaaaagtgaatggaaagctgtgcagggactcatcaggttgtgagaaaagtctagggcatagaaaaacgtatcttaaaaacgtgggccttggcttaaaaagtggtagctcaggtagaattatcccaaaagaacccctggtcccgaatcttggtctgaatctctgataatttgtatttataacttcagtccttgtagtaaggctgatattatcattctgttccccttcacggcctcctcccaagacattaaaaactgaactgaaagggcctttataagattaggtgctaattggttaaagctaatcaagtcagctctgcctagaatagttagaagcaaacatttttcatatattgctttgtacaactataaatcttaggcatagaggagtataacattctgatttctgtttgaaaagtaataggactagatgaacagtattggccaaatagcagagtaggctattttcaaactatctctatataaaccattagaaatgttggatataatgtaacaattttttaaattgcatgtcttggctcacaaaaaaagagaaatcttcaagtgccagaagcaaagaggatgctaaaagccaaagcagtcaatcctctggtagccttgagagttattatacccaattacgactaggggcttgggtacttaagtccacaaggaaaaaagagatgaggtcttggcaccatttcagatggagttggactaaatctccagcataaagttggagccacttgaaaggctgcaatcacagtaagatggtgagtaataaactgtacccactagcccagagagatgacaaagaagtactgactattgagtataaaataataataataaaaaatctggagctaggaaacaatgtagaaataaaatactatcgtttaataatatgtaagatggagtgtcctgaatgaaatatttggaaagccttatattattcgggagttaggtaactggtactttgtcaagtatgcatatgaaaacataaaggtggaattctgtttctagtaatagggacctaagtaatttttactattcccttctgatgagaactagaaaatctaaacaaaatatatttttaaatcttttgggagttagtggagttcacaaaacagtaaagaattactgtgccaagttccagaagaaaaagaaaacccagagagaagagcctgacatttatggatgcttttcctatagcagcatctgtcaattatactagagggagctagaaggctcagaggctgagtagagctttttcagtctcatggaatcagaaaaaaaaattgaattgataatggctaatacatttctaacattggccaggcacattggcatacacctgtaatcccagcactttggaagggtgaggtgggcaggtcacttgagcgcaggagtttgagaacagcctgtgcaacatagtgagactccatctctacaaaaaatacaaaaaatagctgggtgtggtggcatgtgcctacagctactcaagaagttgaggtgggaggattgcttgagcccaggaggtcgaggctgcagtgagccatgttcatgccactgcactctagcctgggcaacagagtgaggccctgtctcaaacaaacaaacaaacaaacaaaacccaacactgaagaaagcagtaagccaaataaatgaagcaaaattgaaagaagaagaaagggaaaaggacaaattcacaatcatagtcagagactttacagcccccctctcacaccaactgatagagcaagcaaacaaatcagaaagaatatgaaatatttgagcaacatggttaacagatttgatctaattgatacatacaaaacactgccataaatgactacaaaatacacataatgtatttcaaatgtatatagaacatttacaaatattgaccacgtgctaggctctaaagcaagtcttgatatatttagaagtattgaaatcatacataggatattttaagcccagtatgaaattaaatttgaaatttgtaatagcagatgaatctaagatccatacatgcttggaaatcaagaaatatactttcaaataaaacattaaacgaataagacatcatcatgaaaattagaaaagagatggaaatgaatgaaaatgtgtaatataactaaatccatgtgtacagaaaaatttataaggtagaaagaaaaacgagctgaaaaaccatgacctaagtatcgattcttagaaatcagaaaaagaaaaccaatgtatacaagaaagtagaaggaagaaaatgctaattataagagctgaaactaatacaataggaataaatatactacagaaagaatcaacaaagtcaatacttgatgattggctcagaccaataaaattgataaactcccggtggagactgatcaagatgaaaatacagaagacccagataaacagtatcgggaataaaaagtatgacattgctatacatagtacaaacataaaacatcctaagacaatattactaacagctttttgccaatacatctgaaattttttatgaacaaatttctagaataatacaacttaataaactacaagaaaaagtggaaactgaatagtttctttaaagaaacttaatccataatggaaaacattaccacaaagaaaattccagtctcagatgacttcatttgtaaatataccaaacttttaagaaagaaaaattgccaatcttaaataaacttttccaaaaaatagaaaagaggaaactcttaacaatatgccttatgaggtcaacataatcctgatataaaattctgaaggatattatttaaaaaatatatgacagtctttctcatgaagatctcattcatggatacaaaaatcctaaacaaaaattaacatagcaaatctagcattacataacaagaaataatatcatgaccaatttgtgcttattctaggaatatattataagattgctttcacatttgaaaattaacaaatgtaattcatcacatatatggaataaaagagaaaaatcaaattatcatctcaatagatacataataggtatttgataaaatactaaacatccatttatgataaaaacttgtagcaaactaagactaaaaggaaattttaagttaacttgtaattaaaaggaactttcaactttaattttaaaactaagactaaaaggaactttaaatttgataaagagtagctacaacaccccatagcaaacaccataatagtgagatgttaaaatctttttttgtgttattaagactgagaaaagatgcctatgatcatcatttctacacaatataattctggaggtcctagccaatgaaattatgcaagaaaaaggaaacttgtataaacactgaaaaggaataaataaagtcatcatcactcaaaggcagtacaactttaacttaatggacatatataggacctcaaagctatgactatacaatacatgttctttccaagcacacacagaataacccacaaaaactgacaaagattcatctacaaagcaagactcaataaatgccaaagattccacagcatatggattattctgcttcacaaaatgcagtaaaattagaaatcaataaacaaaaagataacaaaagaaaaatcccagaaaggtgttctttaaaaacacacttaaaaagaattcatgaattatgtttcaaaaattacattggaattagaaattgagtaacaatgaaatactatttacaaaaacttgtgggatgcagcttagacagtaacttagaggaaatttacagcctgaaatgcatgtagtagaaaagaagaagaattgaaatctaatgagcaaagtgtccaaatcaaggatttagaaaaaggactacatataagtagatgaaggacacaacaaagccaagagcagaagttaatgaaattggaaacaaagaaacaacagagaagatcaacaaaatcaaaatctgcatctttgagatgaatataaaaaatagagaaacccatggcaaggtaatagagctagaaaaaaggaaaagaaagaatacaaataaacattaaagattaaaattcaaaaataaattagagactgctattaacaactttatgcaagtaagtctgaaaccttagataaagtagatgtttttccagaaaacaaatggacgtgagaagaaatagaaaacctgagtacacattaaaaacattgaaaattgcccagatggttttacaggtgtattttgtcaaattttcaaaggacagataatctctattttaaactataccagagaacaggaaaaaagggaaaccatcttgaatcattttataagaatataatctagttccaaaacagttccaaaatagggtaagaaaaggagaaaatgattttttttttttttaaaggtgggatgtctctattttgcccagactggacttgaactcttgagcccaagtgattcttccaccccagcctcccaagtatctgggactgcaggtgtgttccaccttgtccagctctagaactgatttcttaataggccaatctcacttataaacatggctgcaaaaatcttcaagaaaatatctggtaatcaaaccaaaaatgcacacacatacacacacacatgcgtacaccagtatatagaagtcacagccaaataagcatgaatgctaggatggtttaactttagaaaaatctatcaatgtaattcaccactgaattattccattttactttcacacatttcataatgattaaagaaaaattataattttattattatatgtagaaagagtaccatttaaaatttagttcctatttatgatagaatctcctagaaaaacatggctaaaagatagcttactgagtatggtaaaggtgatttaccaaaatcctatagtaagcatcatatttagtacagaaacagagtaatatattccttttaatgtcagaagaagtactagaattaactacagcttctaactcaatgttgtattggaaatcttagtcagcacaaaaaggcaaccaaagacataaaaaattggaatgcctgaaaaggaagaggtaaaattgaacatacaggtaaactatgaaagctacaaggtttctggatgtaaaatcaaaaggaaaaaatcaatagcatgcctagatattggggacagcaaattagaacacgtactttttttttctaaataaaaggttccattaaaaataatagcacatatagcaaaaaaaaggttccatactcctttacataaaattttaaaactttattgaagaacacataaaaagacccaatcaatggaaagatatactgtgttcatggctcacaaggcttaatatcattagaatgtcaatttttctgtactagctctataaattcaatgtaattctggtaaatatcccatcatagagcttgaaacatgatcctaaaatctatatgaaacagaaaaggccaagaatatccaagaacattttgaagcatacctattaatactagggggtgtgtatgtctgtctgaacctaaatatccatcaatgggaaaggatatataaattttagtatatttatgcagtgcaaaaaatatagcagttaacttgaataaggtagagatccatgcctgaatatggataaactttagaaacataatgatgaaggaggaaagcaagttattcatatgaaatttaaacacatgtagaaaaatacattttatggatatatacatatttggaaaagcctaaacatgtgtattgtatgacaatgaatagactgaggatagtggtttctgctgcagagaagagaggcagatgggatcacaaaagtatacatagggactttgtttgtatttattaatttttaaagcaaagtagtgggtttacagctgttcattatgttatcttacatgtctgaaatatttcataataatttacaaaagaaaaagagaatcagtaaaaaacaactgtctttagaactgactgttctattgaataaataactggagatattacttaacctaactcttacacaataccctccacagatacaaaccacaaccacgagtcggataggattcagcacagtaagaatccaggtgggaagcaatatcctcatgaatgagggaatcctctacaaaatgaattactacaaatggagaagcagatcttaagcaataagcattcctcattttgaactgcatcaacatttctgcaattgcatccagttccaaatagagtttctggactgattctaagatgtttttcaatcccaatcttcctataatcagcagtggggttggtgtgggtgaagaactaacagaaaacagatgctggcaattgtataatttataaacaagatagaaatgatatttgctctaatacatttgtctcatgaatagttctatttcctgtgtaatattttctatcttgttgaaaatacattaacattacaggctacaaaatatgacaaaagaatgctaaaatataaacattcttctgtgcaaatgtattggaaaagaacatgaaaaatataggcagacactttaaagttctattgagacatttcatttttaataagtttctttatgcatgtcaacaatgaacaacacttgtataaattgaactcagatacaactggaacacttctttgttgcatgctgacaaagaacaatttgattaaacagtaaatccttcagagcctccctcagaaccacttctctgagatttactttttaggcaaaagtttctagtaatgtaaactctgttattcttgacccctctgccttctccaatattagatggtgatcatatttggcaccccaaaagattaaatctggttatcagtttctaaagtatacatttatgtaaaaatttcaagattaaaatatggcattctaaacaaggaaaagacacctctgatgtaaaaattcataaaaattaagaaattattacatattcacttgcccagcatctggtagaatcaattaaagatcagagtaaattaggctgaaagggaaagcacagggaagaacagagaatgaatgagcctgaatagacagagaccctctctttcttagactttactgcaatttttgttggggaaactaaactatgaggatttttctcattgttttgtatgattaatattagaaataacagtaagaaaaaaaagtaaggttatattggcaagtgtaggcagtgccagctcaagctgtttgtttaagggctgaaaaaaattttggtgtacaccaaaaatttcactaaaatcaagcaatgattcaactaataacagtaaacattattacaaacaaaagtttgtgtactgtgtgttgtttcaccaagtatttggatcattttcattttactgatttcaactccttccatttctcagtagtaaatattctactagaaagtaggactactataagtcactgttaactttatatcagtagaacacacgtgcacacatgcatgcacatgcacacatatatacatgcatgcacacacatatttttggtgtctatttctctaaaagtaattagaagaacatattagttgatgaggtatcatatctgttttattgcatatggttaaattaaataccatctctaaccaatctttacaagtaccttgctatgataaagatttggctttactgtgggataagtatcacgttttctatgcttgaagtataatagtatctcctcattttaacacagaaaacctataacataatacttgtccctcagcctcagctttacaatgatgcttcaatgtatcttagtagttttaatactatcttaaatctgaacaattaaactgaagagattcaaaatgatacaaaatgtcagctagctttaactgaacaaatagcaacatacaagcagcataacaacagcgacacactccagcctatataaaaccttgagaggattctcaaattcttgatggataagaacaaaaatcccaaggaatctagcatgtgaagatcaaaagttgtaatgactttgagcttaatgtttcatggatcttgactgtcacatggttttggatttcctttataaaggaactggttaactgttctttggtaggtctgaataacctgacaagacagaaaaatccatgcctgacttacaacttttgaattcgataaaataagtcagttggccttttcactatacagaatctttcctttggaataaatcctgtttccttgcttgctaaataaaatattctccctaactctagatgtcacattttggttagcttagtgatcagaagctcaaactattgaagatgaggtgaacttctactcatttgtagctacagactgcaagagcatgtttcaatcctttgattataaacctgacacttttgcctatccaaatagtatcctcaaatgccaaagaatgttgaaatctagacatttgcttatcatttgacccattaggtaccagattgtcagggtaaaacccaaccctaaaggagcaaatattaactttttttttttgagacggagtcgcactctgtcacccaggctggagtgcagtggtgtgatctcgactcactgcaacctccacttcctgggttcaagtgattctcctgcctcagtctcctgagtagctaagactacaggtacacaccaccatacccagaaaatttttgtatttttagtagagacggggttttgccatgttggccaggccggtctcgaactcctgatctcaggtgatccacctgcctcggcctcccaaaatgctgggattataggcatgagccactgtgcccagccccgcaaatattaacttttaaggctcatgatctgtcatgagtggtaggccatgggattgctcagccatggcagagtttgtttttggtttatctacagcttttcacttagactttcttatcataattgccgtctaggtgcagtttgtgaccacctaaaagggcaagcttaactgcctcacagaggcatgaaatgcatgtcttagacatcagtaaaacagtgctctcacttataaaactatatacactatatagtgtatatcatttataaaactactactggaacaattatactgcatcttgtctaagagtggctacttaagaactatttcttggtaagttagaaagctacttttcgtatataaagtttaacattcttgggcataatttggtaaaaatgttaaaattgcaccaggcagaattttttctcccttttatgaatgatatttgacctgctttccctttttcagaaaattctgacattagctctcctcaaaatgaatttttgttagtccccttaatgcacatctaaattacctacatggtgttattctaaggcaataagcctcccaacttagcaaagaaactctacaaaccaaagatcttcaaatacacgtctaagtccccaagcaaatctgatagcatacttcagtggcaaagccaaagctgtatgctggaagaacacttcacgaagactaaaagtcttactctaaatgagaaagagctcacagacttgtcttccccatcccattcaacactattgctaagggctcaccatgctttagaacgctaactctaactggagtccacaagagagacgatactagcaatcatcaggcaacctttgcaacggtggtaggcttctgcatcctgaatgcagaaggtgtgttcaaggcattacaaaggcatggaaagcagctttctgtcaaagacctgggcaggggctgcatacatatttacaaagctgccatcatagcccaacagaccatgcaccaacagtttatttttacccttataaataagcatgacaggggagaaaagaaacgtaaagaacccagagtcaacaaaatcctcagcatgatgaagaaaaaaggcatataaatgtccttatatagtatttcaatgcatagtttagtgtcatttaagacatttagttttaaaaaaatttatagttttactctatggcaatcatcaaggctctatggttattagtgtcatctgaactttaagacatatattttgtcttaagacatatgtttcctatgagtcgccacacccattcttctaaggattaataatggagtaaagtatttgactttatgtctatccttgtcttatgctatcgacattctagtgaggttacaatgtactgtaggaaagctatgaggaggtagtatatcaatctaggtacatttacacgaagttaaagtccttggctcactctcaatttcacaaataacatgcatgctacgcatttctacctggctaagccaccggcacctttaaactcaacatgtttataacctacattttaatctcgactcatgaatcagttctttatcctgatttcactattttttttttttttgaggcagggtctcactccgttgcccaggctggagtgcagtggctagatcatggctcacggtggcgttaacctctcaggctcaagcaatcctcccgcctcagcctcctgagcagctggaactacagacacatgccaccatgcccagctaattaaaaaaaattttctgtagagattgggtctcactatgttgcccaggctggtcttgaactcctgggctcaagcaatcttcctgccttggcttcccaagtagctgggattacatgaatgagccaccacatccagtctgattttactatttttgttaatatcgtgataatagtcctagtttccaaggttaggatatttggcattacgctttcattttccttttgccttatgctcatatccaactacatctttcagttcttctgttttcaacacttcttcaatttctctctctctggaaggccaggatagcatagtgattaagagtacggactctaaagcctgatttcctggtctcgaatcctagctcagagatcgattaactatgggaccctgagcatctcactaaatctttctatgctttggtttcccatctataaaatcgggttggtacaaggaacaaatgagtcaatatatgtaaagtgcttacatatattacatatagtgctgggtacataagtattacataactgttagaaattatgactgcctctgtttccaatacacttatctggcccttcaccatcttttgtcttgagtctcacaaaagcctcctcatcggcttcacaaatgctctgttctctttttaaacatcccacatacaactataagctagaacaacagaatcttagggcttgggaaaactttaaaattcatctggccagcccctcactttgacatacaaacttcctacctttccaatattttcccaaaagttcagctatacgtcacaaagccagtcaattctatatttacgcagccatattagaaagtaatttgttgatttgaactgaaatctgctgtccatcttctttcaccaattagatttatttgtgtcctttaattctgccaaaaattatcatactctcttttctactggtcagcctctcagatcattgaagatagctatttaatctcaattaaatttttcttcatctagccacccttgagtcctacaaatgttgctcatgttacattgtttgcttacccttaacatattggttactcttctctgcacaaagcacagctctggtcacacactacatataaaaatatttcatagttcaccaaagcacactgaagtccaaaatccttagcctagaaatctaaactctctctaaccaagccccaattgttacttttttgactttggttttcacggttctccagcttgcatcctttgctacagacaaatttgactgctagccctattctatttagtagaatcaccttcttttcatgctttggggctctacaatgttttccctttctttttcaaggcctttcccacagcctatctctacctgcacaaatgatttttccacttgaagcttgaatgacaccttcttcaggcaacagtccatggtctaagatgctccaaggcagggatgaccttctcctcttctatactattatagagttttgtttacacatatattatgattgttattgcataccatcttttattgtagtttttatacatatgcattattcttcccactatattgtaagttgatgaaggcaggaactaggtcttaatcctttttttctctttcacacatttctagcacataagcactcaataaatatctgtaggattatttcatgaattgatttaacaaacatttattgagtactctgcatagctcagggcaaacttgagctttatatactttgattaaataaattactgatgaacataaaagtatctgaaattttcagtctgagtgactagaaaaatgttggcatcattgagggaaaccaggaagtcaggatgagttatgtttggttttggttgtgtttaattcaaggtgctggcaaaagatgcagaatgataggtatttgctaagctggcatatggataggcatttactaagctaagattctattattggagcttacagttgtgtgtgggaaagctgcatgctaggtgctaatgtggatcaaaaaagaggcaggaaagagggtggtgctaattcatcggcacttgtctgagattaacattaaatcaaagtaacgacataaaaaatagtggctacaatgtaaggaaacactgtcagtgtccattgacagacaaatggataaagaaaatgtagtatatatacaataaaatactattcaaccttaaaaaagaaggagatcctgccatttgctacacatgtgtgaacctggaggatgttacgctaagtggaataagccatgtgctgaaaggtaaatactctatgatctcacttatatgtggaatcttatatatatatatgtatatatacacatatacatatatacacatacatatagatatacatgtatatatgtatgtgaatatatactcatatatgtctatatacacatgtgtgtgtatatatatgcacacacacatacacacagagttagggaataaaatagtggttatggagtggggttggggagaggaaatgggaagatacaggttaaaggacacaaagtagcagatatgcaggatgaacaagtctagagatttaatgtacaacatgaggaccatagttaatataattgtactgtattaataattttttattttttatttcattaaaaagtttttttaccttttattttagattcaggaggtacacatgcaggtttgttacctaagtacattgcataatgccgaggtttggggtatgaatgatcctgtaatccaggcactgagcatactacccaacagctagttttcaacccttctccctctcttcctccccctatagtagttcccagtgtcttttgttgccatctttatgtccctgagtattcaatgtttggctcccacttataagcaagaacatgcagtatttggtttttctttcctgtgttagtttgcttaggataatggcctccagttccatccgtgtggctacaaagaacaatacttagttcttttttttttttttttttttttgaggtggagtcttgctctgtcacccaggctggagtgcagtggcacaatctcagctcactgcaacctccacctcccgagttccagggattctcctgcatcagtctcctgagtagctgggattacaggtgcgtgccaccacgtccggctaatttttttgtatttttagtagagacagggtttcaccatgttaggtaggatggtctccatctcctcacctggtgatccacccaccccaacctcccaaagtgctgggattacaggcatgagccactgcacccggcctatttagttctttttttatggctacatagtattccatggtacatatgtaccacattttctttatccaagcctccattgataggcatctaagtgatctcaagtctctgttactgtgagtagtgctgtgatgaacatgcaagtggatgtgtctttttggtagaacaatttgttttcttttgtatatatccccagtaatgggactgcttgattgaatggtagttttgttttaacttctttaagaaatctccaagttgctttccacagtggttgaactaattttcactcccaccaacagtggataagtgttcctttttcttcacagcctcactagcatctgttattttttttaactttttcatagcagccattctgacttaggtgagatggtatctcactgtggttttgatttccatttcgctgatgattaatgatgtggagcattttttcatatgtttgttggctacttgtatgtcttctttagagaagtgtctattcatatcttttgcccttttttttaaaaagcattattttattttaagttccgggatgcatgtgtgggatgcgcagatttgttacataggtaaacagtgccatggtggtttactgcacctatcaacccatcacctaggtattaagccccacatgcattagctatttttcctgatgatctcccttccccacaccccaatagtccccagtgtgtgttgttcccccccatgtccatgtgttctcattgttcagctaccacttatgtataagaacatgcagtatttggttttctgttcctgtgttagtttgctgaggataatggctcccaactccatccatgcccctgcaaaggacatgatctcattcttttttaaggctgcatagtattccatggtgtgtatgtaccatattttctttatccagtctatcattaatgttttttgtcaattttaatgggattatttgttttttccttgttcaattgaatcaatggattcttccaatctatgagcatggaatgtttttccatttgtttgtgttatctatgatttatcggagcagtgttttgaagttctccttgtagagatctttcacctccttggttagatgtattcttaagtattttatttttttgtggctactataaatgggattgtattcttgatttggctctcagcttgaacattattggtatatagaaatgctacttattgaggtggaacagctccggtctacagctcccagcgtgagcgacacagaagatgggtgatttctgcatttccatctgagatactgggttcatctcactagggagtgccagacagtgggcgcaggacagtgggtgcagcacaccgtgtgcgagctgaagcagggcgaggcattgcctcactcgggaagtgcaaggggtcagggagttccctttcctagtcaaagaaaggggtgaatcggcacctggaaaatcgggtcactcccaccctaatactgtgcttttctgacaggcttaaaaaacggcacaccaggagattatatcccgcacctggcttcgagggtcctacgcccacggagtctcgctgattgctagcacagcagtctgagatcaaattgcaagactgcagcgacgctgggggaggggcacccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagaccagtggttctcccagcacgcagctggagatctgagaacgggcagactgcctcctcaggtgggtccctgacccctgacccccgagcagcctaactgggaggcaccccccagtaggggcagactgacatctcacacggccgggtactcctctgagacaaaacttccagaggaatgatcagacagcaccattcacggttcatgaaaatccactgttctgcagccactgctgctggtacccaggcaaacagggtctggagtggacctctagcaaactccaacagacatgcagctgagggtcctgtctgttagaaggaaaactaacaaccagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggaatgcagctcctcaccagcaacggaacaaagctggatggagaatgactttgacgagttgagagaagaaggcttcagacgatcaaactactccgagctacaggaggaaattaaaaccaaaggcaaagaagttgaaaactttgaaaaaaatttagaagaatgtgtaactagaataaccaatacagagaagtgcttaaaggagctgatggagctgaaaccaaggctcgagaactacgtgaagaatgcagaagcctcaggagctgatgcgatcaactggaagaaagggtatcagtgatggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgacggggagaatggaaccaagttggaaaatgctctgcaggatattatccaggagaacttcccaaatctagcaaggcaggccaacattcagattcaggaaatacagagaatggcacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttagagaaaagaatttttaacccagaatttcatatccagcaaaactaagcttcataagtgaaggagaaataaaatactttacagacaagcaaatgctgagagattttgtcaccaccaggcctgccctaaaagagctcctgaaggaagcactaaacatggaaaggaacaactggcaccagccactgcaaaatcaagccaaaacgtaaagaccatcaaggctaggaagaaaccgcatcaactaaagagcaaaataaccagctaacatcataatgacaggatcaaattcacacataacaatattaaccttaaatgtaaatgggctaaatgctccaattaaaagacacagactggcaaattggataaagagtcaagatccatcggtgtgctttattcaggaaacccatctcatgtgcagagacacacataggctcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagggctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaagcatacccaggaattgaactcagctctgcaccaagcagacttaatagacatctacagaactctccaccccaaatcaacagaatatacattttgttcagcaccacaccacacctattccaaaattgatcacatagttggaagtaaagctctcctcagcaaatgtaaaagatcagaaattataacaaactgtctctcagaccacagtgccatcaaactagaactcaggattaagaaactcactcaaaaccgctcaactacatggaaactgaacaacctgctcctgaatgactactgggtacataacgaaatgaaggcagaaataaagatgttctttgaaaccaaccagaacaaagacacaacataccagaatctctgggacacattcaaagcagtgtgtagatggaaatttatagcactaaatgcccacaagagaaagcaggaaagatctaaaattgacaccctaacatcacaattaaaagaactagaaaagcaagagcaaacacattcaaaagctagcagaaggcaagaaataactaaaattagagcagaactgaaggaaatagagacacaaaaaacccttcaaaaaattaatgaatccaggagctggttttttgaaaggatcaacaaaactgatagaccgctagccagactaataaagaagaaaagacagaataatcaaatatacgcaataaaaaatgacaaacgggatatcaccaccgatcccacagaaatacaaactaccatcagggaatactacagatacctctacacaaataaactagaaaatctagaagagatggataaattcctcgacacatacaccctcccaagactaaaccaggaagaaggtgactctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagacacacaacagaaaaagagaattttagaccaatatccttgatgaatattgatgcaaaaatcctcaataaaatactggcaaaccgaatccagcagcacatcaaaaagcttatccaccatgatcaagtgggcttcatccctgggatgcaaggctggttcaatatacgcaaatcaagaaatgtaatccagcatataaacagaaccaaagacaaaaaccacatgattatctcaatagatgcagaaaaggcctttgacaaaattcaacaacgcttcatgctaaaatctctcaataaactaggtgttgatgggacctatctcaaaataataagagctatctatgacaaacccacagccaatatcatactgaatgggcaaaaactggaagcattccctttgaaaactggcacaagagagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatccatgtacaaaaatcacaagcattcttatacaccaataacagacaaacagagagccaaatcatgagtgaactcccattcacaattgcttcaaagagaataaaataccttggaatccaacctacaaaggacgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacacaattggaaaaaactactttaaagttcatatggaaccaaaaaagagcccgcattgccaagtcaatcctaagccaaatgaacaaagctggaggcatcatgctacctgacttcaaactatactacaaggctacagtaaccaaaacagcatggtactggtaccaaaacagagatattgaccaatggaacagaatagagccctcagaaataatgccacatatctacaactatctgatctttgacaaacctgagaaaaacaagcaatggggaaaggattccctatttaataaatggtgctgggaaaactggctagccatatggagaaagctgaaactggatcccttccttacaccttatacaaaaactaattcaagatggattaaagacttaaacgttagacctaaaaccataaaaaccctagaagaaaacctaggcattaccattcaggacataggcatgggcaaggacttcatgtctaaaacaccaaaagcaatagcaacaaaagccaaaattgacaaatgggatctaattaaactaaggagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaacaaacagccccatcaaaaagtgggcgaaggacatgaacagacacttctcaaaagaagacatttatgcagccaaaagacacatgaaaaaatgctcaccatcactggctatcagagaaatgcaaatcaaaaccacaatgagataccatctcacaccagttagaatggcaatcactaaaaagtcaggaaacaaccggtgttggagaggatgtggagaaataggaacacttttacactgttggtgggactgtaaactagttcaaccattgtggaagttagtgtagcgatttcctcggggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaaaaaaatgtggcacatatatgccatggaatactatgcagccataaaaaaggatgagttcatgtcctttgtagggacgtggatgaaattggaaatcatcattctcagtaaactacagcaaggacaaaaaaaccaaacactgcatattctcactcataggtgggaattgaacaatgagaacacatggacacaggaaggggaacatcacactctggggactgttgtggggtggggggagtggggagggatagctttaggagatatacctaatgctaaatgacgagttaatgggtgcagcacaccagcatggcacatgtatacatatgtaactaacctgcacattgtacacatgtaccctaaaacttaaagtataataataataaaataaaaataaaaaaagaaatgctatttatttttgtacattgatctgtgtatcctgaaactttactgaagtcctgtatcagttccaggagccttttggcagagtctttagggttttctaggtatagaatgataacatccatgaagacagatagtctgagttcctctcttcctatttggatgccttttatttctttctcttgcctaattgctgtggctagcacttatagtactatgttaaataggagtggtgagagtgggcatccttgtcttgttacagtcctcaaggggaatgcttccagtttttgcctgttcagtatgatgttggctgtgagtttgtcacagatcgcttttattattctgatgtatgttcctttgatgcctagtttcttgagggtttttttttttttatcatgaaggtattttggagtttataaaaagctttttccacatctattgagatggtcatatgacttttgtttttaagatgaatcacatctattgatttgtatatgttgaatcactcttacgtcccagggatgaagcctacttgattgtggtgcactagctttttgatgtactgatggattcagtttgctagtattttgttgggaatttttgcatctatgttcaacagggatactggcctgtagtttgttgttgttgttgttgttgttgttgttgttgttgttgtatctttgccaggttttggtaccagggtgatgttgccttcatagaattagttagggaggagtcactttcctcgattttttggaatagtttcagtagaattggtaccagctcttctttgtacactggtagaatttggctgtgaatccatctgtttggggctcttctggttgctagagtttttattactacttcaattttggaacttgatattcatctgttcaggctttcaatttcttccttgttcagtcttgggaggttatgtttttccagtaatgtatccatttcctctagactttctagtttgtgtgagtagaagtgttaataatagtctctgaggatcttttgtatttctatgggattggttgtaatgttatctttgttatttctgattgtgcttatttggctcttctcccttttttattttttaatctagctagtggtgtatccatcttttttatcctttcaaataactaacttttggttttgttaattctttgcttggatttttgagtttaatttattcagttctgctctggttttagtcatttattttcttctggttgctttggggctagtttgttcttgttttctatttcctctaggtgtgaagttagatcattaatttgagatgtaactttttgaggtagccattcagcgctataaactttcctcttaacatagcttttgctgcatcttagagatttgggtatgtcctgtctctgctttcatttatttcaaaaattttttttaaatttctgctttaatttcattgtttacacaaaagtcattcaggagcaagttgtttaactttgacataactgtgcagttttgagagatcttctcagtatcagcccaaaatctccttaagctgataagcaacttcagcaaagtctcaggatacaaaatcaatgtacaaaaatcacaagcattcttatacaccaacaacatacaaacagagagccaaatcatgagtgaactcccattcacaattgcttcaaagagaataaaatacctaggaatccaacttacaagggatgtgaaggacctcttcaaggagaacgacaaaccactgctcaaggaaataaaagaggatacaaacaaatggaagaacattccatgctcatgggtaggaagaatcaatatcgtgaaaatggccatactgcccaaggtaatttgatttctatttttattccactgtggtccaagagtatggtggtatgattgcaatttttctgaatttattgagatttactttaaggctgagcatatgtttcctcttggagtatgttccatgtgcagatgagaagaatgaattttgtgtttttgatgggtagagtattctgtagatgtctactaggtccaattggttgagtgtctaagctaagttcagaatttgttagttttctgtctcaattatctgtttaatgttgtcagtggggtgttgaagaaccatactattattgtgtagctgcctaagtcttttaataattctagaagtacttgttttatgaatctgggtgccccaatgttgggtgtgtgtatatttatgatagttaagtcttgctgaattggaccctttatcattatgtaatgaccttcattgtctttatttactgtcgttggcttaaagtctgttttatctgatataagaatagtgacccctgctcttttttgttttctatttgcatggtagatctttctccaacccttaactttgagcttctgggtgtcattatgtgtgagatgagtctcttaaagatagcagatggatgggtcttgtttttttatccaacttgtgactctgtgtcttttaagtgggggcatgtagaccatttatattcaaggtaaatattgacatgtgaggttttgatcctatcctgaagttgttaactggttgctttgtagtttctattgtgtacttgctttatagggtatgtgggctatgtactggagggtgtttgtgtggcagcaggtattgttctttcattgctgtgttccttaaggagctcttttaaggctggtctagtggtaacacattccctcagtgcttgcttgtctggaaaagtttttatttctccttcacttatgaagcatagttttgtgggatatgaaattattggttggaatttcttttctttaagaatgctgaaaacaggcccctaatctctcctggcttgtaaggtttctgctgataagtctactgttagcttgatggagttctctatgtaagtaatctgaccttttactctggctgcttttaagatttttttctttagcactgatcttggatagtctgcggactacatgcattggtgatgttcattctgtatagtatttctcaagtgttttctgcttttcttatatctggatataaacctttctagcaagattaaagaaatatttttgaattattccctcaaatgttttccaggtttttgctttttctcctcctctcccagaatgccaaaaattcacattttggttgctatatataatcccatatttctcaaatactttgttcatttttttatcattcttttttatttattttgtcagactggcatagttcaaaagactggtctccaagcttggaaattctttcttcggcttggtctagtctattaataaagctttcaattgtatttgaatttcaactgtattttgaaattacttgagtgtgttttcaattccagaagctttgattgatttctgtttagcatattaatctcttcctttatttcctggattgctttagaagtttctttgtgttgattttcaaccttgtcttggatctcattgagcttctttgtaattgtgctttgaattctttacctgtaatttctgaatttctgttttggttaggaaccattgctggacttgctagtgtgatcctttgaagctgtcgctacattcagattttcatggtgccaaaactcttgtgctggttccttctcatctggagatgttggcacttctaatttttgtaattatttccttgccagtaggttttttcttcatcattctttacctataatattattggtttttttttttttttttttgagacagagtattgctctgtcacccaggctagagtgtagtagtacaatctcagttcactgcaatctctgcctcccaggttcaagctattctcctgcctcagcctcctgaatagctgagactacaggtgtgtgccactacgtccagctaatttttatatttttagtagagatgcggtttcctatgttggccaggctggtcttgaactcttgacctcaggcgatctgctccccaccccaccgatccccttggcctcccaaagtgctgggattataggcgtgagccaccatgcccaggccttactgtttttttttttttttttggtttgtttaatttccctttccttttctccccctccctagggggtgtgactgcagagaatgctgggtatgggctgtcttttggctttgcttctatagttctatgcacttctcttagcaggttttatagttagacctacaagccagtagatggtgcttgtaggtaagagctagctagctacagctaatgtggctgcatatatatttcatccttgtttactggtagaaactctctgttctctcaggcaatggactgattcatgcagtgcagagtgctctgaactctgctcagccctagggttgtgggggacaagatgaatggggccagactaggcaggtccacctacagatcttccaatgtcaggcacaagcaccagtgccaagtgataatccagtgggcagccaccaggtgaataggtgctttgaatgcctggagatctccctgggcatgcagcagagagggcctccctgcaccaagatctctgcacaggaaggatggggcaggtcaggatgccaatccaggtgagttggtgctccaaatgcctggagatctgcctgggcttggagtagagagagcctcactacaccatgatctgtgcccagaaagggtgcagcagctcatggtgctgaaccaggcaaacagttgctttgaatgcctggagatttgccttggtgtggagcggaaggggccctgcggcacctcaatttatgtccgtgaagggtgaggcggctcaggctgctagtctaggcaagcaggtgctctaaatgcctagatttctgcctgggcatggggcagagagggccctactggaccaaaatctatgtccaggaagggtggagcagctcaggcttctggtccaagtaagtgaatgttctaagtacctgaatttctgcctggggtggagtggagagggctctgctgcaccatgacctcaggggagcaggctggggcacttagcaatggcatacacagaccagatgcaggttgccaagctggccctggctgcaaatctcacttcccaagggaaactgcagttctcctaccaatccgggattgcagtcggggagagcacaattccagtgccttctgctgaggtgctttccgtagttctggctgtggaggcccctaccctactccagagcaggtgctccaatctctggcctgaggctaaaatgcttgtgtggccacacttctaggttgccaagcaatggctgattttgtatgcacccagattaaaaatggcatctggctctcattcttgggtctgggaaaatatctgcagcttttcctggtatctttctctcacagcatctccaagcctctttctaagttagctctagggcttgggcaaaacaaagtgctttcccttggcctaggttgttcagatccactgtggaaaagtgagtcacagagggaagctctctgcccccttgtgtacttgggcttcactcacttttatcagctggatgacatcataggggctgtttgccagcattcacctccctgggatctggagtgtccttcacaattcccagaataatgcttttttaacttaaaaaaaatcttctcatgtcagaggagagtggaccccaggctgggagagaaatgtcttagtcaccttgggttgcaatagccaaatgccatagagtgggtggctgaaacagcagaaatttatttctgacaattctgaaggctaaagtccaagatcaaggtgcaacatggtcaggttctggtgaggtccctcttccagattgtggatggctgacttctcactgggtcctccaggatttttttaaatagatagattttagctgctcttgtcacaaaaagtaacatgagatgatagatattttaatttctttcacgatagtaaccattctactatctatgtgcatcccataatatcatgttataaacctcaaatatatacaataaaattattacgtagtccacaaaactaatgactatgaacaaagtcaatcttttctcatgtacttggaaaactcctaaatttctctgtttgatactcaaaagtaaacatttgaatctctgttttcattcatatctccattcagtgaggacttctatagaatcactggtttgaaaggcctagaatgtcaggatagttaattctttttgaggcttcaaaggtcagttctcacacgttataacctcctggccacttgcaatctatcaataaacacagacaaatgtccttgctcttttgaaggacaaaagtgttgtactcctttgtggtttggtttctaacttttaagagcaccaagagcagtccaaattcaaaggaaagaagcagcttcctcccactctgttgtcaattatcttcttgggaagtttctttgcagagtttttgtgcatctctgagccaattaccacaagaaaacaaaatgacctttaaattaaagcaatatgagtatgcttgaaatttgcagtgagaatagatcttaagtgtttttgccacatacacacacacacaaaagtaactatgtgaggtgatggatgagttaattaacttgattgtggtaataacttcacaatgcatatgtataaaatcatcactgtgtacatcttaaatgtatacaattttatttgttaattatgtctcaacaaagctagagtaaaaaagaagaaaggaaacaatctgaaatgcaaatgattgactaataatttccaattatgtaaaatattcttttgtaagaaatatgaatactcacttgacaattgtagactatagccacaaataaaaacaaatatattgatcatttatattaaaaatgaaaatatacccttaatctttttcttcttagcatctaagttcagactgtggtttacttggtcggctcttataaaaagaaataaaagccaaaactcttatttaggttttaatacattcaaccacatttcagattttccttaacaagcctaaatattaaaacagcttttaaagatgagtatataaaataaatcatctttatcatgaaagcactccgattatactttccttgcatttttaaatgatgacccttttagaattatccaaaccctgtaactgtcacattcttaactttccacttttttaataaaaatgatttccataaagattagaaattaatctgacctgactctgaaaactaatatagtttagcacgggaagctgtaaaaattcacctatctaggtttaataaagaaagttttttcaatttaaatatgcattgcatttaataagcttgcatgataatttcaacaatgttcatgggttctttaaattaccttcctgctgtgtccaggaaacaatccaattttatttttaagcaactgaattaagaaaagctttcaaaatcacaaagcgatttctgaatgacacaaaatgtaatgattagaagccagccaatcagattgctctgatggctgacttaagagaaaaaaaaattgtttgcctatatttctgtaaaccccaaatatatgagtttttggatacacctaaatgtttgactcttagatatcttctatccaaacatttgtcattgtgaggatcagcattccatccttttttccttccttttgacttttcattcacacgagttaaacatggtgctaactggcagaatacaacaacaaagacagatatggcccctgcctttatggagcatggaatctattgcatacatactcaaagaaatgtggaactacaaattgagaaaagtactatgaaggagcaatgcagagtgcaatgggagactgtcacagggtgacctaatttaatttgaaggtgtcaggattttgaccatttttaggcattggcatttaagttgaaaactacaggatgaatgggcaaacgtatgtggcgatggggaaatgaaatagataatatgtgtcgtaaggagagtaagagagagaggcagaatgaatggtatgagatggggctggacaagcagaggtcagagaattcaggcctttgtaggccttgctaaaattttggactttattatagtagcaattgaaaaaccctgaaaggtagtagagagtaacaaaaatcatatttgccttagaaagatctctttggatataatatagagaatggagtagaaggaagaagaggatatataagtggccaaaaaacatatgaaaaaatgctcaacatcactaatgacaagggaaatgcaaatcaaaaccacaatgtaataccaccttactcctgcaagaatggccataattttaaaaatcaaaaatatcatagatattggcatagatgtagtgaaaaggaacccttttacactgctggtgggaatgtaaagtagtacaaccctatggaaaacagtgtgtagattccttaaagaactaaaagtagatgtaccatttgatccagcaatcccactcctggatatctacccagaagaaaagatgtcattatatggaaaaagacacttgcacatgcatgttgatagtagcacaatgtgcaattgcaaaaatatggaaccagcccaaatgtccatcaatcaacaagaggataaagcaaatgtggtatataaataccatggaataatactcagccataaaaaggaacaaagtaatgtcattcacagcaacctggatggaggtggagaccattattctaagtgaagtaactcaggaatggaaaaccgaacattgcatgttctcttataagtgggagctaagatatgaggatgcaaacgcacaagaatgatataacggagtatggggacttgaggggaagggtgggagagggatagaggatggaagatgggtgataaaagactacacattgggtacagtgtacactgcttgggtgacgagtgcaccaaaatatcagaaatcaccgctaaagaacttatccatgtaaccaaacaccacctcctccccccaaacctattgaaataagaaaaagaaccctatctctcaccatgtacaaagatcaaatcaaaatggattagagacttaaatctaagacctcaaactatgaaactactacaagacataattgggggaaatctgcaggacattgatttgggcaaaaagttgttgaataataccccacaagcataggcaaccaaagcaaaaatggacaaatggaatgacataaagttaaaaagcttctgcacaggaaagaaaacaatcaacaaagtgaagaaacaacccacagaatgggagaaaatatttgcaaagtactcatctcacaagggattaataaccagaatatataaggagctcaaacaactctataggataaaacctaataatctgatcaaaagatgggcaaaatatttgaatagacatgtctcaaaagaagacatacaaatggcaaccaggtatatgaaaaggtactcaacatcacttatcatcagagaaatgcaaatcaaaactgtaatgagaaatcatctaaccccagttaaaatggcatacatccaaagacagttattacaaatgctagtgaggatatggacaaaagggaaccctagcacactgttggtgggaaggtaaattagtacaaccactatggagaacagttttgagaacagtcagtttttataaaactaaaaatggagctaccatatgatccaggaatcccactgctggatatatatcccaaagaaaggaaatgagtatatcaaagagaaatctgcacccctatgtttgttgcagcactgttcacaatagctaagatttggaagcaacctaagttgtccatcaacagatgaatggataaagaaaatgtggtacatatacacaatggagtagtattcagccataaaaaagaatgatatcctgtcatttgcaagaacatggagggaactggagatcattatgataagtgaaataagccaggaacagaaagacaaacattgcacttgctcacttatttgtaggaactaaaaatcaaaacaactgaactcatgtggacagggagtagaaggatggttaccagaggctgggaagggtagtggggtttggctgaatggtgtgggagggagatggggatggttagtgggtacaaaataatagaaagaatgaataagacctactatttgatagcacaacagggtgacaatagtcaatagtaaattaattgtacatttaaaaatagctaaaagagtataattggattgtttgtaacacaaaagataaatgcttgagataatggatacctcatttactctgatgtgattattatacactgcatgcctgtatcaagatatcttttgcatcccataaatatatacacctacttaggatgtatgtgtagcaaacaacatagtatatatagggttcagtgctatccaaggtttcagacatccactgggaatcttgaaacacatcccccagtggataatggggactgctgtatgcaaaatatttttatgaagtagaattacaagacttggtgactgatcagataaagagtgcaaaggatatggaaaagccatgcatcatgtcttagtttggcatgtgcaactctctgggtgtttactctatttcttatcaatatagggactgctgaaggatgagttcagctttagacctgttaacctgaggtgcctgtaaaaaattcaactaaaagtggcaaggaggcagatggatctatgggtctggaattaggaagaggtttcacgggcagagattaaatttttaagtcaccagtaaaaatggtcattgaaaccaagggaatttgtgatgagtgtgatgagaaatgaatggggcctaagattgtgggactttaacaattaaaggtcaagtggaggaggagatccagcaaaagagagaaggattttctatagatgtaaaagaaaaatcaagagaatgtagtatcacagaaaccagtgaaagagagttttccacgattaggagtagttaagtatcccaaatggtactgtaagtcaagtagggtgaacattaaaaagtgtctgtcatatttagtaaaatggtgattactggtaacatagtgacagctgttttagcggagtgattgggggtagaagccagaatgaaataggttaacaagtgactggagtaaatatataaaggataaggggatcttgattttacattgtcagagaagagagttacaaatatgaaaaaggagaaaacaagaatgaaccctgtggtgttgaactggagttggaggtaataatggaaactcatggttttctctagatagatagatgatatataaatagataaaaaggtgaatattgatagaaattagtatgtatatatatatgtgtgtgtgtgtgtatatatatatataaatgtatgtgtatatttcctacctctgttcaccatgagggcctgggaatagcaataccccaatagcaatgaacacacctagtgccgagaacagaacttggcttctaaataccacgccgagaaaagaaattagcctccttagagaaatgcctgattccaggcacagggcagggaaagtgcaaggtgagactggaatatcctattaagacaaaaagtgctcagagaaagatgaggacatgtcaaaaacatgcaaagtccaccttgaagtggcagtcagtcactgtttacaaaacaatttgagcatcaaaataaacagaaatagcaagaaactataattcattgaataatatgaaaaatcctgagttatcacaggtatgaataaatgaattaataaattgaaagtttgatgagcaatacatagcttcaaagtacctcctcacaaaacacttcttaattacaagtgcatatgggatgagtacagtggagaagcctggaagataccatattaattaaatgatcaaagttaacattaccagtagtgggccaaataaataatgggtaccacctgataggatataatgcaaacacaacattaattctatgatattcttgccaaagatgtacaacccaaatctaagtatgaggaaacatcagaaaactcccaaattgaggggctttgtataaaataaccagtatgtaatctttaggagtatcagtcatgacagttaaggaaagattgagataatcttccaacctgaaggagactagagggcatgacaactaaaatgtagtgctttattctgaaccagttccttttgctataagggatgttgctgggatatgtgatgaaatatgaatagaatctaagcattagacattagtaatgtatgaatgtgaatttcctgttttctatagctgtattgtggttatgtagaataatgcctttaattttaggaaatacacaataaagaatttgggagaaaagggtccacaacttattcttgagtgtttcaggggaaaattatttgtactgtactttcacttttcagtaagcttgtgattgttaccaaataaaaagtaaagggtgaatggaaggtaagaaagtggagaagttgaagttgaaacattaaagaaggcaagagataattaactagctagaggagaacgtgggattcaaaaaggaatttctttttcaagtgggagagacaaaaccatgtttaaaagctcttgagaaggatctagtagaaactttggagtcaaacttacgtgtgagagaaagtgggagaaaagtgggatccagagcactggtgaagggactgacctttcacaggactcttcgaggactgtaatgggaggaagaaagagagcctgggtgcagatccaacctgatttcagacttgatggcaggaaattgagggagttctcatgtgatggttattttttctgtgcagcaggaggcaagggcatccattgagaatgaatgggcagaggagaagttagaagtttgagaagagaaattctgaaaaagtgtctgtggagaataacaaaatgaggtaacctgaggaatacagtaatatttccaggcacttttgacatcccaagtgaggttggtggctgaatttttattggtatcagtctacccaaaccgtatgatttttttccaatagggcttggctactgcttgtataggtaggggcaaggctgagagttgacataattcattgtttgaggcttttcaggaaggaccaatggggcaatggattttagagtatttgcaagagggattaaaatgatagaccatttgtattggaacttgggagaatacatttttctacattctttcttaaaggaagtcctacttatatagaacttctctaaccttttactgatggaaaaagcactgcaactataacttagtaaacttctgaagtgttagaaaaattcaaagttggatacttttcaagctgaaaatcttactcttcccaataaattacaataatgttcagtagtttgctcatttggcatcattaatcagaactttgaagtgcggtacataattttaggttgagaaggtcctatctgttcaggccatttaaaatgggttaattatatcgattctaaagtaaaaggacagctatcccatagtgcctgaaatccccaaaactaaagtattatctcatcataattcagatacctgtgtttctacgtgagctgcttaaatgttacccattttatttattggagttcagaagaagatttaactggaagtttctgctgtcaaaaaatgaagttcaaaaccactgatgggtctgttgaaaaaaacccttgaccaattttccaaaaatttcaattataatgcctgtattatcttcctcaccagagttttggaacaatgagctaatgaagctttgttaaaatatataataataagattattggtaagttgaagggagaaaaataagtctagaacttgaggcattgctcagagtaagcaagacttaggtagggtggctgttgggagtcttaggcagaatgaaggtgttatggtgcaagggtgagggacaaggacagaagagccacatagggaaacgcaggagcctaaggggagattataggccactgaagagaaactttgctattttcacggttttaatggtactggttcttgccttgggaatatctgagataaaatgatacaaccctttcccaggatgtggcaacctaaaagatgatgaagccagagaaagtgaaactgaagatgtcttaccaagtgtattgggttaaatggtacgtccttgtcataattcctaaatcctgtgcacgagaccttattttgaaaaagggtttttgcaaatgtaattaaattaagaatcttaagattagatcagcttggattaaccttgtgggcactaaatagaatgacaaatgtcttcataagagacagaaaaggaaaagggaagaggagaaggccatatgaagacagaggcagagactggagttatgtagtcacacactaaggaatgctgccagccacctgaagctggagaaggcagaaatgtttctccccagagtctccagagggagtgtggacctgctgacattttgattttagacttctagcctccagaactgagagagaataaatttcagttgcttaaagtcacctggtttggggtaatttgttatgatagctctaggaaactgatatactaagcatgtcatttaaacatatagcagttgcactgtagttatcaagacctcatgatgcaatttaaacatgcaggcctgttggcattaagcaataattacaatagtagcagccactgcaaacatttatcgggaattttagatactaagcactgtgctgaatgatgcaaatgaattattttcctgagtcctcagaacagctctatgttagaggtactgttattaacctcactctacacatgaggggactgaggcttaacactttgtctagggttttacaaccaccaggcagtagaacagggatttgaacccacacagcctgatgctggagcccacacttttaaccactacactaaactgctttcagaagttatttggatacaccacagtagttggtaataacttatgttctaaataagtctgattggctgaacaataaagatatttttgttttcaagttcaatctaaactcagacatttcattgctatacaatagacacaaatctgtatcacaaagaaacaaaagcttttcaagacatgtcctgttacttacttcaagtaactagagttgagtaaagcaaaaaatgataactttgatagtaccatacttaccctagccagaattaagtagggatgttgttttaataaaaatgttcattttactttttttatttaagctatttgccctatagtatatgcaaaggatactttaataaaatcattacaccttatgtagtagttgtttcttttgatcacaataacatgttcaccctttaatatgatcatattcttccttctttctcacatctttgtactaacttctgttgtcaatttattcagtctacataaaataatcggtataatagcaaaatgacatagtaatatggtgctatctcaaaattagtagttgctcctcaaaaataaaggcagtctgctctaccttgatgtttggattgctcagctgtcataggaaacccttctgcctagacagctccagtcccttggcattctttcttaatgatattttatttgagaagctaacaacgacataaaagagtaataatgtgtagtaggttcaatcccatattttttaatatctcactgtttgagacatcttaaaatgctggcttcctcaaacagaaccacattgttattttccaaaattctattccttcaagggatagagttctttacttttcttaaatgaaaatgcccagaaatgatcagtttgaagctgttggggcagaaactcatcttcaggtccaaaatcgttgatgtgtgagttagaattaatagacctaactgggagtcccagatctgctacttattagccatgtgaactgggatatgctcatagcatgtctaagatggcgtcttcatttgtaaaatgaggatgctatcatccatcctaacttacaggaatgttggaaatatagtgtaactatttgaaaaacactttgaaaactcaagcagtaaaccaaagtaatcctgatacatagaaatgcatgaactttcataatggacagagttggatttgaatcctagatccagtagctgtgtgggcttagaaaatactcttcccttgatttcctaacctgtcaaaggagatacttcttagaagcgttgtttaaatagacgacgtttatgaaagtagtacactgactggcatatattattttttttctctctcctctcccttacatgccctatttctgaagaacatctctagattcagagcaaatagaggattccatttaggatcaatggtaggtttcccttgcttgggactcttcaaaaaagccccaagaacagtgctgcaaggactactgtgaagtcaaagtgtcaggcttcaaattttcttagaaaaatcaatttgagccaaccaaaaatgaggctgcattttggaaaattggcctttaatatctagaaagttcaatactgctttcaccatactagatgggcttttctttcagtaaagaaaataaaaggagtgagttttactacttttgactaggtgactttatgtgtataagaacggtttcatccttttctaggtccaacagaaagtttcaccttaaaaatcacagataaaaccacttttttcttctttggtctattcctccaaataattccaggtgtgatctacaggaccttttgttgtatatggagtcaagggggcaagagaattgttggtgatcttcaggagcaaattccactttctaatctccagtatctttttccaatgttgaaagcacagctaccaaacattttcaaatacccttctggttttgctttgccatttttgttttcagtaatgtttgcttttctcagtgttgtctgtatattcagcctctgaggactaatgtcacttgtccagtaacctaacaatgatgttaaactcaatgttctcataatgagacattactcatccttgggatatttacagtaatacaatgcactggataatatggaatgtgatctactgttccactggaataccaatgttgcgcatcattaataaatgcacagtttctattatatgtgaggctttcaattagcatacatatttttgtcatcatatatcaaaccagctgacttcttctcatcttgttatttttgctgacttgaaaagctgaattcttattgtagcagtgtatattaaagtctgaactttgaaaaccactccaaatgattttcagtattgaaatggaaattcgattttttccaagctttctaaatgaagcaacatgatgtttttcttctttcaatcatttctatggtacctttgcaaaaagaccatatgctgttaacctaaacctggtgtatttagattacaatgcattttgcaaagtatggcccacagagtgcctgcttgggatccagttaaaaaatgcatattcttgggccccactgcagatctactgagtcaaaatgtgagggtgaggcctggaaatttttcttttaacaatattctaggtaatgtattctaaaattacaggatcactgatttggtgttgagagagttgacactcttccatttctcatttctttgcctctataagaacctttatcatcctcataatcttaatcctttctaagtaacatgctgtcccattgactatttaaagatacctaagtgttccatttaggacacaggactggaaataagaagattctagtcctcattttgccatttattttccatgtgacattggacaagacttaatatttctgagctttattttcaccaacagcaaaatggtgaaaagtaggaaagaagggagaggaaacaagatggttagatacattaatgtctaagattttgtctggatccaacattttataatttcatgaatgtttcagctgctagaaagagagtaggagagggaaaaagaggacagtaagataagctgcagaagtcactaggtttggaggaatggaatgagcatgggttctagaatcagacacattagggtttagaccatagctctgatatactaattatgtcatcttgagcaaattataccatgctttgagctttaatttctttgtttattaacatggggataacatatattctcacagagttcacgttatgattaaaagagatagtacactatgtacaatagtacccagcaacaggtgctcagtaagttaatggatatgatgaagaagagaaggaataagaggatgaggatgaggagaaggagggagaggcagaagagaaggaggacgaaaaggaggaagatgtggaggaggacaaggaggaggaggataagggaggaaacattaaggaatgagacaaaatggtgggcatttggtacctcagatttatttgaaaacaaatatctgttgggaatctatgatgagccaagtactattccaggcaatggctatacagtggtggtcaaaatagatattttctacttttgtggagcttattttctgatgtgtatgtgtatgtgtagggggtgatggtatggcagagaataataaatgaatatgggatattttcagtggtaataatggctctgaagaaaattaaagtagggtgagagggatgcagagtaatgaaaggtgggtagttgctattttatattgggtgatcagggaaagcctctctaataatttatcaattgaacaaagactcaaaggaagtgtgagaacttcacagctatttggagggaggcaggcagaaagaataccaagaagaaatgttctaaaacaggagcattatgagaatactgaagaaaaaaaaggaggccagaattctgcatatgtagctggagcagcatgaaagagaggaagaaaggttagtaggagatggtgtgagagaggtcacagaggtgggagaagcagattgggtagggccctgtagattatagtgaggaagtcacctttaactctgagtgaagtgggaagaccatggaagcttgtgagcagaggaatgacaggacctgatttacaaaggattactcttgttgttctgctgagaatagactctagggggaaaagatggaaacagggagaccaattaacaggctattgcaataatacaggtgagaggtgatggtggcctgggaccaggacaggagcagtgtagctggtgagaaatggtcagattctggatatatttgagaatggagccaattagatttgctgatggactagatgtagatatgcaagataatgatgatcccaaggttttgggtctgagtaactagaagaacaaagttgcatttagtgagatggggaagactaaaagagtggcaagtataaggaggataagttacatgtgtaaatcgattgctacagtaaggagtcagccgactaacatttagtgggcactcctgtgtgagaagcccaataacaggtgcgctgagattttattagtaaagtgctcttgttagtattataaggaaaccagagaacattgtctttagttttagtcgagtgcttgtaaaattattttgggaataagctgcagtcttcctaatgcgtgggaagtccacatcagagttaatatacatcagttttcagctttccaaagccatgttcattatctctgaacttcagctttagccaaatcaaataaaaactagtacaagttgaggggctgcaactttgctatttgcttactcagagtgatgccttaccatcgctccaataactgccttaattgttttctggaaataatgctaccccatctggtgggatgtttctgaagcattaagtgctccaaggaaaagagcttctttgctttacagtaagcgcgctgctgtcaggagcctcactggctgttttgtacttcagtttgtgctgcttcccaagagctgaatggaactctattttgtcatttaaatctaaagaaggcatttgcacactgatgatgttatctgaagttctaatttgtgcaaacattgatctgctttgagcagaagagaaatctccattcagacagcaagaactgagctcagattaatagtcaggggaaagaactgaagcaccaggaagagtaagctttttttttttttttcattttaggatgctttatcagattttctttccagatttatttctgctccaacaaagaatattctttttgagctaaatctaatttgtgtataaaaaatacacacccatattgatttcactctggtttaaaatggtatttttgcagcgcaaaaatctaatcaatacaatcttatgagttggactggtaatggtaaacatactaacagatatttcatttcatggggccaaagctctggaaattgataccactgaaaaggattactcattcaccattgggtataactttgtttacccaaccatgatataggtgtaaagcagaaatacaattatgctgtggccaacacacagggggtttttgaatagtagaacttgccttccccatttcccctaagggccatagatcgtacaagttggcagatcaaataaggatattgtgggaaatcgtttactataaatgaaaaaaagtttaatctgatagggtagaaaattagactgacatagtcgctgaagaaaaaaagtctcccaagccaagatcaactttttaaaaattcagcttttagaggagatggatttgtagatccttgaacccatgctgcttttttttttcctcacacatgtatctaaagcctttggttttgagcgagacatgctacgcctttggttttgagcaagacatgctacaagtgaaattgtaagacagtagttgccagggattcaaattgcagccaacaagccttttaacatgcttaatcaaaactgtagcaataccaaaggaactgtgtttcaccatttctagtgggcttaagtgtgaggaactgaaattaatcaaaagatataacctggacttacctctgcctcatgctcacataactcttggttgcccccactggagtaaaatgtagtgaaaacctacagtgcaggagcatacaaagggttgagactagaagaaataattcagctagagtacagaaaaaagcaccattgtccctaaatattatgaccctggaatataagattgatgcctaaagccaaggaggcatgaatctaaggaaaacagatggctattgctgttaatgtacagtcaccataggaggtggatactaaaaattcagatatagattttatgctggaatcagccaagggcagtctgggcaataacgataatgcctgtgagtaccatgttgtgatcgctgtgggtgaccagaagacaataattgatatttcctataatcaatttataagggggcctttctcacaatagctcatagtgctttctaattcactagcctaggttgacataggcacaaaatcactccattagacggagaggagataggtaactattttcattttgataattggaaaacagaggcccaggctaatttgtccaaaatcctatagcaatttggctgtatttctttgaaccccttcagaaagctgacaatatatcaactcaaaatattatcagattctgtttatagtgcaataataggaagtaattcttccatgcaatacgtatttatacagcttagacagtagatgttcagtctttacctttgaacatacgaagtcactaaaggaggaacataagttttaaatattcaaatttcactgcctttggaatctatttttcagtaaataagtgtcataatacagaaaagctatgaattctaccttagtcttctggtctttaacaagtttgcaaagtgtattgtcaactcaactctttgattacaataagtattgtacttcttcctactactaagcatgtgtaatcaaatatcaacaggaaatgttatttcttggtgggtccttattaaaatgaatcagtgagatttaggtataaacagtggcctgaataagggatgatacctccctccttcattcacacaagatcttttctgccagggaggtatttagatctttgtcctccccttcgtagaaactttgagggttatactggtttgtaaacatctatattgattatagtttctaaaatgatattataattaattattctttaatatctaataaatcactttatctcccaaacatgctaggaagcatgcgacttccttatttatgctttatagagtaggaaactgaggctcaaagaaatgagggatttgactaaagtcacgggttactcagtagcagtgctggaactagatctaggactcttgactcttagcttcagactctttccactacagcagtggcttgatgggacacttggactagtcagtataggttagattaggttgcagatgacccacctccccacaagataatagtgggtggaaacaacagatgcttatttttcattcatgctacatgtgcaatgcagttcagaaggtggtgctctgaacacaacttaggacactgtcatctcagcatgaagcttttagggccttccaaggcaggctaaaagaaaatggagatttgtgcaatggctcttaaaagcttccactcagaaatgctacacataccatctgctcacatttcataggccagagcaagtcacgtgatgatgcctaactgaaatggcactgtgccccaaaggataaaacaattgggatcttggtgaacactaatatgtctaccagaatactttccattcaaatgaagtcttaatcagaaccccactatataaaatagatataaagtagggagatccaaacctacttaacttactccttgtttctttggaagctcctaaggtacttttaaagaacatcaggattcagtgaacccaattcaaaatcagctgcctccaatatacaaagaaagccagcacaccaaataagtatctttatagtaaagataagaagaccaataatgtttttcaggatcatgagataaaatagaagctaaagtgggaacagatcacagaatgatccattctttatctcttgttctactcactagactttggttctcccactgtgatacagaaaatcttcaagaatattgtgacttttcatgtcacaatgtattaggtgcacataatgctacccataacgaatgctaagtctcaagtgcacagcatggttcagaaactaatttctaaaggaggcacacagttttagattcattttgaactccacagctgcctcttagtactaagcaacttgacttgcatgcaagagtaaatgttttaatataatatgcctgtacattttcagccttgctgaattttaaaatatgattttttcagaaaacaaaaattattttattggattgtggctggaaggaaaatgatccttttaaagatgaggaaggtaattcagtatcactagtttttacgaagaacattttcaatcaagacagaaaaataaaaatatatgtgtatttcagggatgcttgtttaggcatagaataaatatggttagaacaatgatttcaaggtgtgtgtgtctgtgtgtgtgtgtacatgcatacatatgtgtgtgtgctaggggacacatcaaaaccactggggtggcggggagcttttcaaactacacatactccactaccctcattctgataactcaccccaaactgagaatctgtactttaaaaagtcaccattactttttatgaaaggagtagcctgtcatagccctgaggtgagttgggtagaataaaaatgttgaaatctactaggttggaacagtgttctgtactataaacatctgtggcaacatttttttctaagaattaaacctagaattctccttccagcagtgtcacccatcccaaactatgttgataacaagcaagccatttttttacccaacaacaaattcccaaaagagaagagatttcttgtgctatgcgtttaaaatgacaacagatcacataactacacagaataaagatatttttgttccaggcctccacattgggtaggcagaggggagaggagaacctattaacctgaatgacctccttcttttccttgctttctccctccctcccttcctccttttctcccaactatctatctatctatatcatctatctatcattgatcatctatctatcattgatcatctatctatcatcatctaccaaagcacactcccacatcaatttcatgttcacatgtgaatgcaaagacttttcacatataagtatgctgctgatcatccagcagattagtgaatcaatttaccagtcctgcaatctattttcttcccagagctggaaagaaaataaaatccacattaattccatcctatggatggaacgttacctttcattgccttctacaatgtgtaaagttcagtgaaggccctacctcaaagtttcattttggtggtgagaggtactatttgaaataaggttgctatagaaagatgcttccttctgagatgatgaacaactgacatttgtatagaactttaccttttacaaagcattttctgattaattatcataatgtctcaagtcatgtacatcagcttaaacttcccctgttttccaggcctgaggcattatgaggaaaaaatagaaatgacccggataagaagtgaggttgtgaaaatccaggaaagggacaactgctgatcgcattgtgtttggttttaatgtatatgtaaaccaaaattattctgaatacaaaaaaaaaaggaagaacagaatggttcctcaagttctcttatatcagcaaactatttaaaaaatcatgtctttgaaaatttagatagaacccagggacaaaatgaagagacagtggcaaatgggagatccaactatcatatgggtcaggaggttataaagtatttcattcttcaaattattctggtgtcctctaaatatgtccacctcaccctttatttcatttctttcactgcttggtaatatctcatttgataatatcatgggaatcttttcctcaatgtttttttctacagctctaggtagttttgacttaagttaaagatactgaaaactgtaagagagtatattatttctgaccctagcgttgcccttaaatctgtcaactagggtctattttgacctattttaaatggcatcatctggtcttccttcagctaccctcctcttttggggtgaaaagtctactgggccaatggtataagcttatctggagtttgcactcctgatccccaataagactactccgtgggaagctgggtgcctagaatgccctgtctacatggccctaagcctactttcagggcctatggaggactctggcaagtttggactatgttgccgatatatgcgccccaaggcttgaaggatagctaaaggacaactgttttctgggggggttggggtggtggcgtggtatgtcaatagagtttggctggtatggctgagtccatgtatatgaagcctctcataatatggaacagagtcagggctgggaggagaaaggggttagaacataggcagaaggtctctatttgtatttttgctctatgttccacaaacgttaaggatggccctatctgtaccaattatatttgaaaagaatgcagctttacgtaaaattctctcctgatatccccctatatgaaatctcaaagtaatctagaaaattggtcatggtatagatcattgcacctaagaagttaatacatctacctcccaggaagctccatgctatgctcactggcttatgaaaacaatcttctattctcctatttctgggtcatgcatgtaaaataagactagactaaaatggggtggctgtccatgggatgggagataggaggagaggagccagggtttattcaagctagaagtggggttacccagacaacattttagaagtactgagtggtaacaggctgggcgtggtggctcacgcctgtaatcccagcaagttgggaggcctaggcgggcagatcacctgaggtcaggagttcgagatgagcctggtcaacatggtgaaaccctgtctctactaaaaatacaaaaattagctgggcgtggtggtgcatgtctgtagtcccagctactcgggaggctgaggcaggagaatcgcttcaacccaggaggtggagattgcagtgagcggagatcacgccaatgcactccaccctgggtgatagagcaagatctgtctcacacacacacaaaaaaagcagcattaagtggtaactagaaggcagagccaaggatagagaccaggaggaattgatcatgcttcaagagctaggaacatgcccaagatttagtatcaggccagtaactataaactacccaatattatgcctagaagccatcttctcaacagcattcttaattcctgtttttcccacaaatggaagaagacggcaaagtgttttgatgataacacaaagaatttacgcttactttttaaaaaaatatgtaaccttggatgtagaatgacaggcaaagtagctaagtaaatgttggttgaagtagcatttcatgtctacatcacaggtgttcctgtatgaaagtgtcttggcttcaaaccctgagttaaaagacttaaaattcaaacacatttattgacactcaagcatggtcccagtaattaaacagtctgtggagggcgaactgtactaccaattcaagaaacttagtatttactctgggtgcttcatgactggggaaatttgagcaaatcacttatcttctctgtgccttagtttcctgatctgtcaattgtgaacaatcatttcctcacaggttgttgtaccaaatataataacaattggcaaagagcattgaaaagtacaatgccatacaaaagtaaggttccgttatttttagatgaaacatcttacaaaaagtaacaatttatccaaaacatcttacaaaatctaacaatttctagagagtaacctggaaaaagaatgataatgcatgaattacctaagcttttgtcctttttcctctctttctgtcttggtttttagtagtgagatatatatatacttctatcacagctacttgatgacttttggatataggttaacttctatgaagtctcggtcacagagaaaatatttttattgagcatctactagagccctgtaataagtatttttacatgttatgtcatttcatcctcaatcaagttggtattattatgtttctttagggatgaggacataaacacttttttgcagtgataagctgtaaacactcagatctgaaccagccactggtggggtcacacacacacacaaaaactgtttcaatggaaattacttaaagtattctttaatccttgtcactatgataaggaaagaaattaaactgtctttggtgtgacttgccagactttggtcatgtctaaatgttgcctgcatggcgctaccagctcagttattatattggatatctgaatggataaattggccacatatctattctaattgataccacagcaactggctattaatatgaccaaaaagccccaaatcgaccacaaaatggtcattttcaggcgatgcctggacttcttatatgaagaagatgctgaacatctcttttctgcgttctgagaagactgaacaaaagttgatagcctcaaattaaactatataaaatactaattaactatcaggaagagtagagacagtgttctcaatgtgttgtccttgtaatacctgcattacaatcacctgggtagcttgttaaacatgctgctctctgatcctcattccagactccctgtattaggctttctgtggggagggtggtggcagaaatctgcatatgcaacaggcactcagttatgtctacgaatttaagaaacactgctgtagaatctgtcctcttacagagctttaagaaacacattcaacaagtgtatgtgtgcttgttctttgtagggttctatagtagaaatagaacacatggtctctacatactggaccctctagaacttgagttctgtgaagacaggaaatgggtttggagtttttcactattgtatgtgcagcatctaaacatagtgcctgtcacatagtattttgtaaatagctatagaatggatcagtggaagaccttacatagaaaattgacttcatgtgaatgtacagtagagaactacagcaattcaaagaagaaaaaaaatgaaggaaactacctgcccaagatgtgcctatctgaagaagggagactacaaacatatattaagagtcctctccccttttgcctcttggtgctaaggaaagaaaagcatctaacaagggtaagtgatctttagaaagatgaagaatccactgagattccccaggatatgaaattccactgttattaagatccttatagtcttaggctgtttttataattttaaaatttcttgttggcggtatcagttttgagtgctggtactactgatggtgttaattaagtttccttcttttaagtaaaacttaaggtgcttggtatcttgccatatgccctaaaaggcaatcctgaataggtatcactaaagaggaatgacaaagttggcttcagacaaaaggatcaaatggatttctaattgtccctccctaactttcatacctgactagactgaacagtgccaagtatgaggaaaatgatatatgtgtaataaaggtagactttccggagaaagtttatttttgaggtaactggagctgaagcagagggaaattgagaattgactagatataacacaaagaggaaagggggcagggaagaggtaatatttctgaccctcctgccagtaatatcaagcagcaaatgatcaagtaaaggttggcaggctagcctccgccttggaggttgccttgttgtaactctaatacctttgacatatcctgtctctcaaatcaatgaatgactgcattaggcccttctagttcagcttggactagttccagaaacctaggggtttccatcctgctgccctatgatttttactttaaattcctcggagacttgaattaagtttttcttcctgttatgataatgctgtttcttttttgtttttttcccagaaaggaaactagttcaccagttagtttttcccctgagttcttttagagtctataagaaatactgagattccgggacaaagagaccatctttaaaacttcaccagaagaggcaagaagctgtcagtgaaatgaaagagagggttaaatgaagggaaaagaatacccagactccattcatagccataataatccttaagaactttccttccttttcatgtcatcacagaaatgtaaaatctttaaataaaaatatagaccttaagaattatgaaatgtcagtatacttaagtcagtagcattcaaacttctttatcctgtggaattactcctagttgaaggaattctgtaatttttcccattccatccttcattttcccacttaatcagagagatatggttagacattcacgctgcttggactgggatgaagctttctggaatatattggattatccatcctatccttacagattatcatactccaaattattatgtatatgtacctgtgttgctttctagactttctacttttccatgatctgtttattgaggcatcaataccaacttgttgtatttacttaagctttataacacattgtgacacctggtagggcaagtcctcattcattagtcagtagagttttatatttttctgcacattttctgttatttaatgctaaaattattttacttggttttgtaagcatgattttttcctgttatattttctgtcccattattttttcccattatattttgtcattatattttcagcacattttttgtattatttaatgctaacttcttttttgtttgcttttgtaagcattattttttcccattacattttctgtctccctccataaccctgttgccatcattctttctagatctggccactctttttccttgtcaaaagccacaaacatctattttaaccagttgccttcatttccatattacacacctgtttcctaagttttactcatgtttgtttttaattacatgctattataagtaattaaaagtacattcaagactgggcacagtggctcatgcctgtaatcccagcacttagggaggctgaggcagaaggatcacttcagctcaggagtttgagaccagcctgggcaatatagcaagatcctgtctctacaaaaaattttaaaaagctagcagggtatggtggagcacacttgtagtcctagctactcaggaggctggggcaggatgttcacttgagcccaggagtatcatgttgtagtggactatgatctcatcactgaactctagtctgggtgacagagtgagaccctgtctctacaaaaataaataaaaaacaaaataataaagatttaatgcatattgaattgaattgaaaaatacaattcatattgtaaaactttctgctatgaataaaacaataatataccttgagctgccaattgtagttccttcgtgagacggtaacccctaatatctctttaataaatacttttctgtactttttaatacatttacattaataaatgcatgtagatacataactaatttgtgggtatattttaacctgaatggtataacattgtttatatttttctagaactgggaaatagctccaagacatattgttaagtccatataaaattaacttgttcttttagactgttatgtaacataccatcatagtctggatatgtcctatagtttagccctttacaaatggatatttagattgttcctaaaccttttttctattgtaaacaatgcctctttgtgcatatgtaccagcatttctctagaatacttcttagaaatggaatgactgagttgaggctatatgtattttaagttttgataggtactgataaaatattgtaccaatttatataaccacaatcagagtaagagtatacttgtttctagatacccttcactgatgtgtcaatatggaagagtgtaaaaaagtctcttttaaatttttatttccccgataactagtgaatcgagcatctttttcccttgctatttaaaaaactatcaatatgagtttgaacagatttcagaatggctcatagtaaaaggtataatattcagaggccagagttacaccatgtacttactctgtcggcatggaacaaatgatgcaatcaaaggacttgaactgacttcaagagtacaatcagccaacccttctgcaatcaggagactgcctggattgttcctaaatccttataggcagatgaaaaattgctgttcaaatcctctaaaaaggaaatggcatatatgccatcataagctattctaatttttgaattattctctctcccaaatgaaattctcccttctagccaaacttgatttctctgtatattacttacttcttttctattctttaaagaatgggagaagacctggtcaccataccctatcttaaagcttttcaagtacttgaagattattactaagtctcttctgaactctcttttctcggaatgaatgggggcctcaacctgtcctcaataatgtttttgaccatgattttaaattatgttgctttctacattccaaatcctctgagtccttaatacaaaaaaagagtaaagaaggaaaaaaaaatctcccaatttagcaaaaaacactcttgatattttggcatctttccgttaattctgtacactacgcaccttgtggagatattaaatacacattttagcatacttttagacttcctctgcctttaaaaactttctaatgtaaattaaaaattattcacaaatatttgtaatagttatataatattccaaatgcaccctaatttacctaaccattctgattctgttgcacacttaagatgtacctgactccttcctactttgaataattgctgtgaataaccaaattgccaaacttctatctagaaaaactagatggattactacagtattctgtttgtatatctcattcatgtaacgcataggattcagcacacagtaggggcttaatatattcttgttgtcttacatagagcctgagtcaagttttctccagagctgaaatgattcgtcttatcttatggaaataattattatacatgattaaggccacaaccaaacaatgtacaaaatatcaccactgtgtcactgaagaatacaggagttacttagaagaagggagtggattatatcttgtcattccatttaacaaggagttacttagcggcccaaagagataggaaaagaataaaacagaattataggcaccttcaccgtcagagactgggttcaatccatgtaatagagaaatctagacacaagttgagtatcccttattcgaaatgcttgagactagaagtgttttggattttgtacgttttcagattttgaaatatttgcataaacataatgagatatcttgaaaatgggacccaatgcagggtgcggtggctcatgcctgtaatccaagcacttgtgcaggaggcgggcggatcacatgaggtcaggagtttgagaccagcctggccaacatggtgaaaccctgtctctactaaaaatacaaaaaattagccgggcatggtggtgggcacctctagtcccagttactcgggaggccgaggcacaagaatcgcttgaacctaggaggcggaggttgcagtgagctgagatcacgccactgcattccagcctgggtgacacagcaagactctgtctcaaaatgaaaacaaaacaaaacaaaactgggacccaagtctaaatatgaaattcatttatgtttcatacacaccttatacacatagtctgaaagtacttttatataatattttaaataattttctgcatgaaacacagttttaactgcattttgactgtgacccatcacatgaagtcaggtgtggaatttttcacttatggtgttatgttagtgcgcaaaaagtttgagattttggagcagttctgatttcagattatggatgctcaacttgtaatgttgaaaaagatttcataaatcccctctcatgtagggaaagctggtggtgaatgtttttagcatttagcaaaaactggagatatttccaattttaaagtatttggccctgatactaaaaatggagaaatgctttgtgcaagctagcttacaactgagcatagtctgaataaacaaaagatccagacaggtgaggatgcgcttgagtttatttgtgttgtaatttggactacttaaaacatacctcttatttaattttgtcctactaagttttgggttatgtatggcagattggcactatttccattttttaaacaaataagttattatcaattaagtaactagctacatgtctcagaaattatttttaggttacttttcattacactgctagcatcagaacaagaaggccactttccagataattacaactccctttcctcccaaatccagttaaactagaaatattagattgaactttgtgaaaatatcacattcataggtcgaatatcagcaatttcatacagttcaatctaatattaggggtgggaaaagagggagagacgcatagcctgaccatttcctccagtctagtgtcaaccgccagcttcatttgcaaaacgctcacaaggtcaagtcttgacaagacatgcaagacttttgttgaatgatgctctcacaatgatgtgtctttcttttaagtgaaagaaatacccaagctagaaatcaaaacagagtagcaaactgtgtgcgcgattcagttttcaagaatattttaagttgcatatgttttcttttcattgacaatccttacccttgccatatcaggatgactgacactcttaatttgcaatttcctaaatttcaagagggttttttctttttgattgctatataatggtttacctaattatttttttttcaagttacagtttcggatgtttaatttcaaaatcaatttgagatgtcttgagctccattaatacactgtgatattgcttcactcattttctagcaaagcacttactttaaaaaatgcatcattctaatgattttaaattactctacagtgcacataccaatttacaactattacaaaattttacattttttcccaaagcacttcacatttaaagatgttctgtatttcaagacagaatgagagagagttaacttttaaagggcatgaacacaatttagggcctttaaaattttctgccctctctgatgtagaatgtaacctaagtaaataaaattttaagtgttcagtgtgcatataacatcagcttaggatgaggacattattataaaataattttctttttattcaaactaaggacaatattctttataaatggaaacaaacccattgtgtgtatgtgtgtaagagcaacaatctgttagtgtgtcaatttatgtgtaaatatgcatgggtgtatatgagtgggtaagcatgggcttgaatgtgtgcatgaacgtgcaacagtgtgtgtatatgtgtgattgtgtgagtgtgcatatatgtgtgagtgtgcaagagtctgagtatatgtgaatgtgagagtgtataagggttgtttgggtgcatgtacatgagtgtgtgcatgagtgtgtttgggtgtatgtgtgttcgtgtattcgcttgactttgtgatagtgtgtttgactgtatgaatatgcaagtgtgaatctttctgtttcaaatacatgcttggagatcaaatgttatttgtacttttatttaggcagtcattagagtgtgctctaagaattactttactaacctcagaataaaatgagggaaatgaagcacctcccaactgtatctataatacatctataagatatttgcattaaacacacacacacacaatttataccttgcttgaaatttgcagggaaaaaatagctatattcaaaatctgcatctggtaatatcagtttaatagatgtaaatcagctgccaaagttgggaaaccttccttcctcattgccctttaaaaacatttttgattactttattctctcagaattcttcattcacagtgacacatgccactgtcaaagcgattgaggatactttgggattaatatttaaaagactataattatcatctgttttcgccccagaccacccttgaagttgcagagagcactaggcacatttctggaatgagcctgatgctcattcattgatataacattttccttttgttggttaaaacatgctgctctagaaggtagaggcaaagccctgggggccaaagctaccatgtaataagtgccaggctcagggctagaatctttgcatacattatctcatttaatcttcactacaaccttgcaagatagtgttagtaccagttttcagaggaggtgctgtggctcagagaagttaaatgacttgcttaaggtcatgtagctaattaggagagaggctggtatcaattttgagtttgtctcactctaacactgtattctttgaattacgccatgctgaaaggtatgaccttcctagtatttatatcttccctcactgggaatggggtttctttgcctgcctgctactctctgcccctcaattgtcttctctaacaatccctaaaaacttggttgatgtcaagttcaaatctactttagaggcaatatatccaatttatgaatcatacttccgatgttaagattcactatgtacttattttagagtatactggcttggttaaaaactcactactgtctgtgtaatagacactatttgctcaataactattatgtgccagaggttttacacatattacacccattttacagatatggacaatgaagcttcaagaggttaggtaatttggttaatgatacagaagcagaaccaataaagtctacatccctgctgacagtcctgtataagcttctttggttagatctgggtaggtcaataaatctaatggagcctcagtttcttcatttataaaatggggataatggtactctcactgcaggagttataaggatgagaaaatatacataaaatgtctagaacatattagatagttaatacatgatagctattatctgagccattattgttaatgatgagtatgggttttagcattaaataaacttggcttcaaaagctttgcctcctactggctatttgattgaaatctgctgaatttctctaagttttcatttcctcatctacaaaatgaaggtagcattttacagcaccttttcctaaagtatactccaaagaacactgctatctgcacactatatttaaaaatgtgaggtgataactgggtttcctgatcaaagatccatgggaaactctggtaaacagatttccttatacagggctttttttagtatctctaatacgggaatgtgctttgtgaatttccaagtgggagctaacatatgcagtgtttttccctttcattatactataaaaatgcatttttatttttctataatatcttgcaataaaaggattatatagaagatactttggaaagactgatttgtcccaaagattaaatggataatatttgtaaagcacatatatagtaagagctcaataaatgcaacagtattattattataattaccataatcatcactataatcattaagaagggattagaaagaataagtttaagaggtctactatgcatcatggtgacgacacttaataacaatatattatataattgaaaattgctaagagtaaattttaagtgttcgcatgaaaaaacaaaataagtgtgtgattgtattagtccattctcacactgctatacttgagattgggtaattcataaacaaaagaggttgaattagctcacggttctgcaagctgtacaggaagaatagtggcttctgcttctggggaggcctcgggaaacttacaatcatggcagaaggcaaagggggaggaaggtgtctcacatggtggaagcaggagcaagagagagggaggggagaaaggctgcacacttttaaacaagcagatctcatgagaactcactatcacaagagcagcatcaaggggatcatgctaaaccattcatgagaaatccaaccccatgattagagaagctccatcaaccaggccccacttcaaacactggggactgcaattctacatgagatttggtggggacgcagatccaacccatatcagtgagggaatacctatgttcaacagcttgatttaaccattccacaatgtatatatatgtcaaaatatcatgttgtataccataaatatatacaattttttacttgtcaattaaaaaataaaatttaaaaagcctaccagagtgtcggtgatctgagtgagaaaaggcatgtctaatacacccctaggagtaggggtctacaaactctatagccagaggatttcctttgccagattagggcgagctactccaacggaggtagaagcttcagcagacaacctaccacataattccattgaatgtatgtatttattaaaatagaatttttagagccaccaaaaggttctttgataactaagattttttttgaaactcctcaggttggaattccacaggcaagcactcttattgtattgcactttctgattggttttaatgttctcatacgatcttgtttttagcacaggtatcttcccgtgtatgagttttgtctctttccctctccacttatctaagaaacaacagccaccataaaacttgacagatgtcaggtggactgctgctgaatgcctgactcatacaactggatgatcttccttttggtcctgattcagtttcccagcaatctagaaatgatttgcctttgttcttgtatatctcctgccaaggtgcacatagtttgcttagatatatggtccttttaaaatcatctttaaacttttatctattacctgctccttatggtagagttaatcattccttgggagctgaatttcagaatggtggtggatcctattgctttctaccagaagtcttaagggactgtgtgagttgctttcccatgaagcagtgttttagagggagatgcaataacccaaaaggaaaattcctcacacaaataaaaatgtatttatacaccaatcctgctgatactgaatagtaggatgtgggataaatctgtaagaaagtttgtctgtatctagcctggtggcaaacattatagattttacttgctgcataggactattgactaggattagattctcctctctaactacccatcgttaagatggatattctgaaaaaggtagacattaatcatttcttcactattttgatccttggtatagctgttccagagctatgtttgcatttacattttgatttactatgtaaggaggctgagaggtggtgatggattgagaggctttcacacactatgggcattccattgactcccaaggaccatttcaaccctgccctcatgtgccttaagtgaggggcagctcccattatggatgaattgctgctaattaaaatggatatatacactctgtcctactgtcatagtatgtggtttgataagaatgatgggcagagaaaaacaaacaaaaaaattctggccaagttaatgtggtgactagcaaaaataaatttagaaaaggccatttggattttatcagagtcaagtctatatatgaaaagcttattgctaagtaaaacctcagatttaatatgacctcgtgggaaaatgtgaatttggccgttgcatcccctaaaaaggccaggctccgtggcagttacacaaggtatggatttggagaatgaggtcatggcagctcagatgccaactgacagcttggtgatcccgagccacctctgtccatgtcccttatacagcacacatgattttttaaacacacaagctaaataaagcatcagaggaagacttcatggtgggagaactattcaaagactattctaaatgataaactctaatccttaccagtttgtttatagttattatctccataggtcttctggctggctggacccagagtgtgtctaactcattttatgacattaaaattctgctctctccaagttacaaacctattactttattagacattttatctaaagcatatgctggcttccttcttgagaaaccgaaagcctgagtttccccagcctatattctatataagaaacaggttatcgttaggtatttaattattccactgtcatttcatatttgtattctttatcatcttgtgtagagctctgagtattaacaacttgatgttcctcttgtcttaggaaatataaatatatttattcctttatatttcctggatacgattttattgtcataaactagaagtagatttaaaatggttacccttgctgtcttattattgccaaaaaggattgttagtcagttacattaagactcaaataatcatttttggtagaccttctccatctttaatccactttgtcaataatttcatactgcaagttaacttgtttagttaccttggcgttggaatagaatcagtttaatttggaatatatatgtagttacattttccaggctaaacttgatactgccatatgctaaagcactgctgcccaagagaaatataatgtgagccttaagtgcaagccacatatattatttaaagttttctagtagccacattaaaaagtaaaacaaaattatttagtaaaaattattaaaattaatttaaataatatattttatttagcccaatatatccaaaatatcatttcataatgtaatcaatataaaaattaataaggagatattttaattaatcttccatacaagtcttgaagaggagctaaaggagaagtgtctcattggtttcaatgaaaagaaaagttttattttaattgagctatgagtttgtctatcttgaggacactgtgaattacataattgatcatttttccctcttgtgttggctaagagggagttagaaagctacagtacaattagacattacttagctatgcacatgacttccttaaataaagattacatttctcacttcctttacagctaggtgttttcacatgactaagttatcgatcaataaaatgtaagtgaatgtttctggcagtagcttcagtgaggtcttcttaaaagaaagtagagaagtccctttgcctcgtcatttcttcatttcgcctatagtgaggatgtaatagctagagcactggctcccaccgtgtactataagggtaagggctccatcctagaaatagtacagtggtgagctggaagaagctttctttctgaagtcaccatacaagccctggactgcctgcctctagatttcttttgcctaaaataaaataatacttctatcttgtttatctctttttttccccttggggaggtacttccaatcactgaactataatcttagttgacacatcaggaatgtaaattttccttgaatgtgattttataataaacagcatggctcaaagtaaaggtagtgaagaggcagaatagctacttgttaactgactttccagtaaaacatatatctgtattctgcaaacacaggaaacaataccatttggatagtgacaaaagaacataaagactttggagtagaaagaattttcatacttcttcaaattaattcagctttacagtgtttaaagatgaatttccttgagatttatcatctactaatttatcttctacttacaaaagatttgtctttgaaatgtgtctttacattgagaattgacatacaatgccaacaatagctacaatctatcattataatttagtgcccactatgggaaaagcatcatgctatgtgttgcacatatgttatctcatttaacccctacaactatattacaaaatattaattatttccctattttacaggagaggctcagagaatccaagcaacttactcaaggtaatacaataacttggaaacaggcctgggatttgagttcatttctgtctgaatttttccatgctgaatctctgacaacttttataacattctgatagtcaagaaaaaggtcccaggatccttccccatatatgctcattgccaactttctagagattcagtggaactgttgacaatgggtagaatctgttaaatttatagaaggctctctgaatggtatattggataaaagatctaaaccagaaatcacagtacctgtttttcatactaactacgtgcctaatgagctatatgactgtccataagtcatttgacctttctggaactcagtttcctcatctataaaaggaaagggcagaactaggtggcatctaaaatctcatctattgtcaatattctatgattatgacaagtctgtcaaaaaaagaaatgaacaaaaagaagactgttggaaaagaaagtaggcaatcatatttagagtgccttaactttcattgcttgatatgcagaattcaatttaaaaaatgaatgaaccttcaatatctttcttggtaaaaaagaaaaaaactgaatgaacctagcagagaagtgtgggaagcttgttttgattgttgaaactacttattcttgactccactattaacctcactgactttaactgctatggttcctgaaatgtcttttgagcaatatttcttagaacattctttgctagcatggaataagctcttctagttttgtggaactggatctaatattgttacccataccttagtagactacattcttaattttactggaacttaagttgttttatccacttagaggaaaaatgctaatcactaaaaatgaattgaaatgtgaatttaggttacaaatagtttgcagatgtgtaaattgagacccatagtggttcacgtgcccaagattatatggaaagtcagagctgtgccaggacatgggtcatctgctgatttgagtgacccagagatttcatgagggtccagagtgagcaaaagtttttagctaccttgggcctgtgcaagattagggatatatattgggatatatatccaatctggaagaaaatgcgtgttgcagagacatagtagaagaaaatgatctgtcttagtcttgggtctatgaggatgttaaatatcaagcctcctctgagacctcatggccactagccaggtttcatgtgggtttagggttcgtatttgtactctttatttggcctaaagaattgcaacatgatattttaaagtttacgctgatttgtagcgtaggcaggtttctgacagaaacaaatgtaaatcctcaccagaagaatactttcttcatacaggacttagagagatttccaacctgtttgagctcacaatttaagaaagccaaaaacaagaatgcaattaatatccaagagttcaaagaagtaacaaaccatagacccacatccacaaagacttcatatgctgtatttatcagatactgtatataaaataaccatgtttcatgtaaccaaaaacacaattaagatgcaaaaaattacccaaaataatgaggcatattttttttaaaaaactaagtaaatattttagaaacaaaaagtaatcattgaaatgaaaaattaataaaagggttaaacattacaataagcatagctaaagagagatttagtgagctagaagataaatacggagaaattgcttataagataacaaagggaaacaaagatagtaagtaagaaaaaggagtaaaggacatggaggctagaatggaatggacagtctaagggaacttccaaaaggataccaaaagggggaaaatcaagattcaaagaaataaggactgaaatttttctataatttatgtgagacatgggttcttatattcaagaagctcagcaagtccgaagtaggataaaaataatgaatctggctggatgcagtggctcgtgcctgtaatcccagcactttgggaggctgaggcagccggatcacaaggtcaggagttcgagaccagtctggccaacatagtgaaaccccatctctactaaaaatacaaaaaaattagccaggtgtggtggcatgtgcctgtaatcccagctacttgggaggctgaggcaggagaatcacgggcgaaggttgcagtgagctgagatcaagccattgcactccagcctgggcgacagtatgagactctgtctcaaaaaaaaaaaaaaaaaaaaatccatacagttttttttttttttttgacagtcttgctctgtcacccaggctggagtacagtggcgcaatctcggctcactgcaacctctgcctcccgggttcaagcaattctcctgcctcagcttcccgagtagctgggattataggagcatgccgccacactcagctaatttttgtattttcagtagagacagggtttcaccatgttggtcaggctggtctcaaactcctgacctcatgatctgcccgccttggcctcccaaagtgctagggttacaggcatgagccaccacgcccggcccatactgatctttaagaaaggatattggggtgtgaattctaccagtggcctcaactctgaagcatacacaataaagtaacttgccctgcctctcaaagtaaaggagttcattcaactctaatatgaagaaactattacttaccctactcataccgtgtgggtgttatgagactaatagaaacatttttgctaggatactggaaatttggtagctggggtacaagtcaagttctttatagcagactcaactacccattcagagtctctatgagcctgaccttaacaagtttctaagtgaaaatttattgtcctcactctttactgaagaactaatttatgtccttcccatccctcttctccttctctctaatgattcagggaaatatatatgtaaatcaaatctctggaacagtcctgtaggtattttgtatcatcaaagctcaatatgcaatccaaactctaataatgaccctggatcatggccataatgatgaaataaaaaaaaacactggtatgtatttggagaaaaaaaataaaacaatcagataaatgcaggatatttttattacaggaatagtatcattcagcttatttggggtaagcatatggggtactcttctatatctccaatcacctgattttggaacacaggattgggataatttattctgatccttccccatggccactaatttttacacaattgaattatggcttccttcaacctctctcagccatctccaccacagagcctttctactttatcctcccctgtcagagaatttccatggcagcagggcaagctgtagtggtagacactttctccataggatctctcatatacagggacagacacaccttgtaaatacttccttttgggatctattgtcacttcatatagctaaaaatgaattgagaaaaatgacaaatagccagtgaatctagaattcagaataagagttgaaggaaggggaataatgaaacacaagatttacctgttttcttttgacatttccattggtctgtccaaatggattcttactgtactgtactttatgtaaataaacatgcactcaggtttacttacattttcttgcttcacaattgccatcttatttaaatatatgtctctggtttgaaaaatagttttaaagctttaatggtttggaacagttagtagagttagctcagacttatagagaggcagccgcaaacttaccttttacttcaaacttgtcaaattgtcaaaagtttcactatatattgcattgttgcctgctaataatggtataacgtgtggttttattgtctcagaacaaaaatgtaaaagatgtctttgaaaacatttgatatttgatgtgctttaaattgccttacaatcttaaattactatatatatatataattataaaatcttatggccattaaatgaacttttgtataaagataaagaatttttggatctgagactattttgtggttcaatttctactttcatttgggccaaaaaaggcctggggtgacaaatcatctctgagtcggatgtatggctatgataccactataatagtgtgattttttttccatttcatatctacctcccaaagatattcctgtagattcagtcttacacacttaatttgacttggaattgtcttaaggatgcttttgaattgtatttctagtgccaccaatgaatttcatttacttcaataatctagagttaatgttttaatctcactgtaatgttaatgaaatagctaccatgttttatgcagatgcttgttttatttaaccaatcaaatcagagtcaccttaatgtttatcttttatttttttactgagtagaaaaagaattatttaaaaataaatgtgagcacaggttgtcatactttgaatatcaagatgaaaataatgaagcctgcatatgaattaggcataagctttttgtcttttatccactaaaaagcactataaatcctcctatcatatttctgtgactacctatatttcaacttttttattgccccatatgatctgcagaaatgaactttaagtccagggaatttgtagcattatgataatattaacattattgctaactaatagaaactttttttttctgagaactcagttactatttctaagaaacccaggtgtgtgtccaaagctgcagagaagaatgtacctgcaatcgtaggttcctaatatggtgacattaactgtctctttgtctactgaagatgctaaattctaaatatcttatatgtgagtgggcttttcccttcagtggcatgatgaatagctgcgtagttatcctcatggtgtttgcattacattttgaacaaagattctttaacagatggcatgtatgagcctgctgtaactgttatgtgtaaaggaaaaaaaaacactgtgtacacatgaatcatttcataagacctaataaattcctagaaattgcagtaaagtgatgcattacatgtgctagacacgcagagtcatgtgaaaaatcttttgattactggcactttcaataaacgggagaactaataatgtttttaaagcatatggtacttgtataatcaaggaaagtttcctcagcaacaacaattatataaacctcttacaacctcctcctctaattatctgttttattagtagatgcatatcgtcatccattagggaacacttcaaaacgtaatgagacattgttataatgaagatatacacacatacacatgtttatgtgtgtatgtatgtgtatctccatacataaagggaaatcatcaaataacatagtctatatatcaaaatgtggatgtccttataatgaaaacaaagctatttacaattaataaactcaagagagtttatgaactaaatctatggaccattcataatcagtgtcaatagttcaatatacagtattaagaatcatagatctcagtgttggaaaagacctcatgggccattttgctaatcttccactatttcacaaatgaggtggctaagactaaaagaaattaagttattcatggtcactgtgtgtgaatacatgcacacccacacatatactgatatctttctgatggacaaggtggacacatgtcataggatagtgtaaaaagaaatatccttataacaaagccttctgacatgttaaggaactaacgttccttagaaggggcacatcatgataataccttatatgatttctgctgaatagcaaatagtatgttgaaaagaacctccaggcctaatgcttcacatctctccagctgattaacccacttctaagatacagcataatcagagaggattgtagcagagaaaggacaagagttggcctctctattaaatgcctaccacttataaattttgctgtcagttatttgcaagtaatgatagagggagtggttcaaaggaggtttcatcaagaagagagtagtacaaagttctaaactgcttttatgctctctttcaaagactatgtgaccaggacaagtcagattttacaaaaggaatatagcagatacattgtgcaatgctgatctcagaggctagggccaatacccttagaataggctaaatgtattactgagatttcatgataaggagttatgttttaagggagcatgatttgacctgtagtatatccaaatctaaagtatattataacaagctgctattgtattcctcttcaggtatttttaaagaatgagttaacctttgtgaagtgtcgtgaggccatcaggttaaagaagcctatatcaaatatcattttagagctgttaacaatactcaatgtacctagaaatacagactgaaaataatcagtaaaccattcactatagtccccctggtatcagagcagcacagttaacatgctaacagctaagcttcatgtgcttagtggaagaaaatgatcaatggcaaagagcatatccaccttggaaatgacatgatccattataagaatcagatgttaaattgcttcctgtactgagcacactcaattaaaagtctgcacagtgagatcatctcgatggttaaatatgctctgtgggaacaacctttatggagcttaaaaatcacagaaggactattcctaccatgacactggagatttggaaggcatttccttcccttatttttcaatctgctagttttattaggaagccttttgcctgagaggctgctgagttttgggtcatacctatccacccttttgcttctgtgaacaagagatgattctagtgatcttttttctttgtgatccagaatggatgaatgtggctttggtccagacctctgtacaaaaatgtgtcatttatgtacttggtatttgatgtcctttatctccttttcagcaaactaatctattcacctgagttctgtctccttgtctaacttttccttcttcctttggcaggagtagggcctgagggctgaaaagaatgctagacattacataaaatcagcagacctggtttcttctggcaggtttgcaattagccgggtctatgaccttggaccaattatttaacctttctggttctcagtttcttcatgtttcaaaaactcatatatttcttgttcattttttaccatctgtctctccctgacagactgcaagctccattagtgcaggaatctttgttttcttcactgatatatcccaaaagtgtagcagatggcacaaagaagatattcaatgaaaatttgtttaatagatgaatatttcacatctccgttagtagtgttaccattcatatagtctcccaatatagaaatcatggagtcagtgaaattcctgtctccccttatacccacatagtcaccaagtgctattttcttttttcttttcttttctttctttctttttttttttttgtgacggagtttcgctcttgttgcccaggctggagcgcagtggcacgatctcagctcactgcaacctccgcctcccgggttcaagtgattctcctgcttcagcctcccgagtagatgggactatgggcgcacgccaccatgcctggctaatttttgtatttttagtagagatggggtttcaccatgttggccaggctggtctcgatttcttgacctcgtgatgcacctgccttggcctctcaaagtgctgggattacaggtgtgagccaccgcgcctggccccaagtgctattttctaacccctctcatgtctgtcctttcctttccatctacacttaaattcccttatatcaagtttgcgtcatttttttgactatattctacaaaccatttaccgaatggtaatggtaatggtaatctccaagtcatttaccgaacgactttgctaaaatgcaagcatggtcatgacactaccctctttaaacaccttaaatggctttcctattgtcctcagggtcaagtccaagctcctaggcatggcatacagagaccttcatgatctgtggtcttttgtgatcacttcctcaaccatcagtaaatattaaagactctttgcacattgtatctctctctctatcttttagcatttagtgcaaggtattttcacctttattcacatttgcctccccaactatagatgtttcatccttctttgtatactattgcctcacatgctgtcggagacataataggggctcaggctcaagaaatgttaggcaaataaacaagtaaatgaggaggttttgactagtgcagtagttctcacactgtgaggcaaactgcttaacttctctgtgcctcagtgcattaaaatccatagggatgctgagatggatggaagaggaacatttaatgaatattgaatcagatacctacacttttttccagatctaatattctatagggctatcatttttttccctcatcatttcatttgttttggtgggtaagggttgtttggggtgagaaaggagtggggtagggtttagggtacttcatctggaagagagagaaggagggggcaacatacaggcatgttcataattacccttttcctcccattctgtgattttcttcttggccaacaggactagtgcatgtctttgtgtgttagggagtaggaatgggcagggaaagagaaactctcagtacattgaatttaatgttaactcaatggaaatacaaatatttgaatttatgcaactggagagtagtacattaccaggaattttatctaattctgaggcatcaggaagggcacataaaggatgtgagtgatctgagggagcaattatatgattcagaatcactgtttgatcaatatgtatttattaaatcatatataaagaggcaagcttttgactcactgtaaagcaccctaccatagtaaagacattaatgttggtgttctctagggttctgattttcttcattctcattttccacactctccctggacagtagcttgcattcctgtggtcccaaactatgttccaaatatttgtctgtagctcaggattcttctctaatttcattattgactatcaacccctcgctggccatatgcaagcgggatcttctgcagatgcctacaacacagcatgtccacaactgagctcaccatagctggcccctctgccccaaacctacttttcggcctatgtcttttctctctcagttggcggcacttacttttgcctagtcatccaaagcagttaccctgtctcttttctctacatctaccgtggtcattcctctctagtctgtttccacctcaccattctcacaactacagcttcaattcaggcccttctcaccatcatgctccttgactactccaataatcacattgcacatgtctcttagttccttatatcattcagctacaattggtcttctcaatagtctatctcaaaggtggtttgttttaaatcactcaatgctttcctattgcaacaagaagaaatgcaaattcctcagcatagtgtgtaaataaaactccctattttctggcccctgctcatctcaccagttttatctccttctgcactcctaggctatagctatacccaatggcttgcaagtccccaaatgtgtcatttagattcatagctctatttctttgtttaaactgctccttctgcctgaaatgttcgttcctctcttgtccatgtgataaacatgcaatcatcattctggtgttaattcaaatgttaagacttctacaaaaccttacctgactgtaaggcttcttctcacaaaaatagtctactgctccctcctttgtgctctgtgacacagggccctggacatggtccaacaatgatacatttttatatgtggtgagttagataataaattttagaggacagtgcagtatagtggtgaaatgtatgaactgtgaagccagaagctatatgattatatgattgtctctgggcaagttatttcacctctcagtgccttggtttcctcatctgtaaagtaagcatgattatcatacttacagagttgttatcagtgagttaatatatgtacaatgcttacaatagtgactaatacataataattattatgtgtttgctacaataataataacattaatattatcatttttaacttaaagctctaagccatgatagtgtatctgaaacatggaaggatggaaagtattcagtaacatttagtaagtaaattaataatcaagttaggtccctattgtacagtctcataatacccagaaactttccctttgtaacctttttctaacttgttcaatgtctctctgactaaactgtaggatccatttgtgcaaggaccacatccaccgtgttcactactataaccctagcatcaagtaccatgccaagcacttagcaggcacatgtatatttgttagacataaaggttatagaggttatatatacatataacctctatatgtatatagagatatacatatctatatcctatacctaaggatatagatatatatggtttttaagattttcattttcgttattattagattacctttagcattttgatcattttctgaaattgtaaaatgtattcctctttcctgtattacgtctatgtgaggcaacaaaatttcagtgaagtattgttagaattgcagtgaattattacgctaaaattaagccttttaacagagaaattctcctctttccttacggtgtaggatcacagacttttcagctcatgagctaatccagtggtacaaaaagtcccacagtgcttcaatctttcctgcttaccacgtcattttacatctttaacaaaattcataggcagaggctttctaagagttaccacttattaattatacttatttaatgagtacatggtttgaagaaaaatggtataaagaatgacttgttatttttagaacttataattcaggcaaaaagacaagccatgtgcacacatatctacatcacaatgttttctgtgctctttagcaatgtgcatggtaagatttcaggggatcctggccggtgcagtggctcatgcctttaatcctgccactttgggaggccaaggcaggcggatcacgaggtcaggagatcgagaccatcctggctaacacggtgaaaccccatctctactaaaaatacaaaaaaattagccggtcgtggtgtcacgcgcctgtagtcccagctactcgggaggctgaggcaggagaatcacttgaacctgggaggcggaggttgcagtgagccgagattgcgccactgcactccagcctgggcgacagagcgagaatccatctccaaaaaaaaaaaaaaaaaatcaggggatccctgttgatgtgatcaggaaacattttatggaatggctaaaattatagttagtcttgatggacgggttggatttcactaggtggaagtacaatagcatctcatgaagaggaaaaggcatggagaaaagcataaaaatatggttcattaagggtaaggagagcacatagattactttggcaaaggaacgatttatgcaggaagcaaaaatagaagataggctggagaaagatttttggaatagtttgtggtaggcttttgatcatagactaggacacttgaagtttatctacagataatgggaaactatagaagatgctagagtagggaatgaaaaaaggaaagcaatgttgtaggaatagcaattgagtggcaatatagcaatatgtaaaatgggatagagttcctgggctaagttgtgcttttaagtgatgggacacccagtagaaatatttcgcagatggttggaaatgccagattatttgagtttgggagagatataatttgaaatcatctgcatagaactgacagtaggagacttgggaatgtattaaataactgtaggagaatacaaaatgaagacagaaattcaagcacagacctacaaggaaaaacaagatgaaaaaaataggtaacagcgtattataaataaaaatgcagtaaaatactaacctaggacatacctggaaacctcttaggactcacaaaggtgtacagatcatattttaagaaacactgccttaaggaaggaacagttagaatttaagagtagaggaaggagaaggaaattaactccactacacctgttgagcagtcagatcctgtccacttgggatcacagctgcatactccagcgtccagaagaaaagttccgtgtcctgagcactgctcttgacatacaggaagtggtgtttcacagttaactcctccccagccagtagaacagtgacattctccttttacacagatgccatggttggaacacattgggtctaggcagtcctctgaaggcacaaaaaagtgggggggaggggtgattaatagtgaacaggtatggccaacataccttagtatgatgaaacggagattacattgatttcctagtttatatcatcaatgctgctttaattaggcaataaaatgactcatgcaaacactctgtccaaaccatattattaacacttcaaaacatggtggggtatcacaatggttgcaatctcaattgagaaggaaaaggaaaccacacatgtgctgtgtgaaactgtgaacagtgtgcagtacccccacacaaataagtgggtggagtactgtgggccttcaacaggaattgctcagcttcgcaaaaaagcccaagagtttttgctaagtcattccttatcctttctgaaaatggaagcgatagctcccagagaagacttttacttgatatgtctagaggagtttatataaatttttgaaatttggattattcaaggtattgggtgaggtgaatgctgttgcatgaaataataaaatttacatcaatttattataatctctcatttattccttaaaagtactgaaaatgtaatattttaaacttaatttaaaaattcacttcttcatggcttctccttctatgagaacacggtgacatagttttcagtgtcttagaatatcacagatccaattccatttgtctctgattctgtgagtctggaaatttttgtatacattctaacaaatgtgtatactgttttagaggtaggttcttgtgcttgcctgggggaaaaattgttttgtgattttaactagtaaccattccatgggaaatagaaaggttgatttccaaatttctagtctttctatacaaataaaatgagactaaaataactaatcgtaatgaggacgtatgatttgaattacttctccagcaatgcaaatagactgtgacaacccgcctgcatttccaagactgcctagttttagggtgtggcttgggtctgtggaacagagtaagtctaactaagcactattataattggtgttattgccactataattagcccaagagcttggagtcattagcacaataatttattatctgagctaataagcaaataaataccagaaggtacatctaatttgattcatgatttgaagagagagggaaagtccaaagtatagaatctgttttcagaagaaggccattttgttatattaaagaataataattttaataaagtagtatttaacttaatacagcctattttattaagaagcctgcttcaatgtattcatggaagtcatatttaaatcattcatgtcatatttaatttagaagcacaaaatcatatggctaaaggggccaggcaggtggcatacaggaaggaaatgggccatatggaagaaaaaaagggtgtgttgggagcaaactgaaagcaagcgcccttttaaaaagaactgctgctacttggctccagttgattgccaccacgtagcaatgtgggcccagggtcaccagattttctagtgtttagagaagccagaaataggaattctcatgtggcagttccctatttttaaattttggcaaataagtcacattaaacaacagcaacagcagcaacacagtgtgagccaaacaaaacccattcagaggcctggttcagcctgtgggctcctgctgcaaagtttgacttaaaacatctttttttctattgcattggaaaaatttataccattaaatgtactgagcattattccttaatatcttggttattctacagatattcttagtgaccccggagaagacaaatttaagtgaactcttttctaaactgcttacaaaatttaaattagaggggtctaaattaattagattacatgtttttcatggcaatttgtagatgtgatagtatttttttactaacactgtgtgggtctatatagcatatgaatttgcaacttaaatataattatttcagctggatcaccataaaaacactttctgaaagtaactcagaaactccagtgccttgtctaggccaaatgccatttatatataatataaatggcatatatatatatatatatatatatgtgtatatataatataaatggcatatatatatgtatatggcagatatatacatatatatgccatatatatatataaatttatatatatatggcatatatggcatatatatatatagacatatatatataaatttacatatacatatatatatatatatggcagatataatcatcacaccaaaattctactatcgctaatgggaggtgaaaagctaaagtcttgcttgttcatggagtggaatgagattaaacccgttagaatgctgtgtaatagtcttaatgagccatctttaaaaagcaattattgtgcatttccagcagcctctttcccgaacaacagttatgatgagaccatctcccatggtaatggtttaatattatttctgaaatcagtcttgtttgaggaatgtagcatgaaaaacgtctgattactagtaaacttattttccagtgcgtctctttaaatgataaaacttgccatttcaaaattttggggggataaagactcctttggggtgaatttaatataaaggcatggctttgaaactcattagtagtaagcctgcttccttaggcatggaggtcaagtttcagcatgaggtatgtaaaaataaataatataaagcaataatagtaatggtaattacaaaacactcccaaagaaaacatttgcaaaatggctgcaaacgtgcatatattattatttttattatgtgctttaaagtgagatgtagcataatgcattctgtaataatgaaatcatatgagttaacacctaaaatcatcaatatggacattctcaacctagaaaatagtgagagaaattagggatgtacaatactatttttcattattgctctgaaagtgtcacagatacagcctcatgtataacattagaatctgtcagaagagacaagagctccgctgacccaaaccctctgctgcatgtactaagacgctgagcatttattgtttgcaaaggccacttgcatctctactaggagaacagaatgacaccttggacaactgagtgagagaaaagcctgaagcaatagattaaaatgggattctgaccttcctcgcatatttctcctttgtatcctggcacacagatgcagactcccatgatgcaggtgccgtggccaaagcatgttggatcaatgcattgttcttccggaacgtcacactctggccccttccagccatgccggcagacacagtgtcctttctcgtattctccattcccaccacacagcacagggcaggaatctgaaggttggcaaatgaacttgtaatgttctcataatgctttcaaagtctccaaagagcaattctctattgattttcgtatttcaggcaaaaaattgtactatttctgtcttaccctttattaaataggcacatgttcatgattacaaacagaattttcctcttatgggagtgaaataaaggtaaattaaaaatatcctgagtggagaaattatttcaagtacttgcatttgatctcaccctactcttaaactgttattgttattattttaagctaggatttttctttcttatatttttcttcctcagggagatatgtgtttacttttaggaagcaaaatctgaaaatttaaaaagcaataaatgaagttattaatgttataaaatattatctttaaaaagttgtgtaattaaatagatttctattggacagatgtctgttcctataacacattgtgcagacctttattagaatgctaattctgctttgtcattgttagtctccttattaaaactatgcactttttgaggacaaggcctgtattttttgtcttattgattttttaataccaaccatcacctccacactcaacccccacctcctcaagatctatcatggtgctgggaacctagcaagtgttttagaattcgctactgaatggaatttaatagaaagaaaccaagtgtctgagaaacctgatattaaaatattagcagactgggaactttaagaatacagtgaaaatgagcagaaaacatctctgaaataataactgtaagtctacgggaaaacatgatgtgatttacctaaagcttttcaaaaattaaactatgggcaagtccaggaagagtgaagtttgctaagtttgacttctgactttccagtcgttactttgtaggctccttactcatttggtgataacccaccccttccacatacattggtgtgtacaagcagttatcaacttagttcacttttaaagtcagctcattatgaattagtttctgaaggaaatacaagcatcacatagtgactggtcagacaacctatctacaaatcccagctgttaggtaaccctggttaagtcacttaaactctctggcattgtttctttgcccataaaaattggataatagcagacctatctcatagggctattgtaggaagttggaattaaaagacggaacacaaagtgtttagaacagtgcctggcatagtaagtgctcagcttttggcagcagccatagggaacactgctgctgttgctgtcaccactactaatgttacttactatgactattactactaattctgggttatgaaatcacatctattttcctaaaccaatcagaataacagagcaacattacctctagcacagtcaggtccaaggaatcctgggaaacaatgacaatggccagagatacactctccatttccattgcaattggttgaacagtcatccattatttctagtaatacagagaaaaagataaaaaaaatgaacgcatctccaggctgtagagtctttatttttttttaagttgcaggaactctggacctatgacaattttgccctttgctgtttgtggagcacttactgctcaaaatcacatacaaagacatctgtaagatgtcacatgcagtacaaaattataaaaagggccctgggtttgctgacttggccaatcaagagtggaaccaaaaaacatcattatctctaaagcacataaatgttctagttcaactgtattcttaagagacattcatgataaagctaaaaaatgtaccaggattacagggcatttctcaaaagcaaaacaggctttaaaatgtaacacagatgactaagtctactgtttatttttcaaatttaggttttagcaaataaagtttcttctctagcaacttatttaatctactatcttgacagcttaaatatgatattcagtatttcattttcattaataagtgacaatggaaggcttttaaagtaagtgttcatattaaattcaccaccactaaaagcattagaacctaagtattttgttgagaaatgctttctgaactgtaaatgcttatccgttttctgccactaatttcctttcaatccattcttagagaagaatggatttcagatgaattgagatggctttgaaggtaccgataggtagttctggtgacataaatatgtaccgtgcaacagaacttttataagacttacagtaacttctctgaaaatctataatattatacaaatgtcagtctctctgacaatgaggtgaaaaaatgtttgtattttaaaattgtgtttgagcacaataatgatcaaattctaagtctgaactattatggtacctatgctttattctcgcagggatttttttttgtggtgtgtgtgtgtgtgtgtgtgtgtttgtgtgtgtgtgtgttatcgtctcctcattacacctttctataaatttctcatactcagcattcttggactctgagtttagtgttctggcctattaaactcacacttttcttgtgtaccattttttcccttttcaatctaaattacctgcttcaccaagtttcacttggataagctatttctgattagaaggagagattctaggaggtggtcctgatatcttccactgaacaataagagtgagaatttataatgagggtcgagaaatagcatttctacaattgtggcctgtggattacttgtatcagtagatcacctggggcacttaaaatggagatgcctgtgtttcagctctagatctaccaaacctgcttcagaggaatgcagcccagtcatctacattctgacaatcaccacatgagaacattgagaaccaatgctttaaatagtaaccttccatagttagagaactttgttctaaatgttgcatttttgccttgagaagaataaaaacaagaaaaagaaagaggtatctagtccatttgggggattcttaaaagctgagaatgaatccagtggctggatagccaccctattatcaattgaagatattatttgtctaaccactatgtgaacacatgccttttgcgggtttatgccagtctggtccctcatcacagtgttagaaaactcaaatggataagcaaataacacctgacattcacttaaccacacctgggctgactgaaatgtagcattcagcaaagagccaactatttttaactcattaaaacactagttatcatcagaaaatcactaatttacttgacaagtagttatgaaaaggcataaagagactttttatcattcagagatggaacaattatttatctgttttctacttatctagcttccttgtaccaagcagtagtgccacttcttaagtctacatttgaatttcccccatgctggatggttagtagaaggccatagaggaagctttcaaaaataagtatagttgaatttaatttcataccagatcctattggaaactttatggaagcagccttgtgggaatgtagctcttctggaaaaaatgtttaataaagcttgctatcaaaataaataaaaatccgtacatcttattgacttatttaagaactgtccctgagctcaaagggctttacaaagcttaaccccagcaatgcaaatgagaagagaaggcaatataggctttgaagctgccacttccactgggtatcaaagagacattggaacagccgagggactccaggaggaagatggctgcagcaggaacacataaacaactagccatgaaaaaaaaatgtgtttttctatttatgttggcctccagtaatctttgacttctatcttttaaatcttacttcagaattacttcctagagtccagtttcttagaggtgagaataattttgaagttctatgtttaaaccctgttcttatgctacagtcaaaagccccttgatatttgcatcttcgctgatgataggttttgtttctggtagttattctcatgggagaaactaaatgtaatgaatactcttatagaatgagtatagtctaaagggtatggaatttggaatcagacatactggttctcaaatttcaattttgccacttgctgtctgtgagaccttgccaaattatttaatcttttcaagcctccattcagttatttgtaatatatgtatcactattcctgagctatctgggttgtgatgagaatcaaacaagataactgagtgtaaagcatctagtacagtgcttggagcagagtggcattccataaatgctatctattatcctgctacagagcaagttgcctgagattaagggatactgacaatgctgcctatactactggaaaataatatataataacttaggccagtgtttgacctatattagtcatttagtaaatgttagttattaattgtcttcatccttgttagtagcagaccaaatatagttgagatcaatcaactgattctaacattatcatgaaatagataaatgagcagcgtttagagcaaattcatacaaatctgactttgtttaatcaagtatattggcttctttttactctgattaagataaagttcaaaaacaaaaataaaatgaggaggtcaggcatggtggctcatgcctgtaatcccagcaatttgggaggctgaggcgggtggatcatctgaggtcaggagtttgagagcagcctggccaacatggtgaaaccccgtctctactaaaaatacaaaaattagctgggagtggtggcaggtgcctgtaatcccagctactctgaaggctgaggcaggaaaatcacttgaacccaggaggcgaaggttgcagtgagccgagatcgtgccattgcactccagcctgggcgatggagagaaactgtctccaaaaaaaaaaaaaaaaaaaaaaaaaaaagaaagaggagaatttagggtgaatgacttacaagccttttgattttgggaaaatttacttgagttttctttaagtggaatggtagcagaaacgtttctgttgcttctaattttaaaaagacaagagaaaagtaaagagactgacttgcattaagcaaagagcaaatatgttgttgtatatgaaactgacagcttgatatgtggatgatatgaattgtatctcaaagtttaggttctttgggggaggaagtaagggacaggaaaaaacctctaagcatgtttctgggtctattgatttttggaaggttaatagatcggttagtgttttaacttgagctgaaagagtaagaataataggaagacagaaagtcttcacaaatattttatttcttctaatttatctaatttttaggagaaactcaaccttttataactcctcgacatgcacataattaatattaagcctccatagaaaaatgccatgaaatattcatccattgaacctgccccactgagcctgtcaatagcaaaacagtgacatgacttaaaaatttattttctattttaacaaacaaatattttgtcttttgaagatataagatcagtggagtttttctctaggggaaacatcatcatttccattgtattgactttctgattactttagaagaaagttttgataatcttacggctgaaataccattttctattgactcaaggtcttcagcatcaagtaaaaatagaacataattgttaaaaagagcagatggtatatctattaaagtcaacacatcttcctaaacatatggctgaacaggttaactaaaggataaagtggtgaggattgtattgaaaattgacagctgtaaaatattttcttgtcttttaaaagacatgtgttttaggaaaattcacacaatacgatactgtgtctatgagttgtttattttcaggactctaaaattgctaaggagctcagctttattcacacaaagggtcacgaggactatttatcctaaaatgacaaaagagtgagacgtctgaaactaattagggtgaaagtgaatgagtataggcaggcatcgcattaaaaagaacatgttttaaaaggccctgagcacactgaaagagacattgtgatgaatttcaaactaaaatattctataagaaagggctttgaatgtctcaagttattatccttaatattcttctgtaaataatcttatgttgtattttaaagccctaatgcttctagaaccagttgttctaaagaagaactgtactgatactagttttttctatttgaaaaaggtattcattgctttttaaaaataacagaacttaaattaacttgcttattccctttttcactgaaattgttcatctatgtagccttggtaataatattactaaggtaattatttctgttgagagcacataaaaagatgtatggcaagtgtcctagaagagcaacaaataaagtagcattaaaaaaaatcttaatcagcatttaaacaacatcaatgataacaacaatataaacttttatcatagtaacctttcctcaataatgacttcaactcaaagtgagcaataagcttaaataacccccaggacactgtcatcactgattgtgtctttctagggttgaactgtcaattcaacatattaggcaaagcagcttaccaattgctgtagttaacacgaatacttgctccatcttttttccatcattgtaaaacgccagataccaaggtccttgatccatatactctatgaaacctgtctcctgaagcgaagttaagatcaggttccgaggggagtgctgtgtatcatcagagcccttggagtcctgcttgaccagctgtttgccatccattagttttacaaaatcaaactggaacaaatacaaacatgaagatgagccactactttttcttctagactgataaacatccctaacttcaactgccctatttcttacttctttgctttgaagttgagcaaattggaagaggaggttatcaatttttaagtatatttagacttggccaggcacggtggctcatgcctgtaatcccaacactttgggaggcgaggacaggaagatcacttgagcccaagggtttcagaccagcctgggcaacaaattttataaaaatttttaaaagttttttaaagagcatatttaaactcaaaaacatattattaattatgaagaaaccctcactgtaattaaaaatattataaacctttcagtttgagagtattcaaaataattgtttaaaaatgaataaataaaaaacagaaagaaatcttgtttagtattatgcaggagaatcttgacattttactaaagcatctgatagaagatacttgaaaatacaccttccactcataaatgttactgtgaccttctctacaaattaaaaacagttgtatagtctttaaaataaatgaacagtcaaaaatttgagaacattcatcataatttactacgtttgtgggtgacatatttacatattcaaaaggcccctcctctccattttttctaatcagttgacaaggacctggcacatgtttccttgaacatttattttttgaatcacatttgaatgcattctaattccgtttctattctggcccagaaggtaaggttgttttttagtttgtttctttgtttagcatgatctcttgactaactgaaggtaaggttttaactatagtcatatctgttggggaaaaaacaagccccagtgtttgatcactttttctacttcttagatgaagtagtgctcgaaatgggttcatgtggggaaaaaataaggagaagaaaataagagaaatgagatgtttaaagtttatggaagggctataaaaatcatagaagttttacacatttaagttattaacaacagtaaagaaaaatttctacctgtaagacaaaacctaactttttgactaatttctcactaatttctgattaatatgcgttccttcattgggaaaaggggacacagatgtatgaaatcagtgaagggactgtgggcagtaaagctaagcaagatgagaggtctgggaagctcatgaacagccggttccaggaagcagaagtcaaatttaaagggtgtgtcttaaactttcttttctgaatctgctctgctaaatgttattccttatttctccatgtcatttttttcattagtttcagtgtaattattctggatatttattcatgacaaatatttttctgtccttacctttgacaaccacatatttcataagtcacaaaccctgaactgttcaacccatcacccttgaaaagggtttaagaaaatacctataatatcaaatacctgagtatgtgtaggtggaatgtttcttctgccataaattcccagcagagagtccttggctaaagaaatattgaacttcagatatattggatggtggatagtaatctggaaacgccagaataaaccaggtggaatggtctgcatgacctgtgcaccaatgtcaacttctccagtgtctatcgcccgtcccttctgaaacactagttttaaaggtagagaaaattacacaccatgttaatcttaatttataaagcaatggtttttagcttttcaagaacagatatatcaaaataacttactcagctttttcttcctccccaccccatctgtctttcaaggccttgcccaaattaaatatcatctaagaagccttccccaaccacccactatgtcagtctctctcttctcttcaaaccctattgcatttatttcaatcaatttcactccttttaaccattatttactgagtgctgtcttggtagctgcaagagatacaaagatgagtaagaggcagttgttgctctcaaggagcattgaaaatagggaaaataggacaagcacatataacctcactgtaaagaaaaataagtgctctgtgtatttgaaagagggaaagttatttggttggaggatactcctcatctctagctatctctatcctctttatcttcttgtatttctccttagcacttatcaccatctaacatactacatattttacttatttattgtttattgtctatttttcctcaatagaaagtaagctctgtgcggacaagcactgtggctgttttattcgtcggtatattcccagtacctagaacaatgtaggcaactgtaggcaaagaacatagacgatacatatgtattcatagaacaaatggatgaatgagaaaaagttactatgggaagtggcactgaagatgagccttagaggaggacaaggatttcaaaagagttattgggaagagtggcgcacatggaaaggatggcttgaactaaaaagaggaaagaaactgtaaagctaaggtgtagggtatgtgtctatagagaggagcagttggagttagggctggagggaagaaggaaatcatgttgtctagggcctagaggaccagtcaaaagggtttatttaataaaggatagaaagccattaaaggtttttcagaagagggaagaggtttgggtacattagaaaggctaatcttgaggcagaggtgggacgaattagagcagacggacacaagaatgacataggaattatgggtgattcaagtgaaatgacatgaagatctaaatttagggtatgcccaaacagctcatatagaaaaactacatctcagtgaaaaataatttcatgtgaatggaaagaaggagaagatatgagagacaatgctaaggaagatactgcagtagagattctcaaactttaatgcgtacaagaaggcagttttttaaaatacaattctgattcagaaggtccaaagtcagacatttttaacaagttcccaagtgatgcccatgtcgcatggtctacagcccacaccctgagaagcaaagctctagagaacattaagtgttggggccaatggagggtcaaagctaaccccgtgattgtgagttgggggatttagacagtgctaatagcaaaaacaggagctggtctgtgagggaggatgttgagtttgggcaatcagagctttattatttattgtcatattttccaatgatttctgatgtgccagtttaatatgtgttttcatggaattttttgttttgtggtaatggggagggtaggaatacaagaggaggagcaagatttagtttgccttgattttaagcaaggagggttacatctcaggtgagaaagctcaacttggcctcatttcacatcacctttatttttttcagccatcaactccttctccagaccaaacacagttttaaaacacacatggtctctgttctttgtgctcacccattataaagttaacagcccattaagaaacacacctgcagtggctttattcagtggccaatgccttgcagcttttaactccctaaaatacctccattattgctttttgtgttaaggccaacagtaataactattttaagaatgttcactgttaactgttaataatagatttcaaatgcaattttgtacataattatgtattacaggacacataattttgtggaattgacatttataataaaataggctctttgaaatgataaatgaccaactgaggaccttatttttcactgaaagttacttttttccatgtgagacagatcaatttggcccctaaagggctgattatacatttaactcttaagtcctagagctgacaatgtcttcaatgagcagacaattaacagaccatgtttatgtggcacttctgttcgcaagttaatgttcagtttattcaactgctatcctcattaggggcttttatcaatcttaaaatgcatcatttggttatgcaaacaatattataaatataaaacaattcaaaatgttctaggtttgacaaacactgttttaaaggtgctaagaatagactttaatgaatagatattgtcattttttaaaaatctgaacaaaactggttgatggacattaacctttatattaaaaccttaccaaatactacaccatctctttattctgcactttatagcatcatatattacataatgaagctacttaaatgttattcaataaatcaaaagaaaggaagttgtgttgttgggcttctctgtttattagcaagtctatgtatctggagtacatatgcataagttattcatgaaaataattttaaaagaagttgatctcatcccttgaaagcttcattacagctaagacaaggtagatgaacagagatgacaacatacgaatgagcacgtggactgtaatttaaataaaaataggcaaagcaagctagttgtggtgatttggtattagagaagagacattctcacagcttgtaggtggaaaatttctcagcctcttaccctttagagtttcatgcatcagaaaggaagatatttccctgttagcaatctagaccactaaatagactgctccattttatcatctctcaaaatttgttatagactatagtacaataactatgaattcattatttaactattttccttaatgtagccaaaaggtgtggcaaactaaagagaaggaaattaaatgtagaaaaacaatacaaaatagtattttttgaggccaggtgcggtggctcatgcctataatcctagcacttcgggaggccaaggcgggtggataacctgaagtcaggagttcgagatcagcctggccaatattgtaaaaccctgtctccagttaaaaaaaaaaggattttttttccaaaaatttctgtattaatataggtaaatgggatctatttggccaaacttaacactgactctgatcctttgtttgcaaattgtaaacagcagagatagaatacagcatccaggtacaattttatttatttttgcaatatgcctgttctaattggcatttaatctcttattttactaaagcatactggaaaacctaggaagaccatattctccagttatagaacacttccttgcacaaatttgagattaaatgcagagagccacagatcatatcaagctgtgcagtactgtagttatcacagtctcaccaatatccaccaatttagtttgagctaaacactctctttataggttgcaacacaggcatcaactgctgagcaggaaaaaccaatggtagacaggctgtgttgaaagagggcacactaagtgatggtaactcagttccaaaagaaaaggtcaagatacttggaaggtgaaaaaaaaaggggcctggaattggtgacagacaatgtgtgcagtggcggtatcacctaaatcaagactccattatatctagactcagacacacacttgaatactaattacatgattactaatgacattgttcatataaaataggaggtaaataactatattctgcacatatgtgtatatttattttttctatttaatatagctagacgtggtacattcaatgatcctatgcaaaactcggttgaatattgatagaagatagtgaaacatggtcattaaaaagattccaccattacattttaaggtaaaaatgatcaagttaaaggctatggtatagcccataacagcaatctgagttgtattttaaagacatttgcaagtttcacaaagtatctaagctatgttttccaaagagaagaaatatatgcattcagagcatatttgtcctttacttcaccctataacatgctcaaaatctttaaaagatattggtgtgtttttcagccaaattagacctagtgtgtgtctcacgatataagtatcatcttctttatgttcctctgaatataatacttgtttaacagtaacaagtcttcgcaaatttagattagcagtgcttggagcaaaatgggaggtggaactaacctcttccctgtgattaaatgctttaaagggttcaaaggggtatagcaaaagccatctgaaaggtaggtggaaagctactgtttccatctatgtagcttaatgtaattttccttacgtgaactatcgaagagaaatatgtattcaactctcaatttttcaggggtagattttctgggttatggattacacatgcttttgtatccattatattacccaaaagtagtcaagagaaaaagaaaagaataaaccttgcgcctggtgggaacttggtaaacactgcttggatacattaataaattagtaatgttgataatttttttgttgatagtaattttgataatatatttgacattttagtcaaaacgtacaactttttttattactctcaactatgtgataggtaggtcatcatataattgtttttattaaatgtccagtaagtagatgtcaagaatttactggtgagaggaagaattataactatttacacacataggccttggcaattaactgtgaataaaatatgtttgtaaataaaatcctctgatatgacactgataatagatagctcactgtgtagaaaagttaattaactaatcttacaattgagaaatacattacttgtataagtgtaaacaattatgtccaaacaccaaaagactacagataccagtacagtagcttatttagtattgcttacatcttctcaggtagaagtaaaatggcattgctaaaatcttatccttaattaaaggacttattttgagttgcattttgactctgtatatctgtttttgaagctatatcatttaaaagacacaattctctatttagaaggatttctttaaattttgttgtaaaaacttccacattcccaaaaactttagtttcacagttcttctggtgtggtctgttgaccattaggtagcattcagaaaaatgagtttccaaacttaaggctcttgtgacttgctatacaatctcacacggtgtaatacaaattacatttgtagacgtttctgtatacggattacaaatgggtacatgaagtagccaattactttgacttttcttggtgaaaactaaaattgatataaagcacaaatgtatcatcaagttgttacatattcaaacatttactcagactcatgggtcaaggtggaataaaatatctcttgaaagaaaatattgccaattgcaaaaaaatccaaagatttatgaataaatatgactatatgcaatgaaaactccaaagtgaaattaagaagagaatgtccatttgtaatatcattaaaaagaataaaatacttaggaataattcagtaaaagaaactgtgagatttgtatactgagaaactacaagacataattgaaagaaattaaatatttcctaagtaaatggaaagatatcctatgttcatggatcaaaagacttattattgttaagatggcagtacttcccaaattgatttacagattcaatgcagtccctgtcaaaattccaactctcattttttttttagaaatagacaagctgatgctaaaattaatatggaaatgcaagggactcagaataactaaagcaatctttaaaaagaacaaaattggaggcctcacacttcctgattcaaaactgattacaaacctacactaatcaagataatgagtactggcattaggatagatatatagatcaatggaatacaactgagaatctagaaatgaaacctcacatttatggtgaactgattttcgacaaggtcaccaagacaattcaatgggggaaagaataatactttcaacaaatgatactggaacaactggatatccacatgcataagaataaacgtgacccccttcctcataccatatacaaaaaacaactcaaaatggatcaaatgcctacatgtaagggctaaagctgtacaattctcaaatgaaaatacaggcataaatctttgtcaccttggatttgtcaatagtttcttagacatgacatcaaagcacaaataacaaagaaaaaaatacataaattgaactgggaggccgagacgggtggatcacgaggtcaggagattgagaccatcctggctaacacagtgaaaccccgtctctactaaaaaatagaaaaaattagccaggcgtggtggcgggtgcctgtagtcccagctactcgggaggctgaggcaggagaatggcgtgaacccgggaggcagaggttgcagtgagccgagatcgcaccactgcactcaagcctgggcgactgagctagactccatctccaaaaaaaaaaaaaaattaaaaacttttgtgcttcaaaagacactatcaagaaagtggaaaaacagcccacagaatgggagaaaacatttgcaaatgatatattggataaggggcttgtatctatggtatattaaggaggcttacaactcaacaataaaaagttaaataattgaaaaaagagcaaatgatctgaatagacatttctccaaagaagacagactaatgaccaataagaacagtaaatgaagcttaacatcattattcatcagggacatgcaaataaaaaccacaatgagataccattttacacccattaggatggctaaaataaaaacaacagacaataacaagtgtaaggatgtggagaactggtattctcatacattgctggtgggaatgtaaaatggtgcagttgctttggaaagcagttcatcagttgaagaactgttaaacataaaatgttaaacacagaattaccatatgaccccgtcattccacaacttggtgtatactccaaagaattaaaaacaggttttctaataaaaacttacacatgaatgttcatagaatcattattcacaatagcccaaaagtgaaaatccacaaaagatctatcaactaatgaatggataaacaaaatttggtatacctatattatggaatattattcagccataaaaatgaagtattgatacattgctgtatattatatgattctatatgaaatgtagaaataggcaaatctatagagacagtagattagtggttgccaggggttggaaggaggtggggatatggagtgacagccaatgcctatgaggtttctttctgatgtgatgaaaatgttctagaattaaatattggtgattgctacacaactctgaatagggtaaagatctctgaattgcgcactttaaattagtgcacaattatattatgctatataaactatatctcaataaagctgtcacaaaaatacagttagatagtgtgaattggcatagcatatacacaaaaaccatcatgtactgtcacaagagttttgatgtatttccaagtggttttagaatgttacctgctacctagaagctgaactatcccctggccagtattttagaatgtgtgattggtagtacacatcagggatgcccattttctatatttcatacaatgttagatactgttatatgtcagttatcattatcacatcattcttaactttggatggtggcaggatggctgattatagctcagttaatccagttccctctcctttattttagaatataagtccccagaggatagaacattcacatctgtctaaattttcgacagctactcattgggcatttaataaaaacaattatatgatgaactacccatgacatagttgagagtaatgagggaatggcatatcttgtactagtcctccagacttgccatattgctatagcctttgatttctaccttttaggcatgcagaaatcttcaattacatgaattaaaacttctcacagacaaaacccatgtcagagagtaataataataataatagatgctaccacacttactgtgtcctctttttcagttcctatctcttatttctaaaataccaaaatgcctctttcatactcagtatgccatccaatttgatgtcccagtttatctctaaggctcctccctcctcttctctcctgcttatgctgggactttggtctttttgcaatcttctttcttactcatactcggtgtctccctctctattggctcctcattctttgtcttcaaacaaacacaagtctctcgcagtggctcacgcctgtaatcccagcactttgggaagctgagacgggcggatcacaaggtcaggagtctgagaccagcctggccaatatggtgaaaccctgtctctactaaagatacaaaaaattagccgggcgtggtggtgcgcgcctgtaatcccagctactcaggtggctgaggcaggagaattgcttgaacccgggaggtggaggttgcagtgaaccaagatcgcgccattgcactgcagcctggacgacagggcgagacttcatctcagaaaaaaaaaaaaaaaaaaaaagtctctcttcttttgaaaaatttgtaaaaaaactaataacatgacccaactgcccttttgtcaaattatcatactgtttatctccttcctttccttgctgaactgtttctatcagctgcactattgtttcattatccacttaccacctaggctattaccatctgcatttcccccttaccattcgattattccattctcctaaaaatgtactcctcaagatcactaggagtgatttttcttgttttccaaggtctggcgcaaactacttctccagaaacagtcgtattttaatcttctttcttttaagcctgttaatcacctaaccatcttatttttatttctgtacaacagtttgttgcatgttgtttgtattgtatgtgtatgtatgcatgtttcttccagctctcctatgtaacgggaatctgctcaagggcaagcactatgtcttctgttttatttgttagctttccacagtacttagtacagttaaagtagcagcttggctgatacaggattaaaaattatgagcttctgtgtttctgaatactaagaatttcatttttgttcccttgctattagtttaatggagcatttgaggtggtcaggtatggtttctctttcaactcaactttttaactgttattcttccctctcctagaaccaagaagagaagatggtatctgtgtatagctgtggctgacactttcagtataattataatgaaaatagaaaatgaccattaaaatgactaagggaaaatggaagctacaagaagaatacagaagtaaacgcaaggactcttaatattagacatgtgtaggctaaaaaagaatgtgtgattatcatctaggagattacaaaagttacacgcaggaaaaatgcagatttgtgcattaaattctggaactgtaaaacttcatagtcaaaagtaaacttcaagtaactagaattacattggactccacaaaaaaggctagtaaatgtttaaacttccttgaaaagtaatacaggttcaaagatataaatggatactcaacagaattaaatatacacatggctgataaacctctacaatggactagctcctccacaaaactaaaatgttgtaaaaatgttatgggaagatcccttagctttgaaaggactagtccaggaggataaacatggcattctatagcataccacttagtgaccctgtcagatgcagactgttagactagagggaccacaagacagacctatttcttactgcatcacaggaaaggtgtgtattagtttttttttttttttttaagtaaaatgaggatgaaaatgaaacaagaatgaaacactaaacatatatgaccaaggacatttaacgtgaatttttaatacaataaataagtttgtctttcagcatagggaaccctttccataaatctgttttagaagtcaagtctccagtatgctttaggaaagcttttgttaaaactgaagtatattgataaagtgatttaatatagttgaaaacaagctgcagcactctagctgggccctctgaaaccttctgttagggaaacatctatatagcattataggaaacatttactgtaattcgccatcaatctttaaaaataatactgttacactcccaacaatgttgtctttgttagcgcattacttctattttattcatgtggtttgttgtgcttacatgaattattcccaattctacctcaatatcttgggctataatatcctttaaataaaagatactgaaactatgggttgactcaaagggctgctgaatatccacatgtcctatgaaccaatattgcagaaccacagaattatactgcaggactgcgttccatctgaatgcacaatgattacctgggtggggttggtgcagttttttagtttggtaccacataatgaatctttatctactgattgggtctgtgaaataaatatctgccaaaccttaagtaaattaaaatttaacctgttatttcaggtccacaattggcattgtataaaatgttccaaggcatttatgtctcagataaagcaaaagaaaaaaaaaaaaaaaaaaaaaaaagcaaaacacacacatacacacacaaacacacccctcttctggataggtccacaatgaaaggtggctgtaaacagtacattttgcactgtcatttagttttcaattcccaagagtacttgtggggtgtgtgtgtgtgtgtgtgtgtgtgtgtgtgtgtgtgtgtgtatcttttgctttgtggaggagggagaatgctcgctgaaaggagatcttagatgtgaaatataagatttgccaagtactcttaaggaagagtacagtatttgaactgtatgcattgagatttttaatcaagatagccgttatttaaacaaactggctttgagaaaggaatttttttgaaaaatgaaagaaaaagcccaaggaagggtgctaacagtaaggagaaactggatcacaatctcagctctgcctttagttatgtctattgtctattgcgcaaggcaagtcatgtaactttcttgtgttttccttttcaactataaaacatgggtaacacggctgggcgtggtggctcacgcttgtaatcccagcactttgggaggccgaggcgggcagatcaccggaggttgggagttcgagaccagcctgaccaacatgaagaaaccctgtctccattaaaaaaattacaaaattagcctggcatgatggcacatgcctctaatcctagctactcgggaggctgaggcaggagaatcgcttgaacccgggaggcggaagttgcggtgagccgagattgcgccattgcactccagcctgggcaacaagagcaaaactccgtctcaaaaaaaaaagaaaaggtaacgatagctgccacagaataaaactattatgtggataaaagacattaaagtattttacaattgtaaatgctaagtgcaagctgtgttatatacatgtcaaaactccaaacttataaggtaggaaactgggaattaattgtttgaattgcaacggaattctctgcaagtattttaaatggcaaatgtggttttacaaactttatagatatacatttcaacctctttccaggagtatatcccttttgcaaaaataggtccacttttacttgtattggctcattattcttccttaactgcagaatttgaacactaacgcatagtgtgtacagctgaaagggatcttacagataagttagccttgtgttttgtcaaagccttagcagctgctgagagaatagagggcaaataaagcaaagaggaagggaacgggagttttgccaggaatctgcccccttccctcgccatatctggagaaacttggcttttatctgttttctatttaaatttgtaatttctgggtaagatttaatttgtaaaaacgttttcactgcctgctagccccgcctcttctctgcccctagaaacggttgaaagccaactcccttatttttcagatgagaaactggagcctagagaggtgaggcagtagtcactatttggtcttggctaaagcatcttcatgacaggctataaattgtgtcatatcaatcagctgtattttgtttacatggtcatatattcagcagacactgactagaaaaacgtcattttttttcaactttgtggagatagattgtgcaggatgaatttaaaagaaatgccactttcccccaaggccaggcttatgcaaaattgtaatggagataaaggctgcttttagtattctttagttctgtctttccccacccatccttctttgttcccagtgttctattttggcatccaacctgcaggaattcagtatcctcaactacccaataaatttcatctccatttatattgctactgacaatacaagactttacctgagccttaatgctcctggaaaacaattttgcttaagaaattccccaaccttttgttttccgaaattctcccacttttttgtgtcctgggaaatggcttatgcaaaaaaaccgtaacaatgacaacaaacaaacaaaagtccaaacaaacacatacaaaacacccttccctaaatgacttaagataaaactctctgtcccttctttcccatgatttccctaagactcacctataattccacccctgaaaagaccaaacacagacttttcccctattgcctgaacccactgaaaggccgtatacagaccctccaatttcctattctttgtctcatgaataattagttgagattagaactgtctgtttccctgaaactagctagaaacaaagatacacatttcctgttcagctaactgatacttcccctgattgcaacacgatcccaccagtaaatcatctcacatgtaacccatctaccccttcctaataagaccaagacaaacctccctattgcaatagcctgaataaaatcaattgttttacttgttcagtttttctctgtgatacttattgaaaaccttttcagaaatttatatacttagtttatcctatactattacaataacaggtgaaaaatataaaacgtgaaactcggtaccttctctcctagtcccagctctttctatgtgatctcaacttttctggacctaattttcttaatttctaaataaggatattggatttgataatctttaagattttaacattctaatttattgataaattacgtgggggtagttatttttaattttatttatagacattatataactcaggtctaggaataagtcttttatttgttcatatcctctgctctgtttaaagcagttgttacataatgtttactggttaaatagttataggccaggcacagtggctcacgtctgtaatcccagcactttgggaggccgaggcaggtggatcacttgaggtcaggagtttgagactagcctggccaacatggtgaaaccccatctctactaaaaatacaaaaattagctggatgtggtggtgggcacctgtagtcccagctactcaggaggctgaggcaggagaatcacttgaacctgggaggcggaggttgcagtgagccgagattgcaccactgtactccaacctgggcgacagagtgagactccatctcaaaaaaaaaaaaaaaaattatgactagtttgtaagactctaatgtagtgagggactattttggtacaatactttcaattttataaatatttaatactgacaactgagatttttctggtagattacagtatgtggttgtgacttatatctgcttattgaaattctagagtgttcgtaaattttttagcatactaaatgtctataatcaaatactctttttctttcatttggataactaagtggtgagaaaattctgttttctcatgagaagcagatatataatatatatatataacaactgttaatgggaaaccaattccagtagaatttgatgtttctttaaaaagtgccattcatcgccattctaactggtgtgagatggtatctcactgtggttttgatttgcatttctctgatggccagtgatgatgagcattttttcatgtgtctgttggctgcataaatgtcttcttttgagaagtgtctgttcatatccttcacctactttttgatggggttgtttgtttttttcttgtaaatttgtttcagttctttgtagattctggatattagccctttagaatggcgatcattaaaaagtcaggaaacaacaggtgctggagaggatgtagagaaatagaaacacttttacactgttggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttactgcggcactattcacaatagcgaagacttggaaccaacccaaatgtccatcaatgatagactggattaagaaaatgtggcacatatacaccatgaaatactatgcagccataaaaaaggataagttcatgtcctttgtagggacatggatgaagcgggaaaccgtcattctcagcaaactaacacaaggacaaaaaaccgaacaccgcatgttctcactcataggtgggaattgaacaatgagaacacatggacacaggaaggggaacatcacactctggggactgttgtggggtggggggagtggggagggatagcattaggagatatacctaatgttaaatgacgagttaatgggtgcagcacaacaacatggcacatgtatacatatgtaacaaacccgcacgttgtgcacatgtaccctagaacttaaagtataataaaagaaagtgccattcatcattatctgatgatgatagtggtaacagtttaaaaataataggttttagattggtgagtagagaccaaactttaaagagagaaaacacttcgatctcaagaaggtcatcattcactgcaaagttcatagtggtttgaaagcaggttctatagcacctaacggaatgtcaatgaagttcaaaaacctcaaggtgattttccaatcttttggtccgataataactgctgctaaattaagcaatgtgtcagacactgtgctatatgctttatatcaattgtttaattaactccttactatgaccatatgagacaggtactattattatcacccttattttacagatgagggcactggctgggcgaggttgtgtcaattacttgaggttggagagataatgatggtacagttagtatttaaagccaggtctctctgactccagaatccaggcttttaaccacagtgctataatgcccaatcttctaggagagtagagaaaacaatttaggaagaatggtctggttgtcagtttcatattttagtgcatacagtatcaggacaagcttctagagctgtatttatgggatgtgtcttatgtagaaaatcataaaaggatacaactgaacatttgaaaatatccttctactgtattatatcttctgcaaggtttggattagtatacatatggcattaaaaaaaaaaggagctatgtttttacttggtaagtaatatgcagtaaagacctaatacagcaaaaccatgatgtgcagttatagttaaggttttgttcaggcttccagaaaaagtcaggataagctagcaacttggtatatgaggcatcaacccataatgatttttcttaataaagtatttaattgaagtcggtttgctctgtttgttgttataattgagcagaaacttaaatcatttttcatttatgagacttgtcacaacacattaaaaatagaggtgagtagaatttctctaaaatctatcacgaatagactctgggactttgctttcattgtgtaaaaagttttttgtggtcttcacagatattccatatgaggattttagtacagtgtagaagttaagagactggactctggaatcagaccaccacttactagctctgtgacactgggcaagttacttaacctctctgtgcctctgtttctcatttggacaatggggaccataatgtgaccttcatgatataatccatgtaaagtttctggaacaattcttgacacgtggtaattttaatttaattttagccatcatcatcaacttactttatggaaaggaatcaaaagaggtctgaattagaatataaaatcaaatatactataatgacaactatgtgatgacctgctgtcttgcatgtttcattttcctcagacagataaattctgatttttagtgtgaatggcaagaaaccctaggcagataataccaaatgatagctcttgtactttcagatataaggggataaaacagcagaagagaaggtaagggagaaaaagcaggtaagggagataaggaagaaaaatctgagcagtgagtgtggcagactttcttatctgccacctctgacccctctactctcctcagccactctcaggagtaacagtgaaactgctgggaaaggtcactccaggctagaaacaagtattttgaaatgagaacatacagcaaactgcatcatgaattgaaaactagagcaaaccataatattttcctgaaccctaagcattaatttttactgaagcatggattacagttaccttttcaaaagcacacaaaaacaagaggaaacaaaacccacaaacaacccccccgccaccacgaaaggaattaaaaacacaagggaagagtagtaacccaaataactactgtattaaaaaatgatgtcttagttgcaactaatgaaccaaaataagactgtgttaccacctgtataaaattgtaagcttcttggaggtaaggttttggtcattcattcatttatttacgtttggtctccaaaaattactcaggatattgctggctatatatattattctcaatttctaccgtttaaattgacttcctggaattttacaaggctcaagtccctctgtactgaatcctatttcaataaaaatataaatttccagctattttcactgcttgtatattaagactaagatcattcagtgtgaataagatgttgggagtgctggtactgtgacatttattataaataagtcaggtagttcaagctcatgttggttaaacttaacagttcaggactcaaagtgattttttttttctttctcccaactaggaagaattcatgttcccaaactagaaaaaaatcatgttatccaactttgacataaacattcacctttacattaagcagaaaaagctttttcgtattacaaacagaagaaatttccatataccctttgtaaaatgttatatataaatgctgggcttggacacagagaatgtaatcaaaatcccacgttgcttcagggtagttatatgcgaaatgcaatttccattgtattgaagcctccattctgtaaatatttatctattttcaaaattgccaacatatttgaaaactttaattggtttatactcaaggcactggaaacaaggaaaatttgctttcacaagatatttacatgcatttattctgtccacgtagaggacttctttcaagtgatcatgaaatttaatgtgaagtgaaaccatcccagctacagttctaatgaccaaattagaagaaaagtaatcaacaatcaatcattttgatcactgtaccttttttctctgatttatcagaaacttttcctccaattggagagtaagtagtgtccatggactcggtccccctgttccctttgctaactccatttgcatacagctctccttcaactggttgcaactgccaagtcaggccgaacaaatgcactgctgcaagagaacaagccatacattaatttattccagactcactgagaacatctccaagccaggtatccctttgcacctaaaaatgttacgaacagttttcttttagttaggccaagtaactgggagtttatacctatacatcatacatgtagctacttacatgctacgacacacatataagtgttaacagctgttaaagtagctgttgttaacattttgaggctaaagctatcccaatgataggattagaaattggaatcaactatagtacaattagacttaacttctcactgctgtgaccctttccttttccattccccttagtcatgtaacactagtttccatatggaaactattacagagtaatggtggacagactaccatgagaacatggaagaccttctctatggctttaattcaattcagttcagcaaatatttcctgaacgcctagtatgaataaagccctatgatagttgctgccggtgttaaaatgtagatgcttattagggtgggatttggtagtaataccaggataaaataatattatgcagaatgattgacataagacaggtttaaactgctatcagaagattaaaaagtacccagtgttggtcactgtgcaggaagatgggcactctcatacactcctgatgagagtataaaaatacagtgaccttttttggagggcaatgtggcaccatttattaaatgaacttaaaatctgatttaccctttgagctaacaatttaatttctgtgaattaactatgaatgttgccaaagtacaatgctgtctattgtaacatctgaaaacaatattagaaagttatgatcaatctaaatattcatcaagaggggattaatcaaataactgatgagatagtaaataatacaagattatgcggctgctaaaaatcatgttgcagaagaccatgcaatggcatgggaaatattcataaggtatcaaatgaaaaacattaggctactaaacattataaatagtgtgatctgaagtgtgtgtgtttgtgtatgtgtgcacatgttcatgtctggagaaaaaaaggtttggaagaatatatagcaacatgttaacagcatgggaagcttacagagaatttttattttttttatgatttctgtgttttccatattttttttacaatgaacatgtgtaacatttgccatctgtgaaaaagaaagctttcggtttaaaggaacaggaggttaaaataggttgggctgatcaagaataatttttgaaggaagtgggagtagatatagaccttgaaggatgtgtagggctttgacaggtgacaacgattggtggggagaagggacagggctgaacaaaatatgactttgtaaagtacatgatgtatctgaggcaaaagaagttgctggggttcactggagcttagctatgtgctggtgccagtggaagttaacgccagaaaggaagattagagccatattgtggagcacactggtgccacacttatacatttggattcaacttattaggcaacgcagaggcatttctattttttgacaggttgagtgatatgatcagaatttttcggatgattaatttgagagtggggagcactgaaggtttttagccaaataactgatataataaaaacatcctttgcagaaagataaatccagtagtagtatggagaagaatgaattggagacctaaaggtttggcaaataaatcaattgggatggcattgcaataatttaggaaagaagtaattagtgccccaattagagtagtgtcacaggagtgtctcagttatttgcagtgggaatgcaaagaaggagatttcttaaggagaaattgcataaatggcatttcaggatttggcaagaagtttctttctctctctctctccctctctctcgctttctctgtctctgtgtgtgtttgtatacacattcatgcatgtgtataggtgtgctgtgggagggcgtagaaaaaagtgagagaaaggagggaggaatccaaaatggttaaggttttgagtctaactgaaacaatggtggaaccattaatagagttagagaattctttattagtctagcacttgctacaaatagttggtactggatttgtgttttgttgattgatgactatttgaatatgtggcttgagacaggatgagaagatgcaaggaatgcaatgaattcagcctttggggttgttgggtgtctgggactgatgggccctccagatagtgaatgctaactataggaggtttgaagttctggaggatattagagctagaaaaagaatgaaaagtcatatatgcacagaggcaatagttgaagttgtgagagtgaatgaagtcactgaagggagagaatgttaggagaaaacagttcctagggcaaaaagctggagaaacctcttgtttgttttctcattgcatttttcaacatcaaccaaatcctatcaaaaggcaaaaaaaaaaaaaaaaaaaaaaaaaagtgaatctgctcataagccatttcgtatttctctttgtgttcctaggtgaactgaaaggggctaattagtatgtgtaacactcatgtatagtatttgagttagtgaccgagaacagagaaggatagcctatttaaaaatcattcatccacttttagttggagctaaagagatttctaacacctacttcctaatttatccttaaaacttttaagcatttaactggtttctacccttttctttggattaaggccagtgctgcctgatgaatttctcttgcaattattggaaataattttaactcaaaggatagtggttctgagtaaggtatggtatggcacattaataaagctatattagtgacatccttgagatttccttgccaatggactctagtttaacacacctgttccaattagaggtatttttccgttttacagaaaatttggtctactctgcctcccaaataatttgaatatgatggatagtaggagctatattgaaaatgtgtttcattccctgggttcaattacttctgtgaaattagatggaccatatataacaaaaggaatagtagatctcatttagaagactaagggggctattttatatactttaagttgagccactttcctggcggcacttgaaaatgcgagaaaatgcatgtggtgagattcacttcaaaatatataaggtaaggattaatttttcaccatcgaatgaaatggactgcttccagccaatcaagacagataaagaggtatgggcacatttagtagaacactctttgagagcagtgaagctttgtaattttttgaacttactatatctttcccagggaacaagctgtttgtaatatatgtttgtgtgaatatataatgaaagttaattatttgctacagaccacagacaggtatcatggcaaggctactggccttttatttcttccaaacataggtactggccaaccaaaatggctatcagatataaacaactaatacagtctaaccagtgtgtacacactggctgaatgtcagctttagatgcagtataaagacagcttccttagtttctagtggattcccatccagatttatgctatgtgtttagagccacactgtttaggtgagtcccccaaacccaagaatagacattatgagccaattggctagaataagggtaaaattagtaatgaacaaacagggcaatattaagtcatattcacatgttgattcaacaaatacttttttgagtgcttactttaaaccaggcactgtttttttttttttttctgagtttacagcagcaaaaacataaaaaaacctctaccctcccagaacttacatgagagggtagtgggttaagacaggcaaataaaaaatacacgatataaaatataagatagaatacaacgttaagggaacaaaccaaaaaacaaaaaacaacaaataaacaagataacgttgggtagttataagtgctatgaaggtaaaaataggtaagggtggtcagagaaggcctcttggaggaggtaacatttgaaccaagattagaatgaagtgaagccattgtgaatatctagtggaagaatcttccaggcagacaaaacagaatttatagaaagccctgaagtcttacatgaagtgtgtgagaaatactaaggagcccagtgtgagctcagtcagaaaggcaaagagtggtaggaacactcatacacataagtcctggacccataatcttgttacctcagtacgctagccaactttgcaagctggtcaccaacaaataagaattagaaagtaataaacctaaaatctcacataccagaatatatacctccaaatgagcactgctggttgaagtagatgtaatataagcactcttgactgtaagcaaggtcaaagttactgttccctaagacatatataaaatatatatatatatatatatatatatatatatatatatatatatatatatatatatactcaatgaatggagatggatgctacccagatctctgagggagtacccatcctgttatttgcatttcactgaaattcaatggttggacagaatgtttatgtctactcaaatattccaggaatggtgtattttcagcagattaaaaatggcagtccctaatgctcttttagcaaatgttccctgatgctgagccctgtacattttacaattattctccttccttttctatccaattgcaaagagctgtgctctaaaattataaattcattacaaagttcaggtaatgaatggattgtcttggctctcctcaattccaaattcaatcaagcaccttggaactcaaggtaggctgaccccatgtacagaagctcttcctcttcttaacgtacacatttctgtagcaacctccaagtctctctgcagttttctttctgcgtactgttagaatgttggactatgtttctcataaataagactggtggtctctagcaacatttataatcaataatcctttcccatcccactctctttcaagaggcactcattgactcaaaaaaaaaaaaaaaaaaatcccacaggaatgcgtcagaagtaaatgtgggaaatacatgctgaataacttaggcctatgctatccaatatggtagccactcatcacatgtgtctgttgcacacttgaagtgtggctagtcagagttgaagacttgatataaaagaaaaaatataaaagatcacattaatatttttatattatttacacattgaaatgataatattttggatatatcaggttaaataaaatatttatttaaattaatttcacctgtttcttacttttttaatatggctactctaaaactttaaattacatacatggttcacaattatttctgttgagcagtgatgatcttggactacctacatttcacaaagagatatgatgtttctcttttagcaccctatcatagaatctaccatactatattaaagatatctgtttacatgtctgtctcatcattattaagcactccaaaggcaggaacaatgccttctgcatttttctgtttctggtacctaactctgtgattggtagtcaggaagtactcttcattgctgataggagtgtacagtggtaaagtggctttggaagacaatgttgatatctatcactatttaaattgagaatattccttgaccaaggaattctacttctaggagtctgtactaaagaaataatcacatgtggggcataaaggggcatgtgcaaggaaattcgccattgcattgttaatatattgactttattaatgtagttaaaaattagaacaaccaatatacccatctatggaagagtggtacacgcttactatgaaatcctttataagaattaaaaggactgatactgagaaattatcagattgaaggaaactaaggagacatgatgactaaatacaatatggggatctagaaagaatcctgtaacagaaaagactgtggaaaaactggagaactctgaattaaactctaagtttagttaatagcctcataccaatgttaatgtcttagttttagtaattgtactatgtgcaagatgctaatattgggagaagctcagtgacaggaatacagtgattctgtgctatatttgtaacttttctgtaagtctaaaattatttcaaaataaaaagccaaaaagagagagaaaaaggactgatcaagtgatatgctggagctggcttatactggtttacaaaagccaactgtgcacatctcttcccaattccacctccaatgactttatattggcagttgaaattgaccatggcaggtgtatttacatcctgggaattaggaaatgtggcagatcaggctttttgggccagagagcttgttaaacatttatcaacacatcactggatgatctgtatgtactgaaatgaaacaagctctaagattttatgaaaaatattgtagaacaatgcatattctacgatctggttttagtagaaaatatgtatttatatatatttacattttttaaatgcatagaaagagacctgaaaaatgaataccaaactattgatgtttagagtagggagctgtgaaaaccaaaaggatactttgacattttcatagtattgttagaatcttttacaatgataatgtattcatgtattattatataattttaaaataccaggtgctcaacaaacctttgttaagctgaatgaatagtttcattgttttattctatctcttttattgctattttctgtctaaaattgggcttttcaaaacatttcaaagcagcagaaccattcagcaattaaatatgaacagttcccagatacataaaacagataaaacagaatttgactgaaagggattggctgtccaaaagatccaaataatatagtttgaaatctagtggcctacaaaattatcttcaaaatatctgaataaggaaaatttgggtgttgggaagaattccttttaggtatttaaatttattgaaatatctttatagtgctactgtcaggagacaggaccccttttcatgttattatgtatcttttggggttttgtgtccactctcttacaggtaatttttgaatacacctaacaataaatagggctttgataataaatatacaagttaaccttgaaattataagacttttaagacaaatgtaactttgctttcaaggaattcatcttgcaccttgaaatgcaaagatattcagctaggggtgttatatttatttgttgcaagaattttgggtttttattttctaaatccactaaataaacctatttagaaagtttgaaacctatcttacaaataaagtcctgaccattatggatcatgtcctgcttcgcagcatgccaagacaaaagcatataatattttctaagatactttgttttccctttttgtcagcattctccccctactagttcccttcatgttccttcaggctagggaatgctacagctgttgtactttacttccaaggcttgtcaaaactacagatctgcttgtatgttggacagttcccttcctgaaatatatacgaagtacattacccagatggtgacccctgatgacttcaggctttcaactaactcccgtgggaagcaatttcaccagaccgatacttcagtggccatgatgtgagactagatgcttctgcaataaggaatatcactgcaaaaataaatgctacttgaattaaatgcagtgactgccaacattacagaaaccaggttatcttcccatcttaaaataaatcccatttttattacattaaacatcaaattggcatatgagtgaactatagccctttgataaattaccttcagatctgaattttatcctgataataaccatattacatgcaggattgaaaactattagtttcagagaagcatttttcaagaactaaattaaagaagtaatgcatgtttatttatggtatctactattgcctcagcagtttcattcaacttttctctttttttcctagggctatacatatacattttatactaaaaatattatttgtgcttgcactacatcatgaacataaataaaacatacttaaatgtttctttttaaagcaatttaaatgtagtcagtatggttttgaggtctctttcaaacatttttgaaaacccgaaaagctgttgtgtcgtatataggtagaattccctttgaaagaaagaacttcgctaattaaaagaaaaaaaacaaaaggcattttaacttgaactgttttacaaaacacattttgcaagtctgccatgatgaaacattaaaattaaatgccaattaagaaaagattgagatagtataacagagcaatgaggacaccttttttgttgctccacgtgtttgaatccctacttttcctctcctaaatgaaatgaattattctctattgcagcatgcttttttcttttgccttagtatggtgctagttttatccaatactcaggatggaaaagatcctatcagagtaataaatcattttaatatcccagttctgtattatattatcttaaaactttcatttactacgtattttatattttccattccaagactacagcaatatttataaataacatgtctagttaggtaccttatcacaagtttaatatatgatctccatttgcagttgcataacgggcccatctgtgtattccttatcagacagacacaattatttagtggtttcatctcaagtcacagcaccattaagtgctctccataactcaaatcttatttatttttgtattattatttgctttgtggagtcaggaagaataagcagcataatgatgggataaatttaaaaaacagtttaatgaataacgtagcaaaaatataaatttagacatgaatcagtacttttaattcttctttaaaattttattttttttctattttacttcattttctgctcaactaattctccctttctctatggtccaaatcactgccaatcacttcttcattattgatgatgggagtttctcagattcctaaatattctcctactctctttcctggtttgagtacttattggcaatagtaaccaggttcttttaaaaagacccaaataaaacttgtgactatagagagtaagaaatagacatacacagctatctcttcctcttacccatttgacctgtatattatttaaatttttaaaatagaaatgtattcattgatttatatccacaacctctggtagctgatactttgaaactcacttttctgagttagcatcatgtaatcatagccataaatatgtggtatgtgtccttctgcaaacttttagatattggaattttaaaaaccctgtcattaacttattattcacagttaacgttaaggagcagggcttataaaaggctgggaagacaggatatgatagagaagatggaaaacgatgagtgatgaaaaactatgaaaccttctcatctgccttataagatgtgaacagatgaggaggtagagagagtgaagtggtgattataaggacccagtttgttctgggttttctgaagtgacaccatgacagtgttcttctgaaagagtcactaatgtattattcaaatggggttgattcatgatccggatcctcaagtcttctcctttaatgcagtaattatttgttggctggatcctatgtattagacattgtcctagttgctgaggatacaacacttactgtttggttgcaaaaagaactggccctgttggggatttcactctgtgtaaagggaggcagttgtcatatggtataataaagagcagggactctggagccaaggtttcttggttcaaatctcaactctgctgctaactagtgtgtgtaataatcttgggtaagttattctctgcctctcagtatcttcaccataaaatgtgcacaataacaacatctgcataaggttgttgtgaacactaaatgagtcagtatatgtaaagtacctagaaaaaaatgcctggcacatactaaatgcccaataaaggttagcaatcattattaagcctgtttaattgatccctttacaaaaccatcctggaagtggagaaaggtagaaagtcattgactcattgaattctctactttcctgccctaggagatgattgtgtagttgtgattctctgaagagagtaacacagagggcctccggtctttgagagaacttcagctgccatcttcacacagctgtagagttaaaacaaaaacctcacctaatttcctgattccaaatccttgacttaatatacaacagacattcatttatgttcccatccccatcaacatcccccaaagctgcaaatttctttaatttcctttcctctatcatcagggcactggggatctggaagttgtaggttttgggttttcttggtaaaaggattccagaaattagagcatccctaagattttaaaaggtatcatcatttcttagtagagtacactttttataaaggttagcataaagcagttagagtctcattttatgaataataactgataattctcacgtagctatatagtatgaaatgggtcccaagaaaactttcagctgagttacccagcacaagtatgcaatcctgggtgatggattctactctatcaaattgatctgcacaagtaagggaatctgtctgcaacaataaaatcatgctatgttagagctcaaaaagaccacagagtaatccagtatggtttagaaaggagggggccagtacatttaaagtgaagaagcctggaaaacactacctcagctgggttatcatcaatgatagcatgtacattatggcacagacacctgatatgatgcaatgataatggcacctctgtggtcttcctctccaaaagcatactgccagtttaaacataagcacaacatcagcaaaacccaaattgaaggacattaaaaaaacaacctggccagtgctactcaaaattgtcaatgtcatctaggtcagaaaactgttatagaccatgggaagataggaaaacatgacacgatataatatcctattttgaattggatcctggaaaagaataactggtgacatccaaatgaagtgtcaaatgcagttaagagtaattattgatgttcatttcctagttgtgacaaatgtaccatggtgatataggacgttgacaatagaagaaactatgacagcctttgtactatctaaaaaaatatatgagaaactaaatgaggagtatatggtaattctctgtactatctttgcaacttttctgtaagtctaaaagtgttctgcaattaaaaggatattttggaaagaacacaccacacacaagccatttgcctcaatctcctcattttacagaagaggaaaataacacctagagaaaggaaatgctttgcacctaggacacagagagctgacactaggaccctatttttctacctcagtcttgtttcacccaaccacactgattcagtcttacttaaggccaagagaatacgtaatccatttcttcttttcaatgacatttagtactgaagtaatttgactggaatatcggactaatgaggccaatgttataggttaagtttttattccaacccgttacttttgcatagggaaaaattccactatttgtcatagcctgattattcaagctattttttccatcaatctcaggtaagtacataagagagaaatgggaactctgtaaaaaccctccaattcaaaatacatgtacatctgcaaaatctttttataatgacacttaaattttattgaattactgggtcacatgtagctgaagtaaaatacactgtatatattttctactggttctacaatcttttctcttgtctacttcaatcttcttagcatttttgtcaaaatggatcactttgttgtcctaagctttgctcactatttttgaaaaagatgcaagtttctctttaaagaaaaggtaggcagtgggaagttaactcaatttcatatcacccctgaaaaggagtcaaaattttttcttaatgtttcctgaaatgctttaccatgatatcaatagatgtgggaaaataatatggcagtattttagtttcattatttttgtatggtttgaaactgtaattttggattttaaacaatgttaaaatatgcagtttatgttaaaatcttcaatatataaaatttcttataaatcaataaatatcagctgcacctttcaatagaaacatggacaaaagacatcaataggcaattcacaaaaaagaaatggaaattaacagagacaatttaaaatattcaaccatagtggtaattttaaaacgcaaattagaggagtgatgtcaacagtatggcagaataggcatttccagtgcttgctccctcatggaaacatcaacttgaacaatcattcaggctaaaaaattccttcacaagtgctaaggaattcaggtgagagattacagtatctggtggaacacagacataaaaaaagatgcattgaagagtgtaagaagaatagtttagcattacctgcaatactactctcccaggcttacacagcacagtgtggagagaaataccttccatgtggcagaagagagtgaagtaaacacctaacttcactgtagaacccagcaccatgcccaccccagggaaccctggtgccaggctggcacccaatgaccaagcttacaggcctaccctagtgataggcaaggcctcaaggcctgagactccaggctggtccacatagacccaagctccaggccaaccactaaacatggctggtccctgtggctccaggctttaggctagctccaatggactcaggctcccaccccagtatcaggctggttcccacggatctgacctttagtaaagccactgccaacccaagatccaaactcatcatagcacaaggatggcccttatagccctaagctgcattcattcttcatggcccaagggtttaggcctaccctagggccaggccatcttccatggccccaggtaccagtctggcactggtgaacccaagctccaggctcaaccatcattactgacccaggaaccggggtgccattactgacccatgcaccaggcttaccagcccaaggatttcagcaaagccaacccagagaccttccctgctggtccacacagaatccctggacaagctgacaggtgaagagcttctcctggtgaagccagtctttaatgactggagaaggtgccaatgccacaggaatcatgaataatcagggaaacatgacatcaccaaagggaaagcaaaaaacaaacaacaacaacaacaacaacaacaacaacaacaaagcacctgtaaccaaccctaaaaaaatggatagctataaaatgcctgaaaaataattcaaaataattaacttaaagaagctcagtgaactacaagttcagtgagctacaagagaacacagatagacaagtgaataaaatcagaaaacagcacgtaagaaatatgagaagctcagcaaagaaatagaagccataaaaaaaaatccagagctgaaaaacacaatgactgaactgaaaaattccatcaacagcttcaacaatagtcagtgaagcaaaagaaagaatcaacgagctcaaaggcaggtcatctgaaattactcagtaggaggaacgaaaggaaggacaaatgaaaaagagtgaagaaagcttatggtctcttcaagcaaatctgtttttttttttttttgagatggagttttgctcttgttgcccaggctggagtacaatggcatgatcttggcccaccacaacctctgcctcctgggttcaagcaattctcctgcctcagcctcctgagtagctaggattacagggatgtgccaccatgcccggctaattttgtatttttagtagagacagagtttctccatgttggtcaggctagtctcgaactcccaaccttaggtgatctgcccgccttggcctcccaaagtactgggattacaggcgtgagccaccgtgcctggcctcaagcaaacctgtatacacattatggaagtcccgaaagagaaaataatgagaaatgtgtggaaagattatttaaagaaataatgactgaaaacttcccaaatctgaagaaggaaatgaaaatccagatgcaagaagcccaaagaatccaaaatagaaatagattgaacataaagagatatatactgagatattataatgaaattcacacaagttaacaacaaaagagaattttgaaaacagcaagagaaaagtggcctatcatatacagagaaccttcaaaggaatataagtggatttctcggcagaaactctgcaggctaggagagagaggggtgatatagccaaagtattaaaaaagaaaaccctaccaactgagaatattataactggcaaagctgttcttcagaaattcaggagaaataaaggcctttccagacaaacaaaagctaagggaattcatcaccattagatctgctattcaagaaatgctaaagggtgtttttcaacctgaaaataaaggatgctaactaacaactaaaataaatattagaacatacaaaagcataaaattcagagcttgattcagccattcgacaatatatacatattttaaaacaatatattgcttatccctgatgaacattgatgcaaaaatcctcaataaaatattggcaaaccaaatccagcagcacatcaaaaagcttatccatcacgatcaagtcagtttcatccctgtgatgcaaggctggttcaatatatgcaaatcaataaatgtaatccatcacataaacagaaccaatgacaaaaaccatgtgattatctcaatagatgcagaaaaggccttcaataaaattcaacatcccttcatgttaaaaactctcaataaactaggtattgatggaatatacctcaaaatagtaaaagctatttatgacaaatccacagccaataacatactaaatgggcaaaagctggaagcattccctttgaaaaccgacacaagacaaggatgccctctctcaccactcctattcaacacagtattggaagttctggcagggcaagcaggcaagagaaagaaataaaggatatttaaataggaagagaggaagtcaaatagtctctgtttgtggacatgatcctatatttagaaaacctcatcgtctcagccccaaaactccttaagctgataagcaacttcagcaaagtctcaggatacaaaatcaatgtgcaaaaatcacaagcattccatatgaaaccaaaaaagagcccatatagccacgacaatcctaagcaaaaagaacaacgctggaggcatcatgctacctgacttcaaactatactacaagaaaccagcatggtatcaaaacagacatatagaccaatggaacagaatggagacctcagaaataagaccacatatctacaaccatctgatcttcgacaaatctcacaaaaacaagcaatggggaaaggattccctatttaatgaatagtgctgggaaaactggctagccatatgtggaaaactgaaactggaccccttccttatgctttaaaactttaactcaagatggattgaagacttaaaagtaaaaccccaaaccataaaaaccctaaaagaaaatttaggcaataccattcaggacataggcatggacaaagattttatgatgaaatcgccaaaagcaattgcaacaaaagctaaaattgacaaatgggatctaattaaactatagatcttctgcacagcacaagaaactatcatcagagtgaacaggcaacttacagaatgggagaaaatttttgcaatctacccatctgacaaaggtctaatatccagaatttacaaggaacttaaacaaatttaaagaaaaaaacaaccccaccaaaaagtgggcaaaggacatgaacaaacacttcttaaaagagacaaagcaagacacagaaagacaaatactacatgatctagcacacatgtggaatctaaaaatgtcagactcatagaagcagagagcagcgtggtggctgtcaaggactgggggtagagaaagtagggagctgatgctcaaagggtccaaagtttcagttacacaggattagtaaattctcgaaatctaatgtatagcatgctggctatagttaataataatgtatacttcaagattcctctccactcctctcctctcctctcttctcttctcatagcatgctggctatagttaataataatgtatacttcaagattcctctccactcctctcctctcctctcctctcttctcttctcatagcatgctggctatagttaataataatgtatacttcaagattcctctcctctcctctcctctcccttctcttctcttttctcccttcccttcctttcccttcctttcccttcccttttttttcttttcttttctttcttttgtccaggctgacatgcctgggatgtaggctcactgcaacctccacctcccaggttcaagcgattcttctgtcttagcctcccaagtagctgggattacaggagttttcttttattttatttttcttttatttttttttaaaaataagtacaatttccactttatttttctccagagagtagttttccttcagtctgtaaggactcagctccttacaggggccttggttggggccatggggaagaacccacaggtctaaatagtggtaggggtgtttagtccttgcaggcttcacgagatcaattcctgactaccttgctgtgaatggtacaattcgcacagcaatatagcttcacatacagcttgggaaacactgtgagcattgagggctcacttcagaaatgtccctcactgctgtggcctctgctatgtttttaatgacaaacttcttaatagccttattcctgggcatgcattgagcacagttcttgcagtgaacaggctgcaagtgaatggcatgaccattgttccttctttcctttggcattttggaagcaaggatcctacttgaacatttctaagagagtggatcttaaatgctctcatcaccgaacaataaaaggcaactatgagggtgttagacatatgaattaatttgattatagtaatcgtttcatagtgtatactgtatgaaaacatcacattgcgtaccttaaatatacacaatttttgtcatttacacctcaatatacctcaataaatatggaaggaaaatgcaaactaagacactgaaatacccttttgcctatcaaaatggcttcttttcttttttataaatgatgatgtcaaaagttttccagagttcagaggaacgaacaccctcacatactgctggtagtgtaaagtgttgcaaaaatgtttggacaaattggcaatatatatccaaagtgttggattttttaaaaaatatttttatcaagccatttaatgtttagaaatttatggtaagaaaaaggtctgaatagatttaaaacattggtattcagcgtattgtatataatagcaagattttgaaaattactcaaatgtccaacaaatgggatcagttagacaaatgactatatacaatagaagatcgtgttgccattaagaatattacagaaaatatttcatgatagagaaaaatgtttacaaagcaagtgcaataaagcagtatataatatgagctccattttagaggctgtttagtgtaataagtgagggcacaggctctttttgtgtcagacagattcgaagagtaatggctcttctatttattagctatgtgatgttgtacaagctcctaagctctctgagtctcagttttcctatatgtaaagtagaaataatacaataagccctccttatcagtgaggaatatgttccaagacccctaatggatggatgaaaccacggatagtaccaagctctacatatactatgttttttttttcctacgtgtacatgcctaggataatgtttaatttataaattaaaaagatgaacaataataacaaaatagaacaagtataacaacataccatgataaaagctatgtgaatgtggtgtctctctcaaaatatcttattgtatgtaatattttcagaccatagttgaccatgggtaactgaaattgtaggaagcaaaactgtggataaggcagtactattgtaatacctaatttggatgagactatgattatgcataaagggacctacatgagttaaagtagaacacatgcctatttctagaaattaaatgattaatttttccatattacaaatattaaattctttttgttgttgttcagtgtataatcaattaccaccattcttctttctgacactcaaatttggccaaggggaatcccttcaagttggctcctgtgtcattttggcatgcctgaacacttccttgctttctagcacaagatatcccaggcttaccttatacttactttccctgccacagacctagaaacagccaatccttcaaggagattttggtaggaaatgtatttagaaatcaaagtttgggtataaggtgtattaattactactgaggtgttattgcttttaagtcctttcagaggacagactaggaatatacaaacaaataaaaaaatttttagattttataacctgctttgttagagtgtgtgtgtgtgtgtgtgtgtgtgtgtgtgtgtgtgtgtgtatacacacatatatgtggattgctacagtttggatgtttgaccctccaaatctcaggttgaaattggattccaaatgttgaaggtggggcctaatggaaagtgtttgagtcatgtgagtggattcctcataaatggtttcgtgctatcctggcagtaataagtgagttatcttcttgttctactagttcttgcaagtgctggttgttaaaaagagcctggcacctccctcttctctctcttgccttgtgatctctgcacacactggctccccttctccttccacgatgagtggaagggctttgaggccctcaccggatgcagatcctgtgctatgcttcttgtaaagcctgcagaaccatgagccaaataaacctcttttctttataaattacctagcctcaggcattcctttatagcaacacagactaagacatgcatatatgcagtttaaaagcacaagctcatatatatatatatatccccaattctaatccaacacttcagagttcttctttctcattccatatttttatttccttttccacacaatgaaccttgttcccagtaacatcaatatatttacctgtttgcttatcctataagatgcacaaaacagtattggaattattatagcaaaaccattactagaaatgagcctactaagtaaagttcaaattttgtgtttttgtccttagaatatattcccctgagggtatacagttagagttatgtattcaaaataatgactcttcttaaactcttaaaatttgagacaaagaaaagaaaaagaaaatggaaaaaaaggcaagagatatgagcacacaggtaacaaaaaagatccttaaaaatatgaaaagatagtcaaccttactttttcttaagagaaaaacaaaagaaaactacactaagacgtcatttctaacctgtcaaactgacgattcaaaagcttgcagcacagtttgatggcaatgtccgtggagacgtaaacacgttcatacattgctggtgggtgtacgaaatggctcaatcattatcaaaaagattcatgaaaagttgccacttacagttttttacaactttcctctgtttcaatggttatttctcctcatttcttacttcgtatatatttccccttttctcttgatttcagattatttatggtctgcctacttgttaatttttaacactattttatttatctttctattatttttgtttcctactccattaatttctgctatatctttcttatttcctttcttgtgttttctttttattgatttttcagatttgttttcttttattgatgtgaattttcatcttatacaaggtttaatagtaatttaacatgtggtgtgttcgttataatttttcttagatattttaaaattttatgttttatttccccttatacacaagaattgtttaaaatttaaaaaaattacagatagaagggcttttctggtatttaaatattcttattaatttgtacgttcatttcaccatgatctggtaatgatgtttgtattgtttctaacttatgaaactcactgagttgttacctaatatttgctcaaattttgtgaatgttttatgaaaccttgagaagaaggtgtattctctaatatcagggtgtttaagttcaatacatagccatgggatctatcttgactaaatattctcccttataagtgggagctaaacattgagtacacatgttcacaaagaagggagaaagagacaccgggaccaacttgagggtggagagtggaggaagatgaggatcgaaaaactacctatcaggtactatgcttattacctgggtgacaaaataatctgtatatcaaactcccttgacacaaaatttacttatagaacaaacctgcacatgtacccctgaaactaaaagttaaaatattattaataattactattataatacattaaaaaggatctatcttactgattttgctttcttaggtcttcttctatatatttactatgtttttgtccacctgacatgtcttgaactgaaagtggtgggtcaaaatttcctaatctagtagggcttatgagtacagtattctctgagttcttgcatgtttaaagtatttttctagatccttaataattaaagaataactggtttgaataaaatccttggctcatactctttcttgagttatttgaaaattctggccgggcacggtggctcatgcttgtaatcccagcactttgggagtctgaggtggacggatcacctgaggtcgggagttcgagaccagccttaccaacatggagaagccccgtctccactaaaaatacaaaaaattagctgggcgtggtgatgcatgcctgtaattccagttactcgggaggctgaggcaggagaatcacttgaacttgggaggtggaggttgcagtgagccaagatcatgccattgcactccagcctgggcgacaagagtgaaactccatctcaaaaaaaaaaaaaaaagaaaaaaaaaaagaaagaaagaaaatgctgctctactcttaccttgctttgtctgttgtcaagatgtctaatttcaatctgattttctttcttttacaaatgactcctcccactaaaaggcccagagatgattataaataataattgaagtttaatatttttagtagcacatgactaggagttgatagttttgagtcagtttttgaaggtacttggaggtaattccaaggtattaaaggttgtgcccttcaatacttacagtcaggcctattatttctggaaaattttctttgattatagttttaaatattagttttatttcattgttttgtttttcttctttgggaaccattaatataattatatgtagtttgtatttatttgactatcttctacagcaattattttctctgatcttttcttaaacttctttctttatttcaatttcgttccctttgctattcaagtgcctttcatcattgcatctttttcattttaatatcttttctcccttcgtcatcagtcagtatagtattcattttcacgatgggtttatctttttcttcaatttattccctgagtttagtcaactctcattttgtacatttctgttctgagttttaaactttatcatttgagcctttttcatatcttcaaatgtttgtttaaggcttattaggactgagatgttttattgctgtttttttctgctttggggttggctattagaagttttttttttaatcaaatgaaatgattaattcttattttctagttccttcttatagagctttgtgtaggtgttgtctcccttttatgttcattctgaaatattttagtttcctggaccagtaataggagttgtatgtaaataggaatcaggagtttggtgacttgttagattactagaattattagttcttattaaagtgtagcttttaaaatcaataatggcttttggatagggggtttggtaggtcgcttaattttgtgattcacttttatttttgctgtatcctgaaattatacctcttgctttcttctttctcttcaccaccaagcctccaaaggacatctcttccaagttaatgcccccatgccctcagaggttgtgccttcccaaggctaccaactttacttctgtgaactttaaagtacattcctttccattttcagtagccattgctctcatatgccaggtctgagattgttcaaacagttttttaatgggagtaattcttctttttaatgggagtaatttgatcaagtctgccatagctgggccctagctctcatgtcttcttttccatttagcctctatctgactctcagtcctggcatgggctacagagacaactctgagtaatttgggtgcttatttctctacctatgtgtaatctgaagtttgtagaattatctatctcctatttatgttattgagtgggttacaggtggttttacttgcttcccttctgcatttgaatttctttttgaataagggaatggagagatttggatttaaaaggccaatgttaccctatgggaacccagaactcactgttaatatttatttttacgtttatataatacatatgcagacacacatacctgaacattgtgtacccagtatctataacacattcatttgaaacaagtctctaataatgggtatgaaatataattttactgcatgctgttctttacgttcagttccatgcatctatgagagagtcatccatggttagggccatgatttgtaactgtggataaatccaggtgtactaacagggtgactgtgttgtattcttaggcatgttttcctgcccttcacataatttctccacctggatttttaaggcttggaaattcatagtgagtatctcacttctttggcttaaagtagtgatggcaaatatatttcaacttctgagttgactctaattgcagaacctagacttttttagaattaacactttgtctcctgataaagtgcaaattacgtaacggagatataatacacttatctttgttatagccatttatacctcagtgtgagttattttattatgtggcttcaggcttagatatctacatagaaggaaggcagataatataaaagagtgaagagggtaggatgggtattcgatggactggagcgttcatggtcctatttagccccagttgatggttctcatactatttttgccacaacaaagactgaaataatacttgacacatagtaggtactcaataaatgcatggggaaatgggagaatgccgggccagggatgacagatctatttttaaagagaaacaagacattttatgtaaaacctcttgacctaagattcaattctgaattcaggttttgttaggaagtagaagacaggactaagttcctgatttggggagggaaacgcaaagggagattgagactatgggctttggtaatgaaacagaacagaactgaactgacagattgaaatagtaactgagcccatgacctcagcctcattagcgagaatgctactgaggcagtcagtgagtaatccaaatatttttatttctttcctacctactcaaatcacaaaagacatatgcactgtaattgcctataaaaaagaactatattctttaatttgctatgcatgctaacaatgaattatgcttcttttaggccaaaatatgtccctaccactggactccacagtcttcattttttgaaagtctatttaactgtgattgcccattgaacctcttatttttaaaattgagggattttttttttccttccagttaatgggttatacatttaatagttcattgattcaaaagactagattgttgcctatcagcaaaaagatttatatgatggctaacccaagttatataatggcagaatttgttcagagaaaccaaactaaaaacatacagaggcaggaaaagaaaccaaagatactaatggtttgtttgggttttgtacaatcttagaacaggctgtgttttaggcatgacaaagaaaggatctatttgtaccatctggctttcaatactcccacagtctcctatgttggtaaatcttaagtagtgctatctctacaacattctatgagataatattggagcatgtgctattatagcctggagtagcattgaatatttccagtcctttacattttcccactggtataagaactttcacctctaaagagccaaatagttcaagtaggttcaaaagtcatctgattcttcaactacttatcgactgattgaggctagatttaccactacaatcagacatttaaaaagaaaaacttcttgactctctgctaggtggtacaaaaaccagtgaactatttgttagcttcagaggattagggttcaataggtttctatgtctggaggtagcacatgatctttaacaaaaccactccatttcaaaaatttccactttctttcatagtgcaatatacttgttcctagtttcttgacagctggtatctctctctctctctcctctctctcttaagcattgtacaactagtattggcttagctgcttgttatgagtaaaatccaaaatcttttatctgctctctttatttaatattattttcatttaactccataattttattagttaattctgcaaagtatttgtggatatgatatatataaaagactgcattattgttatttgccatatttaatatctacgcttaattaaaattaaagttcaaaaccaaaggaaatgtagattcataagtgaacaaagggtaaaactgaattaagaacgttgaataatgggctatttgatttaatgaaacctatgactaccaaagagcaaagtctttgtctgtgtagcacagaatggttgcagtcaaaaatcacatttccattcatttttgaccagagctgcagctagtttatctgagagctcaaccacctcctctggtattctatgtatatatgctagcctacagttccctgatcatttgatcaggaaagctcctttaatatgagctaaatgaaatagaagcaagagtgcttttcaaagtgccagatcatatatcttttcttcctgttaagaatttcccattgtcacatccaacccaataatcaaacatttgtgaggcccttccttagaaactcttgactaagcaattaccctggaagttaactataacacagtacacaaggtctatgttaattagactggcaacgctttgatgaggctttgacgagtagaaaattacagtgagccatcttggatcctcttaatttgttcattactgtcccatagagaggagtaggagccccaaggaaggtgttcctgagaagttacactgtaatctgaaattccacgtgggtcttgcctgtatggaggatgcaatacaaactagtgctattatttaaatgctatctgtactttggtgtaatttgttaatgggcttgtaagtctacccaggaaagactactttgtgggatcatacctagacaagaatctagccttccatgaacaaatgacttagtcttagtacttctttattgcccttaaaaattactgaagatgccaaagagcttttggtgacatgagttatatctacattagaaattaaaatggataatttttaagtatttattaatttattgaataatatatagataccattacattttaacataaatgacacattttgtaataaataattatatagtattttgcaaaacccaaaaaattagtgagaatagtggcattgttttacatttttgaagttctctttcatgtttggcttaacgaaaaacaggcggactctcatagctacttttgcatgtaaattcttgtgatttcacatgtcatgtggtctctgaaaaactacactgtacactcctgagagaattacagtaaaagagataaataacacttttatggtattatgaaaatagttttactttatagatgctttgacaggtcttggaattcctagtggttgctagacctcacattgagaaccactattttatcttcaccatagaatgttttcttccaatctttctagttgtttcttcatagtctgcttagcagattccttttccctgggcttcttgaacaccagtatttcccagagttcaagtcttcatactcctttttccttcctactcctacgattttggtgtcctcaacggtagttacctccaaagtttcagcaccaaatatttaataatgttctaggtatctctacctgtaggtccattttcacccttaagcctcttccttccatttgctatctatcttgactaatagcatcaccatctacccagtccctaagccagataacaacattctctcctgatacatcttattagtcactaagtcaagtgagttttatcatttaaatatttctccattccatctcctccttctccattaccagaagtttatgctctcactatcactaatctgtattactaatatagtcttctaatttatctccatgttttcaattttacaaacccatcgtcctgcctgccaaacccaacttcaatactgccattagggtgatttttctaaatgtaagtctgagcaaataattgtcttgccctaatgaaaaaccacaacaactctccatttgttctgggaataaatttcaaggtccttaccatggcttaaaatgccttccataatcagctcctgcttaccgtcttcatttcctgccacctttctgtatctttccttttttgcttccccaggtattgcaatatatttgtatttattaaaacatactatgcttttcaacctttctgtgaagcaaatattgctgaaccctaaatggataagcctccaccctgtaagatgccacctgttagtgttgactatgataaatcagatattttgttggtgatactggccctccccactctggctgttctagataaaaatttagtcatatttctgaagtttaaaatgggttaacctgccatctgtttaaaagccattgctctaatttagtttattcttattcacttcagagtaagtatagcttaacgacttatgcaatgtggctctaaaatattcacatatctatgtatgcactatatatacaatttgggtggagagaaactgagttaaacaggagctaaatttcttctttatgaaatagaattcaagttatttactgtgaagtcatagatttcttgagagattttttttttggtctgagtttgcatgattgattcttactgttctaaaatgtcttaagcatgcaaaactccaaaatgactaacctcctgtccagtccccctttattatgcctaccagtagatctttatctatttcacagagtctcattttaattttcctagccgggctaagaaagtactgtatgagaagtacttagtagagtgattgcctctccttgagacaataatctcttgatgcaagacatatatttagtatctactacttgttcacccaataaattatttctcttactctgtgtcttaaatacattctggagttctaagaaaaaaaaataagtgcagtatttgcctttcaccaagatgcccttagtctgaacaacaggacctaactctgattctagaaattagttttatttgacatggattcatcatgtcattttagtatgtttaatttggattggatttatacttttatttatgacaggcaagagtgccacttaacatggtggggataaaacttatggaatatattataccaaaaggtgatgtaagaagagtctataaatcttttttaaagaaaggttctggtaaatgcatggatagcagatttgtaattagactgaagtcataccaccattttccagatccctgcttagagacattgctagaaggttggtagattcatgaataggaggaaaagtcaatgctaatataaaaactgtcagtattatcatgattgggtctataagagtgaattggaagaagtaataagtattaagcatgacagcaaaaggattgataacggtctataggataatgtgaaatgctttttagcattttatgctgagtcatttcttgaatgttataagctgtaatgcattttaatgaaaacgtgtttcaacctagatatggccttcagataaaaatacaaaaccatttgaagggtcaaaacatcatagaagagggatattagtaaaataaaggcaaagtgacagctatttcagaccaggcagaaggaaacaacaaactcattagaggattcttgtgagacagacattcatgctctgaaaaattgttttagatgactttggaaagaagggaaacaaaagcagttcatgttaggatgaattatatcctcattacccttaccccagctcaaactaaataatcttcataataattctatttcactaataattatcattaatctttattcagctgtgctaagcaatgtcctgagtgttttacaagcttcaactcatttaattataaagacaatccttgaagaaagtattatcaacattcccattttatagatgaggaaacgtaggcacagaaagattaatgaagttgctagcactataagtgaaagagttgggctttggtaagcatatttatctacatttagcaaatactgtgtgagggagcatttttatatttagatttaatggggaaaaaactccatttctatcctctctgttaaaaaaaatctaaattcttgaattttccaaagtcagcacatgccacagtccactttatgtcttccctgtatagtgaggtatttgcactttctttttgaggcggacaaaatgaacacacaccactcctttcattctattattttcagcactcttttactccactgtagtaaacccccaaaatagggcaatttgggccagtgcaaagaggcaaaaaaagcacttgaatctatgttattgaattttgctgcagagagcaacatgaagaaggccctttgccctcttgaatagtttcatctctaacctttggatcagagaactgggtacaaaactctatctcttctagttctatattgttaatatccattgtggtcagctttctacatgtaggctatatagtatgtcatgacaagatttatggactgaaattatttcatctgcacagttggaatactacctgtatcccctgaaggtggtatggattgctactaatctcatggcaaaggaaaaggatcatccatgtcattaactaatgataatgggtacgagagccagaaacccctactcttcagctcattcaatgtaacagcgcacttgaccccaggcacaatgtattcatgtgagtttccatgtatgtgagattctgtagcctcttatacaatctgctgactgtgaagaaacttgatcaaaacatcaaagattgccagagaagctgtgtttgtgcccttcacaaccactgatgaagtaccttaacctcgccttctcttgacaccttgcatatggtcatctgtcttcctgactactacttcatatggcttatttgtaaattcaagcaaatgtgcttctgactggcactgatacatcactgatgccaaaatatcagaaaagatgaagcataaggacatactttttgattcagatggaaaatattacagatttacgaggaagtgatgacaatagccattccatgctatcttcatataatcagtatttttccatgcctctcttcaccaacttttttgaactcaaaacttattcaaaggaatgatttttttccctgatccaaaaggtatagtgggtaggtgtggagataggactggttggctgaacaacccagctctggcttttcacgtgctggatttccactgctttccaatgaccacttacagagctataatgcacagaatgactattgatgtcccattgatatcgatgcgatttcccctagtggattgagggcagcacagcatacagccattagtatctaaaggttatgtataatggataatagaggaaaatgaaatagcagaaaggaatttgcatgggaaacagaagcagcaagtagtttcagtgaaagattttacttgggttatacagcaactgcaaatggggattgaaaaaaatgatgacttacagactcagcaatagtcgagaatgaaatggtttcatattttgaaatataatacttttttatttcaaccacagaaagccatttaaaaatcatcttgtatattacagctcttatgtgctatctttcacctgaatgcctatttatgaatttttactctatccttctgaggtggtcaccaatatggcacagatgggataaatcaagagagatttttactgacttatccagtcacataatgtccagttcatgacagaaccaggaacaaagttccagtgtttgccataaacatcttctcatattgaacccactcaagttactgtgccagcatttagcctgatatttctgcatctaaaaaatctcccagtaaatgatttcaacaaatattgcttaccaatcaaccaatcttagtggcactcaccatgggaatagatgacttggtatatctaattgaatttgtaatttaataagaaaaaatatctggtggatttattcagtagactgagaagtaaacaagttataaagtttacttcagtgctagaagagcagcaaggcctagcactcaagagtcagtctgctctggcttgaagctcagcatccttatttcttagcaaggcaccctcttaatctcaaaagtggcctctatgtgacctcttaactttgttgagcctcagtttccccatttataaaatacatatgtattgatacctatccttaaggattgttgtgagaattaaatgtgctcatacaaggaaagagcttagcataattcatttttttccaacaaacttttactgaaagggcttacacgtgccaggcactgttcttggtgctgagatacagccatgaacaaaattgttaattctgggaactagtgaattttaatcgtgaataataattatgatggtaacaatggtaatattaatgataatatttaacatttataggctacttactatatttcaggcactactccatgtgctttacttatattaactcatttaattcttctaacaatcctatgctataggtacgattttaagcctgttttacagatgaggaaatggagacctgaaaaggttaagtaactcacccaaggaaacacacctaataagtggcagaggtctgaaaaatctatgttaataactattgaactatactgtcttacttccatgccaaattgatatgccattgtttattctattaaaaaagacagtccttgaaataactgaaatgttccacttttgctgatgaaatgaataaacatacaactgaattaaacaagtttcagaatatgtaataaaattttgatatgggagtggccataataataaatttaaatagaaaattagtattaaacatggtataaacctaaataaagagcttgctattacttgagcttgtttacaccaagggttaggccttgtatctaaaacattatctctctatatagtaaaagttaatagaaaataacccatataaaagtttatctcaattgagcaagaccattttaaagggactctaatgtatttaaactttttatattattccttgttctcaatgatatatgaaaatcatgtttgagttgtagaactttctcatccttcgcctccattccttcagcagtatttctcattacaggtcaccacaaaccaaataaacacacatgttgggttatcctgaaatgtctgagataaaagacacagttttgatattatagggtaatataatccatgttaaatagaagcattgttcaaatatattcagcttgtgtgatgaaaatataaaagagagaatcatgaacatcagcgcaggctatgatcctatactgtttacatcatcagtgacctccctacaaaatatagccgtttatttacttaccatccactggtctatgatgcccacacaaactcattatgtgaacttttagattattctcattttagataaatgggaatcaaccaaatgtactttattacttaaagaaagtctaagtctctttttatctgccactcaaaatcatattcattgtctcttagtgggtaaatctgcttcaaataggtaactggggtaaacctgaaaataatttattagggatatacttggatagactttgttttctacaatgacattctattccttctaggaatagtgctgccacaaaatacacacatttcttaagtcagtttacattttagactgcagaaccactcaagaaagtaaattaatattcagtcacaataaaatgacatccagaaaaatcaatacaatttgctaccaaatgagggtgactttaatcagggtgactcaagaacaacaacatttttcctaaaagtggaaagagcaccttataactgctctctgctttacttttcaagacatagtaactaaacaattttgcagtcatttacctagtgaaataagaatacattttttggtcacagtgtaaaaatctgaattcttgggaagaaattatgtactgaattttctgatagcttccaaataactggggctttaatgaaattgctacctgaaaattccgtagcagtattattgtttaactgtaatttaagaagctattgtagattggtacttatgacttctaatgggaaaaccataacaaccttttaattgaagggaaaatggttaactacagtaattgcgatcaataagactgtgttagtagtataaatatttcttctcaaagagcattccttactctcctcagcagtatttaaggttaggaagaaaaaaaaaaaagaagaaaatcaatttgttatcatactaagcctaggtccaaatgtgtacatgccagaatcgagagaaaaaccccccattcccaccacaagcaaaacaagactttgattaagaacaaaactgaggcatgacaaaaaggacttaccaatcacataggctagtaacaaggccaaagtcactgtgattgcagtggcgctcaatgctgtgcacttccagttgcagcacctgtaaggtttgttaaaggtaaaggcaggtcgggaaaaggtgcttcgaggaagaggcctgggagggggcgagtacacggtattggatgtcagagggtagttctgactggctgcactgaagatcgcagaggaaccagatccatgtttgaacaggaaatgcctgtgaaaaggaaacacaagtttgggctataaaaagcaaagccagttgctacaaaaacacaaactccattaatttcaaacaatcatgctatagccaagctcaagagaactggatggagctcagcaacattttcatatacctaagagataattctaaattgcccttgttgttctctctcttttctttgtctttttttttcttttttcatctagacctttaagaaacaggccttgtgttccccgatttgctggctagtgagtgctaacattccacatttggtgttacacactacacccttccctttcattaaatatgatcatcaagagttgattcaaaaacagagatgcatcattaggcattttgatcattagaatggcctagacaccagtgtttgagattatcctcactaccaaactttagagactagcttcacagccatattttcattcaacattttattataaaaattatcaaatatacagccaagttgaaagaattttataataaacaatcacatactcactaactagattccacagttagcatttgactgaactcactttgtcacatacttattcatttctccattcttctctccatctgtcagtttttagttttttgttttgttttgtttctgtttctgtttgtttgtttgtttgtttggttttgttctgagatggaatctcgctctgtcaccaggatggagtgcaatggcatgatctcggctcactgcaacctccatctcccgggttcaagcaattcttctacctcagcctcctgagtagctgggactacagttcgcaccaccacgcccagctactttttgtatttttagtagagatggggtttcaccatgtcggccaggatggtatccatctcttgacctagtggtccgcccgcctagcctcccaaagtgctgggattacaggcgtgagccgctgtgcccggccagtttttagtttttaagcattttgaagtatgttgcatacatcagtacacttcccttcatatattttaactcacatattattagctagtttgatagttttacaaattttaatgtaaaatttatgcataataaaatgtgcagttttatgtgcacatttgctgtagatttgacaaatgctgtcacctatgcaacccaaacccctatcaagatgtataacattcccatcaagacaagaagttctcttctgtcttttctaggtaaatccctatttctattcccagagaaaaccactattctgcatgtttttgccaccatacatttgttttgcctcttgtagaacttcatgcaaatggagtcatgctactgtcatgtttgaattactaaagaatgattgttgagtgttcatgactattgtaatatgggcattttgtaaacagtagtaatgtattcacatggaaggagttgccaaaaacaaataaataaataaataaaattgcatatacttcttttatacaacaaataaataaaagtacttttatacttgctaagtgccaagtgttgtgctgaacactcattagtatctcttttgctctttactcttatgaaatagtctatattattctcattgtgtatttatagaaatggagaccaaaagaggttaaacaacttgcccaaactcacctagcaagtgaaggacagagccagaatcagaatctaggtcatttggggttccaaagtccttaatctttttttttttttttttttttgagacggagtctcgctgtcacccaggctgtagtacagtggcacgatctcattcactgcactccagcctgtaacttccagatctcactgcactccagcctgtaactccagctcactgtaacttccacctcctgggttcaagcaattctcctgcctcagcctcgcaagtagctgagaccacaggctgccgccctgcctggctaattttttgtattttagtagagacggggtttcaccatgttgcccaggctggtcttgaactcctgagctcaggcaatccgcctacctcagcctcctaaagtgctaggattacaggcatgagccactgtgcctggccaatcattttttataaacttttttcttttcttttttatctttaattgacatatataacaattgtgcatatttatggggtacatatgagacaggaataatatagtgtggttgcaggagaataaaaaaattccaggcagcagtttcacatgattagaggctatgggctattaagaccctgaataataggatttgaaccaagctggctaagactgactggacccaacgtggtgcgggatttgacctaggtttcacctcggacttcattatatcctcattaacatactaaatcacgcaacccaccagcaccatgacagttccagaaatacccatgtttggtgtaaaaatgggtggcaccacagttccgataaatctccacctttttacaggaattttcatgaatattctaccccttgaataaacaaaccccaaaaggtagcagctccaaacccccttgtgggtgattctctcttgagtacacttatactcccttttcttgagtgtgtacatttccctttgcaataaatgtccatacttccactattttccaacttgtctttgagttcattcttgcaacagtgtcaagagcctggacaccagctgtggccaagatcccgccagcatttggggacttcccccagcctaccagcatcacatagtgttgtttcaatacatatacatgtagaatgagcagatcaggataattagcatattcatcaccttgaccaaagtctttaatcttaagcagtctaccgtattacctggggcagtaaaataacaaaacacattcgagtgctacattttaatgtacaacaaaaaatttcactaagcataaagccaacatcaccttgtacatgtaatgtgtgcacaaatgcataaattactaacattattttaagactgacttctagcttccatatttaaagaacaaaagcatatgtatttaaagggattaaaaaaaccctatatgaatgttaatggaaaatacccacaacagagaattttgcttcagtatcatgaggttaaaaattttttaaaggactgggttgctgaggggagtacagattcacaggtctttctggagggcaatttggcattatgtatcaaatgactttaaaaatgcctattctttgatgcaataattatggctataggaatttttcctcaggaaatgatgtgtatgacaatccatataagaagccattcattgcaatgttatttataatagcaaaaaataaacatctaaatgcccagtaattgctatttcattaagtaaattattttataaacacataatgtagtactacacaatcattacaaattgcgtggcaaatgactgtctattcactgggaaaagtgtttacagatattaccaagcaaaaaaaggcaggcttcaaaagagtatgggcaacgttattcaatttttaaaggaaaaaaagtacatatgttcaaggaaaataataatttatgttacctttgtatggtaggggtattttctgaacttttctgccttgagcttgtattgattttgtaactaagataaaaaaaaagattcatgagtattagggagtggaaaacatttacaggataacaccaaccacaggaatagttggttccatttaagttaacgtgatttattgagcgcctagatgggccaggctccaagttaggcactttgtctccaattttgatccttatatgtctgtgaagttgatactattatcctaatcttctagatgactgaactgagacccaaagaggtttagtaggagtagagcggtgataatagtaattattataataatgttagtaagagataacatttgagtgattatttttgacaggcattgctctaaatacttcacaaagtattatattatttaatcttcataacaactttattacagtcgatatctctattttacagatgagacgatctaagcacagagaggttaagtcacttttccttggccccacagctagtaattgattaaactgagtttcaaacccaggcagtctggctgcagagccactgctcttaaacaatatactataacatagtgtattgtttgtgatgggaatacaggcctgttgaggcatagaataagtatgctttgtgttgaatttggcatgaggatgatgtttaactgagccacactattacattccttttctgactaataacaagaatgtgagaatgatggctacagaatcacagagttggaagggacccgcagaaatcatctagtagcccatccctctcattttgacgttagggaaactgaggccaagagaatgaaactttcttacttaaaaataacatagctagctaataggcatggatgaaactgaaatctggggcttccaaaatagtgtatttacattaccccatgctacttgacaaccacagtcttcaccagattagcatcaggttctaatcatctgggttaactgacctgggcccaacaaatactatctgttcaaacagtactacataatacacatctattcttctgtatgtcaaatgttcttctagtaaattttaaagactgtcttaactattttggatgaatgggtaagcattacaaagaaactaccctttagttgatgaaaacctaaaagagttactactgcttctaaaggcacctaatttatccccagaatgaagaaacaatataaaaataataataagattaagtatattttaatgaataagtgactcttagttgtcctcttttcatttgattgtgctgttactttaaggcttttaaataaataacctcctccgcaccataaaaagatgaatttcttttttaatgtctgcttaactctcccagactgtttttttcccctttgaccatttcatttactagtgagcaagaagtgtagcactatacaggcagcgtagggatgtagcctccctacctccccactcctgccctgtggttactttggaggtgacaaaatgtcacatattatggattcgatgcagcaacactctgatatggtcctatgggacaaaggagaaacccagcagaatgaggttcctttacttaatgtttggagataaaatcttcaatcttttgcacatttatgaaggagaataattggatttttgagacaatgtaagtgttccaatatgttggatattgatttggtttggtataatattaagaggtggaaggaaggaaaacaaaagacagagaattgttggctattatgacggcaattacaagaataatcaatatccctgagccctgtaatttcatcctgatgtacaccaaaggatttccaaatgcagtttcataagtaaaatattacagcataatgaataaattcaacagttgcagcagaacaacatttaaactaatttttatttgagtggaatccaaatcacggttctcaatgagggtagataataaaatgagttcatgtactaaggttcttgttttcttattaacaaactcagattaagattctatgctgaaagtgatctgtactttgttgtgaaccatgaaaaagagcaatgcaaatgacgtgttttgtcataggctttgcagtccattgttggaaagtcaaactagtgcctaaatgtgttttcatagtccctgaaagaagcaggagcagaaagacaaatgctcagtgctagatgttagctatgtgctcatacaatcagatcatctgtctaagcacattgcttttccctggggacctgaggatatactaaaatgttgctatcaatttcatacaattgggtttttttccacagagcaaatgataaaaatgcagttcaagagtttatgtgtaagtagtactcttctttgcatctgttttaatattcaagttcaaatttaaaaaggaaaggcaagatattaccaaaaggaaatgggcatataaagaaattaaaaaaaaaatcttcaagaatgatgagacccagtggtggtaaatgggaatataataaatgcccctgtaaggattttaaaatcatctataaaaaaggggaaaatgtgctctctatttttaaacccctcatactacataattctgagggtatctgctagcactaaataatgtgatttaatgtggcacttaaaattctataggaaacagacagaaatctatgactttctaacaacagatgcataaataaccaatgatttttttcttttacatcttgtaaacattcttatgagacgcatatctatacctatattcccttagctataagcatctgactcatttttgtacccagaagaaggaattcaacttgcttccagtagaagctgaggttgggtttttaaaaacaagaagactagaagttaataggaccaaaccatatttggatagcatagtagaatttaggtatttttttaaaaaaacaaattataaaatgaatttttattgtgataaaaagcatatggcataaaatttcgcatgttaaatttttttagtgtatagttcagtaatgttaagtattattgacatggttatagaacagatctctggaacttttacaccttgcaaatctgaaacactatatccccattaaacaattgttctttccatcctcttccaagcaaccaccattctatttgtttctatgattttgactactttacatacttcatataaggggaatcatacagtatttgtgtttttgtgatttatttcacttaacataacgtcctccaagttcatccatgttgtagcatttgacaggatttccctcatttttaggccaaataatattcttttgtatgtatgtaccatattttgtttatctattcatccactgatggacacttaggttgcttccacctgttggctattgtgaatagtgcttctgtaaacatagaaggtgtgcaaatatctctttgagatctgctttcatttattttggataaatacctagaagtaggattgctggatcatacagtagttctatttttacttttcggaggaacttccataccgttttccatagcggtttctactttacaacaccaccaaccatgtacaagggttccaatttctccacatcctcaccaatacttgtaattttccttcttctttttttttaatagtaatgattctcatgggtgtgaggtgatatctcattgtggttttgatttgcatgtctctgatgaatagggattttgaacatcttttcttttcttttctttttcttttttgtttttttggagacagagttttgttctgtcacccaggctggagtgcagtggcacaatctcggttcactgcaacctctgcctcccacgttcaggtgattctcctgcttcagactcctgagtagctgggactacaggcgcttgccaccatgcccagctaatttttgtatttttagtagagacggggtttcaccatgttggccagggtggtcttgaactcctgacctcaagtgatctgcccacctcggcctcccaaagtgttgggatgacaggcgtgagacaccgcacccgcccttgaacatcttttcatatgctttttggcatttgtatatcacttttgcttaaatggctattcataggtatttattctcatgcctccaaaaaacacaagaaaatgccatgctgggtcagccccattttcttctctaacaagaatacttagagttgttttgtggaaaagagtcattactggcaaagatatcaacctcaacatctctactaacaactatataaaggagaatttcattttatttgccctgtgattctttcttccaaatactaagccacctctgtccacatattgcttctaaacctcggacgccaagtgttgataaaaattccatgctccgtccacatcgttcataattttaagagcttttaaatgaatttctggatacctatctaagctttaattttcctaggcttaagtcttagttctataatatattctcaaatagaaatactctgtagtctagatcgttactatcgtgatttgcaaaaaaaattttttttttttttgagatggagttttgctcttgttgcccaggctggagtgtaatggcgtgatctcggctcactgcaacctccgcctcctgggttcaagcaattctcctgcctcagcctccccagtagctgggattacaggcatgtggcaccatgcccggctaattttgtatttttggtggagatggggtttctccatgttggtcaggctgttctcgaactcccaccctcaggtgatctgcctgcttcggcctcccaaagtgctgggattacaggcgtgagccaccatgcccagccgggagatcctttttaaacctttcagtggttatcatcccttctcctcttttattcagaagcaatatctgccctatctggtcaactatctctggattgcatattccttgaggacaggaaacagtcttaatttctaggtacattgtctcttacttcagaggtattcgatgaatacatattgatttgtatgatgcctttgtttcttctaaatgggtcttgaatcactatgcagaaggaacaaaggttgggtagtctaaggtaagtgttctatttgcgggcaaatatttcttggcttgttgaatgtaaaaacaactatatgcgctcatttcattttcacataatctaaaataaataaatcaaagaaatagttgattcacatttcatgtcttcttgtgagatattttagtcatgaaagaattactattaataattatactaataatttaaagataattgctgttaatgataatggcaacatcattgtccacttactgaacatctattatgtgccaggtactctgctaaagtacttcatgtgctttttctcactgaatcctcaccataatcctataaggtagatgatattatctgcatttcataggtgaggaggctgtgggtcagataataggattagatacatttcatcaggttacacaattggtaaaaggcagagttggtaatcaacttcagttttgttgattgctagaatgtaagctacatgaaagtacaaatgcctatcttatttattactgtatcttcagtgcttaaaatggtgcataataaacagcaggcactcaataatattttaaaatccatgcctacaatatcactcataatattaatcattgaggtagtatgatcttcttaattcacctggtcatctgatatttctcttctcaaagatgaatacatataaacttcatatttcactgaatatgtttttatggaatttgttttcaactcttaaaattacagaaatgatcaaatgatatcaggaggatacttatcatcattgtgaaagtgaggtaattgtcatggctccctgcttagaatgtgggggacatcagaaaagtttcatgcagtactgtactggactttcccatgtcaattaatataaacataaatataaattaaatataactaaatataaattcaacattctttaacaggatgtttagagataaattgaaagtaggagtaagggcatagatacataaatggtatagaaagaatatactacatattttacaatgtttgatcaagttgctttagtagacctcaaaactaattaaaataaataattaatgcttctcttcataataatgccctttcaagtcaccctttcattctccttccccaagttagatccatgttctgttaacccaactttaatttaaaatttgatattaaaaaactctatatcagttgaagagtaaataccaaattaatattttctattaatgcaaatgttcctgtattaaaaggctcaggccaacgtataaaaattatttacttagataagtaagcttatcatattttcattctctttatatttaatgctaatttaggttttgagataatggtgtggaagctataatcctttcaaactacaaaataatgtggaaagctattggtaggtgagcttatcaatcctcttacaattttatacattttccctatggaggaataatggaatgccaccctatagttttcagtagttcattccctaacagagactaatcaaaataggaacaaacaggtgacgcaggaaatacttgtgactatacatttaaaagtaaatcagactctaaatttcctaggacttaaaaaaaaaaaaaactcttcattttgtaaagaaactcaattacatttccctttgctgaaagtcagttcccaattttactcaacagagaaactgatgattttataaaattgatcttcagtggttacttggattattatggttatttttttctttatacaggagggggtagtgggcagagtattatacacttttattacctcttttttcatcttctcttttctttttttttccttttcttttcttttccttttcttttcttttctttcttctttctttctttttgagacacagttttcactcttgttgcccaggctcggtgcaaaggcgtgatctcggctcactgcaacctccacctcccgggttcaagcgtttctcctgcctcagactcccgttcaacttcattttccacagacatgtcttttcctggtttattttatgagccagttgacatggtatacttttctgtatcatttatttttattgagttataatgtacctcgataaggacatcttatataaaaaaaagtttcaaattaattacaaagaagtacaagaaggacagagcctaagagtttctcactaaacacttcaggttgaaaatctagatcattatgctaatgcaacttttgaaggatcttgatcaacatttggcttttatcagcttttatttctttgaaagacttattcatacatgtacattaaaggtaagaatattttataatgtcataaattaacataagaaatgccactcaaatcagtcccttaatctatccagcataacatttttcttctctaaagaacaagctggcaaaacacatgaatgtcctttgaaatagcctcaaaataaaacagccagaagcagagactgcttctcaccaacacccatgttctcctctcttcctgggcacacaaatggagtacaatttcccaaccaccatttttgttaggtgtggtcctgcgactgagttctggctaatgaaatgtaaagtgtgagcaaaagtgatgtctgacacttcaaggcttgacccctaaaactttccacccatgatccccaatctccttcctcatccactggctagaaaaaagcagacccaaatatggaaggagcctagtacaattgttacaggtaaataggcatgagtggggcaggagagggctctccctatcacccactagaaatgtccattgatggttcagcaattattgcattgcctttcaaacagtgacaaattggtagccggtgccatttcctgatagtccacacctgttaacatcaaaatgttaattgaatgtaggccccaaggagaagcaacttcctggacatgcacatcaagagacaaaaatagcgaagtatgatcttccgggtacacgccactggaaaaggaaagaaagcctcagatgggcatgtgtataactccctaaacacactgtgcgtgctcaattccaaatggtaaggaacgcactgagtatgcaggaagcccaccctaagggtagaatcatgggagagacgagcctataaagccctaggatcaaagttaaaggcacctttttttttgctctcttttctcccttggaccttcaggtgcccccttgagtctcctccaagcaaattttcctttctttccgtcctgaagacttttaaaataaacttccactcctgctctgaaacttgcctcagtctctttttctgctttatgcccctcagttaaattctttcttctgaggaggcagggactgaagttgctacggacccatatggatatgctgctggtcagggtaactcagatctcttctactggtaacacattcattccatggaatattatgcagtcagaaaatccaaagaattggtaaccacataagcatattagatatgtagatcattgtctctcagcacagagacctagacaggacatccatgatccccctatgcccactccccactgcctgcagccatagtccagaattggataaccaaacttagaggcaatcgtattctctctttctcactcagaaatctagacatagacacacaactggggaagccaagatgcaaggtcatgttgagccagagctggagttacaacattataggggaacagacaaagaaatcccatctagagtgaagcttgagaatggagcatatctctagagagaagaaaagatgagacatcacctggtcccagaaagaaatagaatgatggagagagtttcatctttcattaggcctggctgtacttactgtgcttttctttcactgtgagattactctgcatcttaaaaaaaacctttaaaaagtttaatttagttgtacaggttttctgctcccagtaactagataattttccatattgagcaagaaacagagttcatgcatatagtacaaccacaattacgtgctgtcccctcccacacaaaaccaaaagcaaaatacaaccccaaatccccattccacagacatctgatctagaagaaaacaaaaggaaatcttaatagtaagtatctttggatgatggaaattgtagttatttttcctggtgattatccatgtactttctatttttgaaatgaaggtatactacttttataaggtccgtcatgacctggcctctgcaggcctgtcagcctcactactgctattgtctacaatgccctctatacttctagccatcctatgttatgtgcatctccaaatgggccatttttctttcaggtttctgtgtccttgtaagctttttgcaaagaacaatatcagaagagctaagacatgcccccaaatagtgcaggtctaaagtaaggcaggaaatagaggacaaaaagtgaacatagggagaatgaagagtataagagaagagaaaggaatagagtaagaaaagaaatcttacagatagatatggctgtctttgcaaggttagaagatcattcgttagttgcttcaggggtcactctggtctcctttgctataggttgtttagttttgatctaaataaatagtcagcaatgacacactgtatttttccatctttatgcattaccagaaaacaagtcaattaagtatagtacaaacagggtatatattcaatgtgtcaaaaatgtatttctcttgcttaagactctcacatagaaatgcaggatatgacaagttaattggggataaaaattatatgacgagttgccattgcattaaaagtaaagcaatgcagagaggctcagatttaaatggatgtagtttaatggtttctatcccaaactataaactggagaattgtctaaacctctaacaaaggccttggaagaaaggaataggaggagggaaagatgggaagggaaaaaagaaattaagagtttgaagagtggtttgagtaaaaagtgatccagcaacaatagattttgtcttaccagtaccaggactaagttgggaaacatcgatggaaaagaatgtttctcaaactggctacaaaaaaagtgtttctcaacaggggaccaactggtccatggggaatatttggcaatgtcagtagacatttttggttatcacaacttggggaggggtactactggcatctagtgggtagaggtcagatacgctgctaaacatcctgacagtctacctccttaagacatatgtaacaagaaattattcagcccaaaatgtcaatagtggtgaagttgagaaccatttgtctaaactcttcatccaattggaacgtgaagttttgaggtattctacatctctacaggagaaaatctgtcactctgtaaagactcccagaggaagattttcatgccaggcactcctgatcttatcttcctccccaagctcacagctgttcctccttgatgctctatttgcacttgggattggtctattatccaaacaaataccctgaaccctagggccagagagcatatacaactcaccgataattgcctcaaacatttacccttactgaccaaacaaggaaatctttgtaacaataaaaaaaaattgctttttaaactgtacccctcatgaacctgtcatgaggcaaaaatccaaaacctgaactgattaaaatatgcagaatatataataatcatagcaattgaaacaacattaactcctcttaggttaggtcacttaagaaacagtcaaattcagctttgtgctatgctctaaagcttagtgactacaattccacttgagcacaggagaatttgtggaaagcaggcctgccttccactaaaatgttctctccctagttccctgctgtgtggatttgagagtgcaaagaagaaacacattggttcactttaattattcagggacagcacagagagataaacaaggtaaggtcaacgtcaagaatatagggatttcatgcactctgctgacctctaaatatgcttttgtacttggcaaatataatattaaacctggacttattttttctatgcatcattgcctatccttagaaaacaaatatcatcacggattcacggggtgcagtatagaaatggctggttgtaacttaaacctaaaccagattatatttttatctttcaataggaaacataatatgaagctgtatttatgtcatagactgagaatgacaacatgaaggaagatattgaaactgtactgcagcctcacacacagtatgacccaaggcagagtagacttctatacaaggtgttgcatcttgaatcttgtcactataaaggtgcaaaccaaaaataaaattcgaaggccccaaatcatccgaatggacccctcctcttggccaagggcatttcagagttaacctgaaaatctaattcaagccatgatggaagatggagtttaacatgcctcgttatatccctccagtgttaacatcaacatagaccttaagtctgataagaaacatatacagtctattttctctaaagcaggcatcatctgcatgataaaacctaagtctccacaaccccttattgtaacccagacattgttttctactaataattctttcaactaattgccagacagaaaatgtttaaatctacctatgacctggaagctccccaccttgagttgtcccacccctccggatcaaaccaatgatgtaaatcatacatgtattgattgatgtattaagtctccctaaaatgtgtaaaagcaagctgcaccccaaccaccttgggcacatgttgtcaggttctcctaaggctgtgtcaccagcgcatccttgaccttggcaaaataaacttcctaaattgactgagatgtgtctcagatattttgggttcacaaagggttttgttttaaaaatgcatttatttaacaaaattgtatcaagcacctattgcgtaacaggaaaaatgacttcatagactagtcttgcactggcctaatgttgcctccttaactatagttgcctgccatcatcactaccctttgacagaaagggaagtgtggtgtcttcttcagttcttcttgcctataggaaattcagaaagaatcatgactgctcaacttaaatctatctcacttgtttggggacctcacctggaattagtaaacttgcaattaattagaatccaactaactggaaagctcaattaagcaggattctttcagtggaggagcaagagacaagaagcaagtcacagaatgacagagattgtaaagccagaaaggacctcgaatatcgtttagcttcatttcctcatctgactattgaggaaaatgaggttgagaagaagaaagggatatcaaggttacatagctatttaatagtgaaattggacttggactcaagatttctaactgtaaatctagtgctttttcaaaaactcacacggggccattaaaaatttgcaacggatatcctgggaccactagacattttgtccactctacaacatccctttatacctagaacactttacaataacaactcaagcttaaatggcaaccctgatgtactataagattttcaattataaaagattaaattatgatcatttggattaacatggaaagtagattcatatttaagaatgattttcaacaaggatggcaatttgtaaaaagttctatttaaccttaagctaaccaccaaatccaattaaccagaatgccccagtttcctgggcatttaagattttaatataaatagaataaaaactagattatatctccaggcagggaaacttaaccgaaccataaatattcactgaaagacaaaaagagatggcgtggagttctttatataccagagacaaattgttatagtgcaaagagcattggattgtttgcacaggacttacattccaacaccaaatcttgctccaagaaattttaataatttaataacacatgctccacatgaatgtgttattaaaatttcccaagactcagttattttaccattaaattgggcatagtttctattatgtctactttccagggtttacagtttgaaatgagataactagtgaaaatactttggacaatagcaaattatgcgtgcatacttatatatgtacacatgcctatatgcacgcacacaaacatacatgcatacatatacagtacattatcaaatagctaagccttttgattttgacagacaagaaaaagtatttagctacaagtgtatctactaaaacacaactacccacattaccataaaattacctaagttaatgatactattcactatggtaaatgacaaaatttgaaagattagactgtcatagataaaaacaatgattttagttgaaaggtgagaaaaatatcagattgtgactattttatgccagaagaaattcaatttacttatgaagctaatatcatgttgtacttgatattttgatagtttgaattggaaatagtcatgttagcatctatgctgtcaatgcaagctctgtgcatacatatgtcactattaagtatcttcttcagtaacaagggaccgcctagtgttttttgtatgccagatagagataaaaagttcgagttctaattgtgtcttggccagtgataggtgcttgccctcggaaatatgatgtatatttgagaaccaactttagataagagtgggaagatgtaatatcacctctactgtgagaataccaaaggcaaactttttattttattttaatcctcctcccaaaggtgaggattaataaatccccagctcggccaggcgtggtggctcacgcctgtaatcccagcactttggaaggccgaagcgggcggatcacgaggtcaggagatcgagaccatcctggctaacatggtgaaaccctgtccctactaaaaatacaaaaaattagccaggtgtggtggcaggtgcctgtagtcccagctacttgggaggctgaggtaggagaatggcttgaacccgggaggcggagcttgcagtgagccgagatcatgccactgcactccagcctgggcgacagagagagactccgtctcaaaaaaaaaaaaaaaaaaaaaaaaattccgaagctctatgtccttgttgggacttggcaacctgggaagcctgtactgttgtatgggatcatgttgttttcttctgaattatgtgattatcactgcatatttctatatactttatcattaaggcaacttgatctctgactgggtctgtttcttcttgtcactcacagcactatcctgatgtctagtgtatacctcctcactaatgtagtttcccttgtattttgccttccaattcacatgaaagttttgccctgattcagtctgctctcaatctactgccccatttcaaaaccctactttaccttttgtttccattttcttagctcttaccaattcttcaaatccaacgtggtatgtggcttcaatctcactactgtacagaaattggctgcttaaaatttataattgatagagtcaatggtctcttctcatccatagtttatttgattcctctgtgatatttgaaaatcatgatcaccacctcctggaaatttccttctgtttgttctcttccgtgattacttttcagtcacctacgctggcctttctcctctatgaactcctaatacataagtgttgccatggtttggtttttggctttcttttagtcttgcataaaactccatctaggtttttcaatacttactattattacatttacctatgaaagtcttaattatctacgtccatcatgagctctggaagcagacatatctggtgggtttttttttttgttttttttttttttttttgacggagtctcactctgtcattaggctggagtgcagcagcatgatctcagctcactgcaacttccgcctcccgggttccagcgattctccagcctcagcctccggagtagctgggaatacaggcgtgtgccaccacgcctagctaatttttgtatttttagtagagacggggtttcaccatattggccaggatggtcttgatctcttgaccttgtgatccgcccgcctcagcctcccaaagtgctgggattataggcatgagcaaccatgcccggccgaagctgggttttaactgactccactacacgtaactgatgaccctgtggcatgttgttcaacatttttaagccttagttttaataacactaagttaaaataaatgtgacagttacttggaaaaatacttggcacatagtaagcaagtagtaggagaatattttttctctatttattcctttccttggactcagatccatattttcaactttttttgatactgaacatttcaaactagatggctcacgtaggtgttccaatatttccaaaataatatgcactgtctgcttccattaacttctgttcctgatttcagaaatctactctatctgtagttctctgctcacttactctgtccatgcattttgttgaacgatatgagccaagcactgagggatcaacataagaaaaggcatagcactttacttaagtttcagtgaggaacaaagacaagtaaatagaagtttttgagggcaaatatacaatgaaataaggcgttgtgataaacatattggcagagtgttatgagatcatagataaggggtttctacatgaaagttgaagtggggaggttgctatagtctgaatgtttgtgtcccttcaaaattcatatgttggccatgtgtggtggctcacgcctgtaatcccagcactttgggaggccaagacaagcagattgcttgagttcaggagttccagactagcctgagaaacatggcaaaaccccatatctacagaaaatacaaacattagctgagcatggtggcatgcacctgtggtcccagctactccacaggctgaggtgggaggatcccttgagcccgggaggttgaggatgcagtgggtcatgattgtgccactgcactccagcccgggtggcagggcaagatcctgtctcaaaaaagaaatcatatgttgaaatcgaatccccaatatgttgatgttaaaaagtagggcttttggcagggtgattaggccatgagggttctgtcttcatgagtggaattagtgtccttataaaagaggcttcaggagcctgttggccccttctgacatatgaggacaaagcaataacgtgctgtatatgaagaacaggtgcttaccagacaccaaaatctgctgacaccttgatcttggacttcccagcctctagaaatgacagcaatcaatttatgttgtttataaattacccagtctaaaacagaggtgatggcagactaggaagactcctaagaggtatctttgactcctctccccgttttcccatatcccatctagccagaccccaagtcttgcaatattattaacctcaaaaaagatcaatgttttaggggaaaggctctctccccctactagattgtaagctcattaaaggcaaggtttttatttgttttgttctctgttgtagccccagcaactagaagagtgtttggtttaaggtaggcacttaataagtatttgttaaaatttgatgaaactaaaataaattcattatattatttataatgaactgtttttcatttaaagtatttgcattatatactttctaataccctcagatatcacaccaattttttaaacaaaatagagaagcagatgttactgtttatttgcttatctgttcaccaaaggggacaattctttttgagctttcttgttctttaaataaaatactcagtaccacactttcacaattcttgcaaacatatttcaaagacctcaagacttaaccagatcttatcttttgctttgaaagctacaaacatttttgtgttatggagttaatacagaaccagctggattcttctaaagggagatgcttagtagcacatctttttgatacacacatacacacacacacgtgcagatacacattaacaccctgatagaaaataagaataattgacaggaaatttattttctgctgctttaaatatatttcatgctcttagtaaaatagacaagtatctattaacttgacatggtaatggaaatatttgttatgattcactggataagtaactttgcagtgaatgaagttgttaagaacttgtgttctctcttgttcaaaaccatacatctctgttttaaatatagtcggtatagggaagtgtataagtatatggtgagggagggcaaaatgatgggtacagagatttcactaaaatttaatttttgtttgctatactcgtatattacatcaatcaactcatttttaaaaattccctaaaacatttttagattcacatttgcattgccaagtaaatcttctccatattaaaatcagatttcatctcacctatggtgaagcattctttccctataaaatgaaacaaattatgtttgcctatggttttattttgaaatgaaactgagaatagtcagttgaaaagcatgtttaaaaataatgctgccaccaaagtaactagagactgtatcacactgatctccaaagtattgttcttcactgcctaagcacaatagacttatattttactctcaacatgtaaaacatattttaagactacagcattctctttgatgtaaatttaacatattccacacccatcatgtggtgtaggctgaaaagcttggttgagcttggttaaacaggatttataggtcatagattagttctacagcgtcttttcctgtcttaaaaagaatctttaaatctgtggctgaagatagatttttgctaacctccgtgctgttaaaggattaaagcctgagatactgttggatctaagcactgcatatgtacattttgagattttttttctccagtcattattgaaggaaaaaatttagtctctatttttccattgcaaatgttctagaaaaaaactacttataaatgttaggtatattttagcagtgctgtataataaagacatattactgctgctggagaacttacatttattggttaatacttaaagggtatttttccataaataaattactgcaatcaccattaatgagtatttcctccaaatgattcttttttccccaagatagaaactagctctggaagtatagtaatacacattggtcatataagtttcatttctgtttccattccttgccaaaatctcctttgccaatggccctggctcttcttttgtaaaaataaccctgtagactccatttaattgtcacattggcctaaagccatcaagggcagttagcctcataccaagctgcagccatctgtcagaatatgctaaaaatcaatgaagatggttacttgcactctcctgccccggcatgattcctccacacaattctgatttgtctttgtgaactgaagtggtcatgttaatcccaacaccaggttttctctagtgttgataatcacagcaaaacctttgagtaagattcattttggtaaatagatcatgattactatccattatcatcattctgaaaaaataattaccatctaagatcaggccaagcaaaattagttgtcttgaaccaacacttggccaaaaattatcatgagtaatagaatatcaagtagactctgaattaggaatttgaattgggggacagcaaagagagtaaataagagtaaacaaaaatggctgcaattccacttaaaagtgaacctggatgaagaggctgagaagcaaagggaactattccagtgctctgcagcaagggggctgtgtttgaattcctgacagaaataagcacctcttcaattaattgggtgttaaaggcaggtcaatctacttgcacataatttcatggatagaatgaaaaaaacattctatagaaaagaaggaaagcagtaaatcatgattgtgagaagctagaaaggaataaagccagtgccaggggatggacatgggaagaagagaaagaagaaaggaaactaaaatgagggtgcaaatttcatgtgcggtatgaaataatacttgtaacaaccttataaagtgagtgctattaacccatttttaagttcaaaaaactgaaattcagaaaggttcagtaatttgcctaagctcatagaggtaataagaagcagaatgggactttgaactcagttctattgttttctttttttttatgttttaaacattttagaaaatatttaatctcactaataatagcaaatgcaaactcttaaccagtcttacagaattttatcaagcagtcacaggactgtgccaccaaagccatatgatacctttgggattgaggctcatgccacagggaagaaaaagagactttctgaagaaaaaaaaaatcaaagaataaaagaaagaaaggatctgcaaactctagtatatctaaggatgggcctctggataaggaaggataatatggaagtttaacagcaggaattttagcatgaaatttagatttctggctcatagcttgagaatgataggttttcagttccagaatggttgtctctcattagtactagaaagaacatgcttgctcacagagtggccaacctggtcaagagtatttaaatggcaaatgaagaagggaaagaaataataaaaagaatagtgcctaatatcacttagataactggtgactatgcacaattttgattgtgatatgttattcccagaatgccctttcctccatttttcacttagtatcacctcatgattttagaacaaaatgatttttaggccattttctcagggaaatttcgactttccccccttctacctacctgaacacttccttagtctctactattcctaccttggttagatctacccccctccaagggttcttacctttggattacttaaatataacaaaacacttgtgatggtactgttatttatttacctttgcttcccctactacagaaagtcagtaatgcatagtggttaaatatgaagatgctagacctacagcctaggttcaaaacctgacctggatctgtcatatcctacctgtgggattttacaaagttccttaacctctctgtacctcagttgcttcatctctcaattgaggatggcaacactaaatagtacgtaccacatgggcactagcatatggattaaagaagttgattcataagggcttagaatagtgcttggcatatagtaatgctgtttagcatagttagatatcgttattgttactagtactaaaccatgcatttctggaatacagggattctcattcctcatagaagcggcagtgcaccaggaataactagtaaatgcttgctgaatgcctcgctgtgcaggacacgcacaataatccatagactgggaagtatatgtgaatactggatgtttttacagcagattaaagctattgtgtctctctgaattgtagtaactctgaattcatctacttgccagcaggtctgtgccaggctattatactgaattgaaaatagtaatatttattgcacactttctatgtgcctggctctgagtagacattttcatatattatctcattcagttctgaaaacagccccatgaggtagggtctgtcatttttgacacaaaacaaacagggaaattcaggtctatggaagttatgtcatgtgtctaagttcacaataacataagtagtttagtccagggatgttggagtacatatgcttgcacacatcacccagcctctccatctttggcaatgtgcccatctttccgggttgcaaaaaacaccctgcccccaaaatataatctagacattgggaattttgagaagaaggcttggagaaggagatagcaaggctgacgtctgagtaagggagggctcagggcagggcccaatccccaatgtactgggtagacagggcattgtttttctgaataacacagaaggcaggcagcaatgcacaagctgttttgaagattgatcacagggcagtcttaaaaagcctcacaggtatgtatcgtcaaaatgtgggagaagggggatggttctgatgatttggaacatggtggtgaaagagtatattctatttatttatttagagacagaatctccctctgttgcccaggctggagtgcagtggcgcgatctcggctcactgcaacctctgaaccatccccactccccgccggttcaagcgattctcctgactcagcctcctgagtagctgggattacagggacctgccaccacacctggctaattattgtagttgtagtagagatggggtgtcaccatgttggccaggctggtccggaactcctgacctcaggtgatccacccgcctcagcctcccaaagtgttgggattacaggtgtgagccaccgggccaggccaagtgtattctatttaaaagcatgctaagagaggaagtggaatgatgttgtatatgtttactttgaggaaattatgaatggaagggtagaaatacctttagttagataaagatagcaatagggacaaaaagtaaaataatctcttgtgttattattgctattattattactaatatttacggagtgctcattatgttcatggctgctctaagcacattgcaattaggaactcatttaatgctcacaatggccttatgagctaggttttactattatccttactttacagatgagaaaaccgagacatggtgatgataattaatgtgcccaatgtcacatgactaataggtagtggattggagagtctataataagacacttggccagaaggagacaacggatgctgattttcaacacagatcacaaaagcgtcgtaggaggaaagggtagtaaacatgagtgatttcaactccataaacatctgctagttgtatcgatttgcaaaatgcaaatatatggcaagttcccaaatttttgtgttaatgactacacctcccaaaaggtagagaaaataagaaacttgcctctctgactgacttagaaaaagagaaactggtgagttgaaggtgataggaacctttagaggaagtgaagtattttatcttagagtccataagtaccttataaggcccaaatcccagactttaggaaaagagcttgctgaagtaaagtaggtacaatttcatgccctgagatactctaatatggagatgaattaagagagttgggaagttattatattttattttttttaacctgttgaaaccagtgtgtctgtactgggtgttatccattcacattcagtttggatttcaaaagaacaggtgccaaaataaagggatgaaaaccaaaaataagtaagtttaagagggcatgatgaaaataatgctaagaagaattataccccaaatgagcctgaggcttgagaaaaaaactgctaaagatgacagaaaagtgctttttaaaaaatatatttaaaccaagaagagcaagggtaggagagacatgcaacccatgaaattgttattggatggccaatatctgagaggccttctcaactactgtactagttttctttgtgaaaaagaatgatgatagacttgaaatggtaaaatcaatatcagtaaccataaattgaagctaaaataggcaaagcagtcattaaaaggcatttggctgttctataataaatgaattaaaattctatcccagagtggtcagaggtcttggagattggattaccctgtcacagttgctaaagttttagcaactgtagtgtggttgaagtgtgacaggagactagaaacagaaaacattggctttagttttcaaaataaacaggaagcatatggactccttagactagaccaagaaacaggttgattaaatacaaaattctacaacaggttaataaaagaacagtttgtgagcgcttaggaaaaaagtagtaaccataagaaagcaagcagtataaattctctaagaacaagttatgttagacaatctcatttcatttctattcttgacatggttattagattggaagatcggtaagaatgtaagcatactatatctgaatatcagcaaggcatttaacaaggtctcccataatatggctatgaacaagatggagaaatgtgggttgttagtaaaagaatgttgcctaatagataaatgtcaccagtggcatgcacagagatctaaccctaatctggtcttatgtaacatttgtatcgataacttacataaaaaagagggaagcatacctaacaagcctacagatgacataattctgagagcaaaagcaaatagtttgtatggtagaattagaactcagcaacatttccacatgctaacaagatgagatcaaattaggccaaatcaaggctccaaatatatttccactgttatcttccataccaaacacaaaactgaaaaagaatcaactatgtacttacagaataaataaaacgtggtttagcttcagaacatgttaaacaggctttggggtttagtttccggtgttctcaatgtgtatggatagtgtcatgtggccaccaaaaaagctgatactggagtagacagcattaacgaaaatacataattagaacaagagaggtggctaattgttggtcatagcataaaatcctcagtgaatcagtcaaaatgactgactgctgagagtcccatctaaggaacatcaaatctgctcacggtccttcctcaagggacaaccatagatggccatgttgtttattttaatcacatgacttttctctccccgtagcctcagttgactatgagaataattgccagggcttgccaaaaaactgaaacacagcctgctataaaagggatgaactgggctaatcaaattccctcttagggttttgagcctacagtgaccaagataataatgcagttagcaatgggacatgcagctgaagggatgaggtgagaggtgtgaggaggtactcttggagtcatgtggtacagtggagaaaagacatcgttatgagatagtagaaactatgtggtagacaaaataaatattgagctgatggaaagaataagctattggacaaagaaacagacagagaggagcaaaaatgcagagaactgctgagtcttattaatgctagagatccacagtctttgcctttcctttggggattgaccagagtttcccgcgttcccggggactgacaacacatacactgaaaagatgttctcaattactcgaggcaacctgaatgtctctggcttcttgcaaccagagaggctaataagaacccacacctgcattcagccttgaacattacatttcaagagcagtttggacaaactggagtgttctaaagaaagagaccaggaagggagatttgaaacccattaatgtgaggaacaggttgaaggaattggggaaacatttagcacaaagaatagaggactcaagaatagtgaagggctgtcagttgtaaggggaattttacttattctgtgagaccctaaaattagatttgagaaaaatgggcagagttaagaagggatagattttggttcaaaaagaatcttctagtagttgtttgaggtagagtggaataacttaggaataagccaattacctattttggagatatttatgcaaaggcaagtggccacttagtagggatagtaatgttaccttttaattgtgtagtgctttacagtatatgaggcactttctactacgttagtttgattttcctaattaggaagtcaggcatttgtatattcatttttacagatgaggaggctgaggctcagacaggttctgttacacagttcatgtataagttcctggatacccacagttacctttattgactacatgagaaatgaacattttaaaggctatatttgaacaatgctagttgatagagctaataacgtttctggcttttaaaaaatcatcattgtgatgctaaatatatgttcaaatgtactaaaaaggtactctgttcactcttacatgaaaacttatgttcttctctgcgtcttaagaaactgagaccaattaatatattccttgcatagatacagaaggtccgtgggtgcagtttgtacaaacatgcctagatgtacatttcaaataagaataattttctctctccatttgcctgaacccattccccactctctcccagattttctgttatttggcttcaaagacgaaaggagtgtgtttgcttgtcagaactgctacttaaccatattgccctgttgtttcctcagctctctatcactaagctctgcaaatgaactaaaagtaaaatgaggaaataaccactgtttgaaaactccttgaagaagatatacattgttctttgcattttaccctttactcacctccccctttcaattaaaaaagaaagaaaagaaaagaaaagaaaagatacagggctgggcacggtggctcacgcctgtaatcccagcactttgggagggtgaggcgggcagatcacaaggtccggaattcaagaccagtctagccaatatggtgaaaccctgtctctactaaaaatacaaaaattagctgggcgtggtggcatatgcctatagtcccagctactctggacgctgaggcaggagaatcgtttgaatccaggaagtggaggttgtagtgagccaagatcttgccaccgcactccagcctgggcgacagaaggagactgtctcaaataaataaataaataaataaataaataaataaataaatacagaaactctatcactagtatagttctaattgggttattgtcaccataggtgctgactgctatatttttctcttggaatgtagcagaaatcaccctttatgaaaccatttaatctggtaagtgatggatgatactgtttcctggacatgggccatagtacttgcagtttgttgatggtgaaatattctctgatgccatggttggtatttaatttaatatgctgctaaacaacaaaaacaataacaaccagtcttaggagagttgactagtccttctctttccattccaattcccagagatcagattagaaggtgataccagacattgtttatcaagtagtatattatacccattttttacatacaaatgtctttagaaaaagtttctgtaaattggatagctataggtagaaggaaactggactcctatccctcactgtatacaaaaattaactcaagatggattaaatacttaaatataacaccagaaactataaaaatactagaagacagcctaggaaaaaactcttcaggacattggcctaggcaagaaattttatgaccaagacctcaaaagcaaatgcaacaacaacaaaaatagacaaatttggcttaattaagctaaaaagcttctgcatagcaaaataaataatcaacagagtaaacagacaacacacagaatgggagaaaatatttgcaaacaatgcatccaagaaaggactaatatccagaatctacaaggaacttaaacaaatcaacaagaaaaaaatacccaaaaattcctgttaaaaagtgggcaaaggacatgaacagacatttctcaaaaggtgctgtataagtggtcaacaaacagatgaaaaaatgctcaacattattaattatcagagaaatgcaaattaagaccacaatgaaatacgatctcataccattcagaatggctattattaaaaagtcaaaaaacaacaggtattggtgaaaatgtggagaaaaggcaatgcttatacactgttggtgggaataaaaattaacacaacctctggaaaacagtatggcgatttttaatagaacttccatttgattcatcaatgcacttctgggtatctacccaaagaaaaataaatcattatatcaaaaagacacctgcatgcatgtgtttatcacagcacaatacacaagagcaaaatcatggaatcaacctaagtgtccatcaatgaataattggatgaagaaaatgtggtatatatacaccatagagtaccacagagccttaaaaaaaaatcatgttttttgcagcaacatggatagagctgtaggccattattcaaagtaagctaactcagtaacagaaaatcaaataccacatgttctcacttataactgggagttaaacaatggctattcatggacataaaaatggaaatgatagacccttgggactccaaaaaagggaggatgggcggggagtgagggttagaaaattacctattgggtacaatgttcaccctttaggtgagggtacactagaagcccaaacctcaccactgcacaatatatccatgtaacaaacatgcacatgtatccccgaatctataaaaataaaacaaaaataaaagcttccattgtagaactaaataaggcacacaaaaaaacaaggggaagtccttgaatttcaaagaaaatagaatctatgttttattagttagtgtttttctatgtcaatataaagttgtaatgtttgatttaagaaagtgactagaaatgatgaataatttctttattaattgtatctggtgctaaaatctatcatgatcaagggacctagaactgcaaagagtagaacttttatcatgacaaagctctgaggagtcaatctagaaatctaaacatgtgaagaaaaacagaggcaaacttttttgctcaaaagaccaaaagcttcaccctaaaggcagaatttagtttttaaacttacacatatacttccattacatgaggctgatcctttttttttttaatgtttgaaggcaacttattttttcaaagaatcttacaataaataaaatagaaatgatcactcctcctccagttgtgtttgggttttcttgtaatactgcagttttttaaaacaagggacaattgcctttcactttgaggctgcagtgacagcttagataattgctttgttttatgtttttgtggatatgtgacagcagggtgtttatgtatctgcggcttcatcttttcacgtgtatctgctttggtctgtggctgtggctggatctagatgtttgtgtctgtttgcacatctgcgcctgtgaaggagtcttcctttttgcccatgcatctgggtgtgtatcggtttgtgcatttgtgtgtctctgcagatgtgtgtgatgaaatgagtttctgcaatcagtagaaccatcctctgccaatacttaagtttagtgggatcaataatagctcaagtacctggtctccaatggtatgttgctgttcaggacccagctgttatgcagatggactgaatcctgcgtgctggttgggggagctggagcagctgggctgggctggctgcgggtagtcattgatctcctctgaagagagtccgctgcagggggtggcttcctggcacaggtgcaggcatgaggaggcggaggtggcggtgggaggggtctgaaggtgaactggttgtgtgggctgctctgcacatctaaagaggagagaagagaaacataaaatagagacttactctcccacttggcagtcagggaaaccagcatgacagacttaccaggatttcagataataaaacctgtggggtgagggaggttgttttaagttcagtctatctgtaaaaatgccacttaacttacaaaagcacgtgcagcatgcttatgaaatgtaaaacattcacagttgcatttacatgtaaattctttagggctatagcagctaaaaagtaaatgaggccgcctcacaccatttgtcatagtttctgctactgaacaaataaatcatcaacaagacaccaagttacagaacagaagtgagctgatttccatcagttgcaaaattctcacttcagaaaatgctagtaaaaggcacaaatttgttgcaaggaaaatcattcggcacttcaaataaaaatataaggccaccttctggcttacctcaggaaaggatgtgagcttgcctatacgggagcaaatccatattttagaaaaacagctcacgagtgtgtcgcttggctgtgtgaaactaatctctttgtcagccccccaactagagtgctacttgtaaaaggtaggctaaaagaagtttgttcaagttgttatacatatttccatggtcatgcaaagcacagtctgcaacttttttcctttgccacacctttctaggagctctgccatgttagcggcagcttaggcagcaaggaaacagattttttttctgctcgtttgcagaggggcagcctgggacagcggtcctcaggcttctattgttgctattgcttggtatttttccattgttttcctggcaggcacacgtaaagacagtgagttagaatttggcccatgagaaatacctcaattaaacccctttaaaaagaaatcactattgtagctgatagccacctctcttccacaggagaaacataatagatgtcaagtgatttcttgtaacaccagcacgttctggataaactttgtggacagcatggccttgtcccacctcccaaatgactgagagttgaaaagcagaaaaacgccagaggctttcgatgcctagcaaaggactcagctggtttgtgctgaggcccactttgcagtggctgatcacagaaaaaaaaaaaatcacttctttcaatctttttacttcaaacttgaattttaaagacattggcatggttttttatttttaaaaacgatattagcctcccaagagcatgacaaattcttggctgtattttctagcacaggtggctctccctttaaataaactcactatatgaaaatctgaattgtacaaaagatagatagagaagggagtggtgatcattcattttataaaaaggattcctttagatggtcagctatccttgtatattttaaaagaactaaaatgtttcatgaatttcctaagtcacccccattattccaggcccagctcaaatcccatattcactaaaaaaaatcatcacaaatacttaacatctcattaactttttttaaacctctgggctcatactcataaccgtaactagaagtgtgctttccattttggggactcaaagaagcatagaatgttgaaacccaaaggactttggagatgctctcattttgcaaatgagaaaacaagtccagggacacttggcaagttagtggcatggccaggactagaactcacatctcttgactctctggctaatgctccattccctgtattgcagatctctgtaatatgagttctcttttccttcataagatttagagacaaagaattgtccacattttcttgatttttcacttaggtttattacgtctgcttttctctttgaccatgactccttaaatgtagaaaggaaggcagtgtggtgtaatggtatgcaacacagcacagtggaaagaggagaggacttggactgggatgtatggcaaatctgggtttaagttctgcctctaccctttagaagctttaacccctcatttgtaaaataaggataataataatcccttttcctaacaattaaatttaattcatgtaaaatgtgcttgagcatgcattttattgactatttctttattgaatgtaataaaagtataaaagtataaaactataaggctggaagaaatcatagggatcacctagttaagcttgcctctctccactcgccattttacagatgagaaacccaagacccaaagaggtgaactgacttgctcaaggtcattcaacttggatactttttcctgcccatgccagatgatttctttactctttttctgtacgtgtttttgtaaattaagtgacattttaacagatagactgaacttaaaactctcccccacccccatgggttatgttatctgaaatcccagtactctgcccagcactctttccattatgctacttcggaacataaacatgactctcttctatgactttaacatttactatttttgccataaatttgatccctgagttggcaatattatagcatccccatcatattctatgtgttttgccttttctcccaaaatagactgcatgtttcttagaataaggtttccttctacttctcctgtatgctgtatgacattgagcaaagtactgggtacagagcaagatctctaaaatcttttgctaatagaagagggtttgactggatcatgggacccagataatcaccttctgtgttccctttggctctcattctgatgtagccactggctatctattcaattgacagagaagtaggttttccccttgaagatcttagtggaatgcctcccagagccatgacaaaggacaatgatactctgaagaaggtgcttaaaatgatgccccttcatgatgtgaaaaaagcaccagtgacacactacagatctactgtctaatgccacgtgtgggagagcacttaatgacccgagggaagggaggaaaaggtgcaagtccaaggttagaagaaaaagaggagtcaatttgaggtcttgtgctcagaacccctctaaacaacatgcatgacatttactagcttaatcagtaggggtttctgtcagcacagttgtgcaagagaaagggtttctcttcagtacagttgttcaaaagaaaaagaatatctcattgacatcagatttattgcctgctagattacctcacaatctttgcaactctattatgaaaaatgataaaaattttacttcattgaaaagtgcaatcatagtattattatttctgttgcaggtagaatggctttgtctagtcatttagattatctacgtataatgcatatccatatacatatatggatattttgattttcatctattttactgtgtatttttatttccacatttcaaatatgtggaagtttccctgctagttcatattgtctttaaacgctttcacaatattggattgttgcactgagtggaatacatccagaccttaagcctttatgaaatgcaaatgatctcagattcattctttttttcacctcaggaaaaagatggggaatgcacttgttccctcccaaatgaagtaatttaatacttgggatccatgaaatgggatttcccaacattaaacactaatgaaaaatacattagtgttcagtgtcagaagctctagaacaccaattctaggggtttgcgagtcacatacactcacttccaaatgtatctggcaaccatacacttctgtgccccagagagaggaagggagaaggggggagtggtgattatgcaaatgtagatatccagacttacttacaaagctttctgaaaataaattaagttttcaaatggaaaggtctaattcacataatatacttggatagtagccagtttcaggtttgaggtcctaaaataacttggtaagataatttctcaggagcaaaattcctccaaactgtagatttgagacattttaagtgtggcagagctactaatagaagtataagccttcagaaacaacattgcctctgtctccaaaaggtaagtgcaagaagaaacgtgtcacgcatagttttttcttttttccttttcttctctttttgccaatacaccttattttggataatgtgttagagaaagctttcacaagaaattagagtatctctgctcagaaatactgtggcaacttatcagagtgtctatcagggtgttttgtcccttacatttcattaacatatacagtcagttctgctacaagacaaagcatgcatttctgcaattcactgcactatgcaaaatcacacctaaccaaagggttatggaaaaaatgaagttagggatgcaacattcagaaacataatcaatgacgcattaaaaaaaaaggaacctaataagaatgacagcatagtttgtcatatattaatggttaagggatacgcgaatgccataccaaatatgacactttatcttgtgaaagtgggtgccagaagagttgcaaattgtgagttattgtgaagtggtgaaaaggaaagttatctgattaggacggaaacttctaaataccagatgtggatgggacaggctcctatccacatgtggtgagctgaaatagctgatggatattgcaggtatatacatgtgcccattttgtgtattcttacgcagttcattctgctgtatgcagttttctgcattcatctagtgcttttaacagatggaattgcgcatatgcaaacgcaaaatttgtcttaagttcaaactgttctcaaacatcccaatggcaaaggaaaaaattaacctttataaaacgagcactgtagcagcactggctgtacatgcaaaataattttcggtaggtgttaaaaataaatattgtcagtattacagtaatgccaaatagacatttttcttgaaaaatttgaccaaagtagatacatggctagcttttctgaaatccatgtactaaattgatcattcttttctttagtgacactgtgacaataccttccctaaatatgttttttcccaaggttactatgcagtgtacgttgtcaaaaggggcacatatattcctatagctctagaaaaaggtcacggagagtcagaaatcatgtctgtacttcctggtcttagtatgtgtttcattatctccttggccaaggggaagggtagctccacaattctttatctacaactatggaatcaaagaatctctgaaaaatgagtttgttttcccctaactcactgggtggcaaaagctgacctgaaatgctttgaggatatttatggtctttacttatttatctaatttcataaattttggtggcaaagcctgacctgaagtgatatgaggacatttatagtcttcatttatttatcttattttgtgaattttcatacatttaggtaagaaagtattaatgcattttattaaggggtgctggcccatacctcactctgggtgagtgtatatataatatacagtatatgtacagcagcacctttgtaaaatttgaaaaattctaaattctgaaaaaagtggaccccaaaggttttggataagggattatgggcctgtattagtatttaaccaccttcctgagctcttatgaggcaatattaattaatgcctctgaagaccatataatctacacgtgcaaagaacatcagggcaccaagagttattgccatactacttatgtcagatctctcaaggccaattagaagtctttggttcctgaggttgcttttctgagctgccctccccttctaggcaggagtagggggtaaaaggaaacaggcttaaaagaaagagaagatattttcttattaatattaactattactactaactcaaaatgtatgttactacttaatggtattttacctgtcacaaagagcttttgtaacttgtgagcaggtagttttaagatttgcatgttacggctaatatccattaacttcatagtgctcaatgatcatcaaattagacttaaatgtatctggctgttctgttctcaacctcgtaattattattagaggctcaaaagaataaaaaggtaagaaaactggttttcagaagaaaataaacaatacagtttatcacttttctggctcaaataatactgctttaatattaatataccaacatcctttattaaaagcagatttatcagttaaataaaccattggattgagaatggaaataaagtccattcgataggtaatgcttaataaatacttatgtataaatgggcatgtgcatgagtgacgcacagacaacaacagaaagagtcagaaggagagagaaatagagaggagatatcacaactgaagcagatgactgaaggagaacagtcacagaggctctgggggaaagctaacaataaattacaatgttttctagtttccatgggctcaacctggttctggattactgcattctgcatggcttccacagccctggatactatttactgtttttcggattgtcaagtacatccctttgaggactttgaatggccctctcactaagccagcaggtaagatatagtatgctgtgttaatttctgtcagttaggttgatctttgttacaatcactggaaatgaaggtcaacaataaagcacctatgatcctttgacatgtttgtgctgaaattcatatttatattttagtctctctataagctgatactcatctttagagggagtgctggtctacatccagaaagtccaaattttctactttctagtttaattaatctcttttcctgttctccaatttgttgtgcaagcatacaagttagtcaaagatccacaaagcagccctcccccagcccatttcttcctgtctctgttatagagggaagccaactgtgctgtacactgtattggttttacatagtacaatcagccaacctcaggcataatactcaatattcctgccaataagtgtctggttttttaactcagtcaaacaatccaggactttacaatcaagaaaaaaagataaggctgtggtaaatgccattttgtttaaattattgtagtaattgctcaaactacctaattttcttggttgtgaaaatacaagatggatataactctgctaatatttgtagagtagtttcgtaatgttaaaaaaaagaaaaatgaagccaatatatttgtcatcttagaaaattgtcatttttctaagtagagtggtaaagagctctactttatggcacaatttggaattttaaatgtcaatatttaaacgttagtatacggtattagttagcaattaaaattagtggttggccaaagccttttcactatagccttgaaagaaactgttatctgttatgtaccatgaaacatgaaatagataattgccctgttttatcttatgttgacaatgatattgtggcttctgttattacccagtgaagtatatcaaaaagaaaatataaaaaagtaatgatcctttaaaatttcatatttagtttatactcaaactaaagtcttatgtaggtatttcaattattttcaatcttcaagttcattatttatttgcaggtaggtaatggagggttatgaattaattgacagtgtatcatttaatgaattagctaataagagatatcctgaacatttataaagttttcattttcagggctttatttttattacactgttataaatggtcaccctgtatttgttcaaaaggcaaagaatgcaaatcgctccaatgttatttataaagatagaacgcaatgtttgaagcacaaatcaggaaaacattacaactgtgtctgaagtttcaagaaaagtatttttcaagctatcatatgttaaatagtgagggcacgctatattaagaataaacaaaaaaagcaaaaggcaaaaattctagagtataaaaaagcatagaggctagggaagcctcggaaaggtttcacccttgtccaaatttttcaaataaaggctgaagaaaatgttctcgtaaccaccgttgtctggttatttggcaagaaagatcccctgtactccatagttcctctccaccagcacaactttaagaacaaagggcactcatggacacctaatggagtgatggagaggaaccctggcatctataattgggagctaaacaagtacatagccctcatctgggacaatgggaagagatgtcactattatagcagtattcacaagagccagaggattctcaaatttcactcatgttttggccctttgctccagttcagcaatgctcagatataggatcaaaacatgccaatgttttgcggtcacctgttgctataatagagggctgaaattcacaaatgatttatttttaaaaagtatagatgagtggactcagggtgatgcctctaatagtgccactctcactgagttgcatttggatgtgctttcttggatgggagagaaaggggttggggttatagctagtgataggaattgggtacaactctgatcttataagcaattgtaataagtgattttcatatccatatgcttgtaaagtgattctactcataccatgggagggacgaagacttgcttatctttcccctctgaacgacaacaacaaaaaggaaataggaagcattaaaaaaaggagtcctggtattctcatatgagtaacatgtacatgttattcaaatatgtcggggccaaaacatttttttttcagaattatgatcttaatgattgctggtagaacactactggctgccaccaatctttctgtctgacatctaatgggctagtgagggagcctcctaagaagtatgagcaggaaagtaacaattctgtaggaaggacagagaaagttttatttcccctcttgcattcaagctatgcatatacttgtcttgtatcaggatgtgagtctgaatcatctttatatctcccacatacaacccataattttattcaagtttattattttgtttatttacaaatttaattaatttgagtgaattcaaaaatttaaagtttgaattcaatcaagttttattttataaaaaagttatagcaaccatggtgggtgagagtgttttatgatgccaaataacttatttgattgaattattcacattcctaacagctgttttggcattgtgtgggcacagcctgtatctgaaaagttttctgcttgaaatgttcattgattgattcattattacaaattttcatcttcttgtttttcaacatggcattttagtgaaatgttaaatagagctattttttgggagatatgccaaaattacaacctattactaagcctatcttataaactttgcttatgctaagctatgcatatttaagtcattttatttttccttcaaagtctgattcattctctcaattacattactgcttatctccccggactcactccaatttaactaggtctttatggttccccaaacaaaatgcaacattctggatgaacatcacccagaatacaaaaaagttatctgataaattcttttgtaatgatgtcttttcacatgtagcctcaaactatgtgtagattgcacttgagacttcattaactagaatatggctaatgaagttgtgagaaggcagctcaattaggaaatatactgatctattgatatagatgtgtctgctagtggatcaagtgaaatgtctatcaagcaaattaggccaggggtagtggctcaggcctgtaatcccagcactttaagaggctgaggcaggtggatcacctgaggtcaggagttcaagaccagcctgccaacatagtgaaaccaaactactaaattatgaaatttattaattttgtacaaaaaaatacaaaattagctggacatagtggcacgttcctgtagtcctagctactcgggaggctgaggcaggagaatcgcttgaacctaggaggcagaggttgcagacagctgagatcacaccactgcactccagcctgggcgacacagcaagactatttcaataaataaataaataaataaataaataaataaaattaaaaaaaataaaaacgcaaattagtggaatctgctcatatgatattagaatgaattgaacaacagtgaatgcaggtactcccctccagcgaaatgaacataatgtatagatgccttcagaaaatgaaaaaaattagctcatctcaaggggaagagagtcagcttgcataaacagaagaaaaaaatgagaacacatgttaatgaagctgtgaatatgagactgcagtagtaaatatagatggaaatcctagaaattaagaaatgatttcataggtagtgattgataaatatgtcctttaagcaagtattgggttggtgcaaaagtaattgcggttttgccatggaaagtgatggcaaaaacctcaattacttttgcaccaacctatctcttaagcaatttagttcttcgttaagctcattcaagtaagtttttcaaaaggtactcatgtaccttgtgaaaatacatatgtatgataggtgagatgctgagagggacagtagattaaacatacattacttatgtgaaacagtttctcagagagacttcttgtagtgcctgaagtcagtgaatgaatgcacagacgctcctttctgtgtattaacactggaggtctggaccagagcagaccacagagtgtgatctgggttcctggatgggaatgatgacaacctggatttgattcaagtttgcttttacttttcttgactcccaaatagcaaacacgtaccacaaaggatagaaatgaaattaaaatgcaagcatgtatacatggttcccttttgcttcccctgtacttcatggagacaagccctcattttctggttttggtagcccacacagagtgagctgtctccccctcagggtaaaagaacatactactatggaattgctctgttttatgctcctggtctcatcagcatttggaaactgcttatgtaaagcataattccattactcaggaagccattgtcacttaggcttactgaccagctacctgatcttcaaattcttgccctggcagcactagggcaatttcctcttttccatacttacagtacaggacttagatgtttcccattctgggtagttttgaacattgtgtatcatagggctttctagtgataaacatacaaaatgggttgcatgtcaaggtatacagatatatatatagagagagagattatatatatatatatttaaattttattgttatgtgtacagaataaaaggtcaagtgctgtctactactgaactatactcttctttaaagtagggcttatcctacttataacttacaaaataaatgatgaggaagccaaagaaaaggagaaattaacctaaacgtttagggaacaccttatatttagtagtagaagacaaagaggagagtgtcttagtttcatttgtttgttttcaataaggtgaatcaagtgtagagtactttctctgctactaatttacttacttagagatatcatctgtatataacttgtttaaattagtaagtacatcataacattttcgaatgacacaatggttaagttacagatattagaatcagacctatgtcggtttaaatcacagctctgtcatttactatcagtttgctataaaccttttcaagcctttgtttcttcatctgtaaaataaggatagtaataagcatctcaatgttttttgtaagaaataaatgaggtaatgtgtacaaaacacttagcagagtgcttggcacatagtaagcactaaataatattattaaatgaatgatcaattattgagctcaatgaaatctataaaatcaggtgccatctagtaagtagcctaagaggataatctacttgactccaagacacttgattacttaaaacttctgcattatagttgattttttttcacaattttcagttttcttattttcttctaaaagttctaagaagctattattgaagtcatgagtcaatataagaacagttgacacctttcttttcctcttcctccaagccacaccaaacactctctattgatcagcttctttattatgctgcaagtttctttcacttcagataatagtctctatttcatgatttttagttaagtactctgactgtgttcacttgcattttcctctatactaaaatgatctgggggtatacatgcatttctaaagtatccattgcaataacaccttgagactcagacattagagcaaaggatgtgaagaagagccatttccatgaatacaacattagtgctttgtatttatgaagcacctttcatctgcatctttcaaagactttcacaaatattatctgatgctttattcactgggccaagctgcaagcaaaactggctttcaaataattccctcacagtacgtcaaaccccatgagggaaggagttgtggataaccgtttgaagtgtcaggaatgctcagaaacatttttaaatagtatatacaaaaataccacctaacaaacgatgacgactatttagaaatgtggcgctttgtaggtataccgctcatagcaaataaacaggaactttatcatattggcattaagaccaacatccacattataaatgaaagctatctgctcaattttgtaactgtgtatcaacctaatttgggacatacgacttgcctcatagtgtatccaaatatattcattaaagcattgcatattaattatagtatatgtaaacagcatgggtaccagaccaggattgtatgtcaaatacttagcatagtgcctggtacatgtgacacattcagttaatgttagttactaatataattattattgtaattatttccagtatgaatttagattatgaaaccaattttctttcaaagaattcagtgatgacttacatatattcacatttgttgctgttgctgctactgctacaactattacttcttttccttatgcctgttaggatatatacttgcaaagtaggaagaaaagaaaaacatgtccccttcctctgttggaacagtagaccaagatggggagaggtaaggctacacagatgttaaggcctcttcccaccttccaactgaaaccatttacacagagtcttgttgtcatgaagactatggctgtgggtattccattaaaacgagtggctaatcatttctggggggaagacagaatcaaattagagactttttataacccaaatgaaataagtgacctacaaagttttagtaaattttattggtgccatgaaaaaaataacatgaatttagacacactgactgtggagatatcacaagtttcatttacttctttttagtgtttttatttttggccctctagtctctcttattttacattcttgttcacataactggtatgctgtgaaaatggactgtttgaaaaaaagagtcattattgttaagaatgtgtaatttttaaagttttctgaggctataaataacttccacagccttgaagaaaacacagtgtttcaacattcatatgctgtgcccattttagagatggagaatatgagtctgagagatgtggagaacttagtgcaaggccttgggtaccatagtattgcactgattccatttgttgccactcagccatctctcctggccttcaaaacaaacaacaccaactgtgcttataccaatcttgtcattcctctttattgcaaacaattaatataaaatgctgagtctgaacagctatgtaataacttataatgaaatctatgtagtgggttattttatttgtaagtccgattcaatatgctcaagcacacatcattaaatgtttccttttaattttgagtagcaaatatcttcatttcagtagcacctacataatttatgtaatctatagtaacagttgttagcttatttggtgtgtcattttatcccaagttgatgctgaaaatatcagaagaggctgcttgatgggcttgctttaaaaagacaactgagcaatttatgtatgctgtttttcttcctgcacattaaagtttaaccacatttacaaatgaaatattatgtacctaaaaaaaattcttatttaatacaataactggcattcatgatgaccatctctctactatgggaaataccaaattggcttcaagtaaatgttattacaataaaaagaattatcttaaactatgagtcacatgtagggattttccttctctaaatacatgttagattacaacaatagataattatgaggatagtttagggttatggtaattcaactagaaactctagaaatagtatcactacatatgtcactcagtataatagttcttttttcattttattttattattattatactttaagttttagggtacatgtgcacaatgtgcaggttagttacatatgtatatatgtgccatgctggtgcgctgcacccactaactcgtcatttagcattaggtttatctcctaatgctatccctcccccctccccccaccccacaacagttcccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggacatgaactcatcattttttatggctgcatagtattccacggtgaatatgtgccacatttacttaatccagtctatcattgttggacatttgggttggttccaagtctttgctattgttaatagtgccgcaataaacatacgtgtgcatgtgtctttatagcggcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccaacacctgttgtttcctgactttttagtgattgccattctaactggtgtgagatggtatctcattgtggttttgatttgcatttctctgatagccagtgatggtgagcattttttcatgtgtcttttggctgcataaatgtcttcttttgagaagtgtctgttcatgtccttcgcccactttttgatggggctgtttgtttttttcttgtaaatttgtttgagtacattgtagattctgtgtattagccctttgtcagatgagtaggttgtgaaaattttctcccattttgtaggttgcctgttcactctgctggtagtttcttttgctgtgcagaagctctttagtttaatgagatcccatttgtcaattttggctttcgttgccattgcttttggtgttttagacatgaagtccttgctcatgcctatgtcctgaatggtaatgcctagattttcttctagggtttttatggttttaggtctaacgtttaagtctttaatccaccttgaattaatttttgtataatatgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaacgttagttttttccaattgtgtgaagaaagtcattggtagcttgatggggatggcattgaatctataaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaatttggattcctaggtattttattctttttgaagcagttgtgaatgggagttcactcatgatttggctctctgtttgtctgttactggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccattaatacctaatttattgagaatttttagcatgaagggttgttgaattttgtcaaacgccttttctgcatttattgagataatcatgtgatttttgtctttggttctgtttatatgctggattacatttattgatttgcgtctatcgaaccagccttgcatcccagggatgaagcccacttgatcatggtggataagctttttgatgtgctgctggattcaatttgccagtattttattgaggatttttgcatcaatattcatcaaggatattggtctaaaattctcttttttggttgtgtctctgccaggctttggtatcaggatgatactggcctcataaatgagttagggaggattccctctttttctattgattggaatagtttcagaaggaatggtaccagttcctccttgtacctctggtagaattcggctgtgaatccatctggtcctggactcttttcgttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgacatcccctttaccattttttattgcgtctatttgattcttctctcttttcttctttattagtcttgctagcggtctatcaattttgttgatcctatcaaaacaccagctcctggattcattaactttttgaagggttttttgtgtctctatttccttcagttctgctctgattttagttatttcttgccttctgctagcttttgaatgtgtttgctcttgcttttctagttcttttaattgtgatgttagggtgtcagtttttgatcttttctgctttctcttgtgggcatttagtgctataaatttccgtctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcattgtggtctgagaaacagtttgttatagtttctgttcttttacatttgctgaggagagctttacttccaactatgtggtcaattttggaataggtgtggtgtggtgctgaacaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctgtgtaggtcactcaggacttgctttatgaatctgggtgctcctgtattgggtgcatatatatttaggatagtcagcccttcttgttgaattgatccctttaccattatgtaatggccttctttgtctcttttgatctttgttggtttaaagtctgttttatcagagactaggatggcaatcccggcctttttttgttttccatttgcttggtagatcttcctccatccttttattttcaggctatgtgtgtctctgcctgtgagatgggtttcctgaatacagcacactgatgggtcttgactctttatccaatttgccagtctgtgtcttttagttggagcatttagtccatttacatttaaagttaatattgttatgtgtgaatttgatcctgtcattatgatgttagctggtgattttgctcgttagttgatgcagtttcttcctagcctcgatggtctttacaatttggcatgattttgcagtggctggtactggttgttcctttccacgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggctcccgctctcttctggcttgtagagtttctgccgagagatctgctgttagtctgatgggcttccctttgtgggtaacccgacctttctctctggctgcccttaacattttttccttcatttcaactttggtgaatctgacgattatgtgtcttggagttgctcttctcgaggagtatctttgtgccattctctgtatttcctgaatctgaatgttggcctgccttgctagatttgggaagttctcctggataatatcctgcagagcattttccaacttggttccattctccccgtcactttcaggtacaccaatcagacgtagatttggtcttttcacatagtcccatatttcttggaggctttgttcgtttctttttattttttttttctctaaacttcccttctcgcttcatttcattcatttcatcttccatcactgataccctttattccagttgatcgcatcggctcctgaggcttctgcattcttcacgtagttctcgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaactcgtcaaagtcattctccatccagctttgttccgttgctggtgaggaactgcgttcctttggaggaggagaggcgctctgctttttagagtttccagtttttctgttctgtttttaccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtaccagcagcagtggctgcagaacagtggatttacgtgaaccgcgaatgctgctgtctgaaggttcctctggaagttttgtctcagaggagtacccggccgtgtgaggtgtcagtgtgcccctactggggggtgcctcccagttaggctgctcgggggtcaggggtcagggacccacttgaggaggcagtctgcccgttctcagatctccagctgcgtgctgggagaaccactggtctcttcaaagctgtcagacagggacatttaagtctgcagaggttactgctgtctttttgtttgtctgtgtcctgcccccagaggtggagcctacagaggcaggcaggcctccttgagctgtggttggctccacccagttcgagcttccggcctgctttgtttacctaagcaagcctgggcaatggcaggcgcccctcccccagcctcgctgccaccttgcagtttgatctcagactgctgtgctagcaatcagcgagactccgtgggcgtaggaccctccaagccaggtgcgggatataatctcctggtgcgccgttttttaagcccatcagaaaagcgcagtattggggtggaagtgacccgattttccaggtgccgtctatcacccctttctttgactaggaaagggaactccctgaccccttgcgcttcccgagtgaggcaatgcctcgccgtgcttcggctcgcacacggtgcactgcacccactgtcctgcacccactgtctggcattccccagtgagatgaacccggtacctctgatggaaatgcagaaatcagccgtcttctgcgtcgctcacgctgggagctgtagactggagatgttcctattcggccatctttgtcactcagtataatagttctaatggttggctgtattaaataaatacatagtgtagcacttcataggtatgccaaaatctagtcttaaaattcgagggatactagagagctgtcttgttaaaaaatgtgaattgaatgttattttatattttatggatttggggaacttcttacacgtaaattattgtattcttcataatgtaacatactaatacactcaatttgtataacatctccatttgaaagaactgaaaatgtaagacaaacaaacaaaagcattcgaattccctaaacattttaacagaagtttgtttatacgggagtataatgagtagaagtatctgaacaacagaatttttttgaaaaagggctttaaaaatgattgttcattttgtgcagcaaaggaaacaatcaaaagagtgaaaagacaacctatgaaatgggagaaaatatttgcaaaccatacagctgagaagagattaacatccagaatagaaaaggaactcatacaattcaatagcagaaaaaacaaaacaaaacaaaacaaaacaaacagaaaaactaaacaacttgattaaaaaatgggcaaaggacttgaatagatatctttctaaagaagacatgcaaatggacagaaggtatatgaaaagatactcaatgtcactaatcatcagcgtaatgcaaatcaaaaccaccaggagatattatcttatacccattaggatggccagtataaagaaaaatggaaaataaagtgttggtgaggatgtggagaaattggaatctttgtgcactgtcggtgggaatgtaaaaaggtgcagcttctatggaaaaaagtatgaaggtttttgaaaaaattaaaaatagaattaccatttgatccagcaaccctattaaagagaatatatccaaaagagtggaaaacaggatcttaaagagctatttgcattctcacgtccattgtattactcaggacagccaagaggtggaagaaatctaaacgtccatcaagggaggaacggataaagaaggtgtggcatatacatatgattgaatattattcagccttaaaaaaggagatcctgtcatttgcacaaaatgatgaatctggaagacattatgctaagtggataagtcagacacagaaggacaaatactacataataccacttatatgaggaatctaaatctaaaatagtcaaactcttagaaagtactaatagtgatttccaggagttgagaggagggggaagagggaagttgtttaatgggtataaatttttgattttgcaagatgaaaaggttccagatatttgctatacaaaaatgtacacatagttaacactactgtaccatacacttaaaattggagatggtatattaaaattaagatggtatattttatgtgtttttatcaaaataaaaagtcatgccatttcttcattgaatggaatatttatctataaataattgaataaataattcaatcttttattttacttaaatcacatggcgatagtgtgattctgtgggtcagcaatatcacagtggacaaatgaaagcgttatgaatagggcagacaagttataatggataattacatggtcatcaacacagattttgctggtaacccaagaattgtagtgttcttaataacgtatgttttaatagatagaaatagttttttaaaaaaaaaattatttccataagcttttggggaacgggtggtatttggttacataagttctttagtgttgatttgtgagattttggtgcacccatcactcaagtagtatacactgaacccaatttgtagtctttcatccctcaccccctcctgctctttttcctgagtccccaaagtccactgtatcattcttatgtctttgcatcctcatagattagctcccagttatgagtgagaatatacgatgtttggttttccattcctgagatacttcacttagaataatagtctccagttccattttaatgcactgaattgtgtacatatatatcatacagcctattccttaatgtaaataatcagttgtatttggaaaatttgggctgtgtcaagtaatgataaaagtaaaagatatgtgcttgctagccaacaaaacctggagatatacatccatatttctaaataaataaaataataaatagccgattatcttggtttaggttgccataacaatacgccattgactgggtggctaaaacaatagaaacttattttctcacagctcagagactagaagttcaaagtaccagtgatagagacaggtgacagtcaagagtccccggcaaaaccctgctttcaagcctataatagcctgaaggctgaaaaaccagactgctggtcccggatgaagcccaccctttcacgactaattgtctctgaatacagcccacctgtgcactgggaggaaggggtggagcctcaggaagttctccccatttgcagtggggaggagcccaacctctcctgttcctgtgtggtgacctgggattcaatctgtgaagtggagggcctgttagcatctcactttgctgagttttttttcctttttgcccagtaaattccactcctcacccttctatgtgtccgcaagcctcatctttcctggtcgtgtgacaagaacctgattttagctgaactaaagagaatgttctgcaacaccagtatggttggtttccggtgacggctctattcctagcttgaagatagctgctttaagagagctgcttcctcttttcctaattgaatcccctttatttctttcttttgcatgattgccctggtgagaacttccaacactatgttgaataggagtggtgcgagagggcatccccgtcttgtgccagttttcaaagggaattacactttatacaaaaattaattcaagatggattaaagacttaaatgttagacctaaaaccaaagaaaaccctagaagaaaacctaggcaataccattcaggacataggcatgggcaaggacttcatgactaaaacacaaaaagcaatggcaacaaaagccaaaatagacaaatgggatctaattaaaccaaagagcatctgcacagcaaaagaaactaccatcagagtgaacaggcaacctacagaataggagaaaatttttgcaatctacacatctgacagagggctaatatccagaatctacagagaacttaaacaaatttacaagaaaaaaatcaaacaaccccatcaaaaagtgcgcaaaggatatgaacagacacttcaaaagaagacattaatgcagccaatagacacatgaaaaaatgctcgtcatcactggtcatcggagaaatgcaactcaaaaccacaatgagataccatttcacaccagttagaatggcgatcattaaaaagtcaggaaacaacaggtgctggagaggatgtggagaaataggaatgctttttcactgttggtgggagggtaaactagttcaaccattgtggaaaactgtggcgattcctcaaggatctagaattggaaataccatttgacccagccatcccattactgggtatatacccaaaggattacaaatcatgctattataaagacacatgcacacgtatgttcacggcggcactattcacaatagcaaagacttggagccaacccaaatgtccatcaatgatagactggattaagaaaatgtggcacatatacaccatggaatattatgtggccataaaaaaggatgagttcatgtcctttgtagggacatggatgaagctggaaaccatcattctcagcaaactatctcaagggcagaaaatcaaacactgcatgttctcactcataggtgggaattgaacgacgagaacaattggacacagagcggggaacatcacacactggggcctgttgtggggtggggggaggggggagggatagcattaggagaaatacctaatgtaaatgacgagttaatgcgtgcagcaaaccaacatggcacatgtatacatatgtaacaaacctgcatgttgtgcacacgtaccctagaacttaaagtataaataaaaaaataaaaaaacatgaatgggatcatactatttccattgttttgtagcatgtttttctaagaaatgcatttggagatctttccacgtatgtacatacaaatagaccttaatttaaaaaataatgcttccatagtattctataatataaatggattataattttaaacaactttttgtgggtattctgattacaagtgaagtggagcatcttaaaaacagtttgttagccatttaaattttattttttcatttttaaaactgaatcgcctctttataacttctgtccattttaatgtacattggatgtttggtcttttacaattgatttgaaattattacataaagcccaatatcaatccttttgtgttaaatacattgcaaatattttcttccatgaaaaataaaaagatagctgcttcctcgttgtgttctcacatggtggggagaaagtatgtctcttcttagaagggcactaatcccatcatgtgggccctatcttcatggaatgatctaaacctaatcatcccccaaaggcccaattgctaaatactatcacattggtggttagggctacaacatataaatttgggggacacaattccatacatagcaccaactcatctagataatgtattaacactaaataaatgttttcttcaactcatgttttaaaaacttgtttattttctaccatatcttacattccatattatgtgtcatgctttctaagacagatggttttaaaacttatttcttactatactttgcatcttacactatatagcataaattgattagctaacatgcctttaaaattgttatgctcacttggaactaggatatctaaattccaatataatagaacaggtcaggtctcagacattctgagtaaatgatttgttactgtatttaatcattttcagctctcttatacacagagaggtgcaaatagcattccatttatatatcattccaatcatcattctcattataagatgtggtaagttattgtgattataaagttgctggtacaataaatacttacctttaaatataaggtaaggaaaatgaggcatggaaaatttatgttatttgttgaagattacatggtcaaccagtggtgaccattgagatgagtatgcctttactccaggtcataatcactttccagctttacacataatggtcagcatcatacttgtgtatgatgctgtagtctttactgtgtagtctttacttgtgtagtctttactgactaacctcattccaaagattacagaaataaatctgccatttaacccttcttcctcttcccctaacagatatatctgcctgaaaaatcaccaaaaggaatagtggatggtcatcagaaaaggttatgtaactgacatgggaggagggtaagcacatgcatattaatacaatggaatgatgagcaggtaattgtaaacagtggtagagttgaaaaagagagaacagactagtctacaaggtttcacagaaaagttgtatgatacacagggaagggaaatggccctaatgaaagggagcagggtgcctcagtggcttgggcaatggtacgagggaatggcagagcagcagaagtaaatataacaattaagagaggggaaaaattatagacatgctaatgctgatttaataattttcctagcccaagccagctatttaattttctaaacaaacatttttgtactgcttattaagtgttaggtatgctatgtgcccaagtataatggtgaaggtgaaagtcacttctctcaaaagcgcacacacacacacacacacccctttgaaaagcttagtcagtgagaagaaatggtgagacatgaggttctttgtgtctccaggagctcatctcctattctcagctgagttgcaactactaaatgtcgcattaatccattaataatcactccacaaatattctaggtttcatgtgagaacaggtctctattgtagagccatttatatgtgtgctttacaaggtgatcagtgctatgtcagtagctgaatcaggtaataggcacagagatatctctcagatttaggattaagttggaatgttcaccctagatatagtcttctatttctggagggcattccaaagaagcaaaatatacctttctatcccagaacagactagactttgttgaatcctattgtaaccgtgtcaccttggattagttaccttctatgtcctggagaattagcaagggaaaaactgttgctggtacatcttgattatttaacatataatggttatttgcagggtttggctaaacttgaatccaacgtttataaagaaatttatgtttaaagcccttattcatgttactttatcaaaggcaatcaaattttatcagtgatcattgcttgctcttctgccttctattaagacctcaggtcctcaaaggacaatattttccagtgacaaataagtttgcctccctggagaggagagcatgactaggtagaagtggtaaatggacatagtcaaatgagtgcaggcgtggggacagcaattggtagatggtctttaaacccaagaccagatatttcaattagagaaccaattaggtacctttttatgttgctgtgaagcttagagcacactgaggagaaaggaatctgaataggtaagcaaggaagccaatgagggagattgggtggtaatatctgggtatagtgtttagggagtgtgaaagtacttagtgacagctgtataaaaatacctgcttctgctacatttatgtttgtgtttgggcttgtctgtcttgtccctcaactaaatggcaaattctaagaacagggagtttcttattttatcaatccacacactgcctagtgccatgcctcactagataagcttgtcaatggagtgacaaatgtgttccagtttctgcaaaataaactgaagcaaaggccaatggaagacatttttgaggtatgctttgtttggactgttttttttttttttttacattggaaaactattggacatttaaaaaatacgtacacatgtagattgactatattacatttaaattcaaaagttttagaacactttttgaggggttaaaaaggtatgattttggcccagtatacctttgcatatttcctgtcctgcagccacactgcaacatttgccattcaacagacccactggtgctctctccatctctgaatctttgcattcatacttgacttcccaccttgaatgtcctttcatcccatattgtttgcatcctactcttctgaggcccattaccaatgttaccccttttattaaccattctttgaaatctaaagaaagaagctacagtaatctcttctgaccacctatagcactgtttcctattatgcccccaatacctcctaagacacatgaagccaggtggtggcagaaagagaacagacagatatagaaaaaagcagacaggaggcagttactgtgtcaggaatagcagaaccctggattgaaaattcacaaactcctgctgctgaaatttctagagcttggttcattttcagattttggacatgcacgcttataataaatccttatcatctgagctagtctgagtaagtctctgcttcgtgcaatcgtccaacaggcctaatgttgtgctttgtatttgtatacttgttttatcttccctaacagaggataaagccctttgaaaggtaatgactctcatagcacctgcagtgtggtacacagccagtacttagcaaatgtttgttgaaaaactgaatggagaaaaccagacaagtcatcctcaaatcatattgaatttccatccatttttagcaaggcaagaactgaacataggtagttcataataatattttactaaacaatgctttttcaaatgaatgatttgcctgcttccctcttcactgttatagatttcttcctattagtgttctgcaaatgcgtttatgacacgtctttgccaaaggctaacttcagcagcagcaccatgtatcaaaaaagatgtgtcacatatgcaaattacataatataaagccatgcattcctctcattgttttaactatcttttagtttaaagggtgctggtctgtttcacatttctttcagagaggccaaaaacatacactctacttgaacttatgtcatttactcataacgagaaacactttgtcaaccttattttcacatacatctggtgtgactagataccgtcacggaaattatttttaacagtgaatttgaaggattaaaaggttcacgaaagtcacatgaaatacataactatgaagtatagtctcattttatggatatcacctccttacacttatatagtgttttatggtttgcaaaacactatattatctcatttgctccttacaacaggagtctgtgagatagacatggaaggcatcattcccattttatatatcaaaaaccagaggagttaactgactttactaaggccatagagattgtaagcagtaaaaagaacccagaaaaagaacccaagtctttcaacttccaatccagtatcttttgacttcaaatccagttattttcaactattctatttataacaatgttttccaaatgtctggctatgatcaattgatgggttatgaaaccaattttgactaggataaaaaatgaaatagaatataatatatcctagaacatcacatttagtaaagattttaattgtttcatgaaacttttgtttcagttttgtatattatgatgcaaaatatattttaactgtgggaaacggtgagaaaaataaattaaaagtcactgttctataccatgttgcctattaaactaattaagtagttcaagagtactttgtgccaccaaaatgtccacattattggttttaacattaaaataattgtagataataaaaatatggtttctggcaatccttgagttaggtattgtttatgtgccggtaatttcattgcttgagtgcttttaagagttctactggaatattatataaaaatttgggtttttatacaggtatgatggtggttttattactgcttttgtggaaaaaaatgctaattgtgctttataaagaaatcatcttagaaaatcttcacctgacttaaatatattcaggagaatgtaggaaacactgactatagataataccctggtattcacagatctaattcttattaaattaggatatctgatatctctgtaacttattaacagcttatttaattatatgtattaccaatgaataatcaaaatgaataaatccacaactgttttcttaattacaatgaatacaatggctcttcattatatgtaacatatagtacaaaatcattagtagggcctataaaccccagcagctttatcccctatctctctactctgcataagccacgcacatctgtgtttccacagtactgtattatacatgcttcctttgctttgatgctattgcttctcacccttctcagtggagctaggtcttaaggcatgaatggaagtcttttaggcaatgttacctcttctgtgatgctttcttccattttcctttctgtgttctcacacaacttattatctatcagaaaccaacattatcatgagtatttgtgtgtgtgtgtgttgtgtcagtgaggcagtgagttgcttgaaggtgaggtctatttattattcatttttgaatcttggtgccctgcacaatgtctaggtcatagtaggtacctgattaaatatgtgagcaaatagtattaatatttaccttgaatttacttgggcaaatgcaaaaatacataatgcaattttacatgtggtcataagaatttttagatagatctatcaatctatctattcttttttacaccgaaggctttattgttctttactgaatgattacatattaaaatattaatttaggggcagaaaattatgcttaaacttattattctgtggttcatacaatagcaaaggagctggctgatttggtctgttcaagccaacacttaaccaaattgctgacatgattttattcgacgacgtgcataatatggaccaaggcatttttattttcccacaggctgagatggtggtttagagatatagcctaaatgttagaattttctctctataatttagtcatcattgtactatgaaaaaaacctaaaagataagcaaatttttatggatagttgggtcatttaatattttctgatatggtgctattaaaatttcatttatattcctatagggttttctcctcagtgtttcagctaatagactttgaagtcccaatgtgtctatctctcctctgagggattttaaaaattgttgctctgaaaacagagcactaactttcccaacagataaaacacacgaaccacagctggagaagtgtgaacgtcaatttatccttcatagcacataaaattagactctatgattgtagaggaaggcaatacttaattgaaagatattttaatacataaacatattagaaaaccatctgtctgaggactctactgttgtgtatctatgctacaaagtatttttaaaaatatggtaggctaaaggataatcctaattcacatgtgagtttgggagataagtattttttattttcctggcttgaattctttatacatttctcccatgtatgtgattgcttacatgtctaaccttcagctaaataataagcttcagatggtatccaaatctttctcatctccagattcccagagtggtcaacaccatgttggcacattataagtgtttagcaaatgtttactgagaaaataaatgacttattattaaaaccctgatgctttcaacattttccctaggagccatttgatattttcctttgtgttacaatgttacaaagatgaaaaccccacaatttctttctttgcctgttcaaagatgtggcagtaatgatagaggaagaagttggattattcataacatacaagataatctttcacggcaatctaattctttggcttccatgtgcaaaacatctgaaccaatggtgaaaaatgcaaataatagaatttgtatcttcaactaaaaatcaaactgctgaatagcaggaaacatctgggtgattaatccattcacatattcagtattgaacactcagagagttgcaagaatctaaatgttgtccattgcttttggattacttgtagaaatcacaattggctttcctgtgttttatttaaagttcagtgtaactgaggattcattatgattttgtattttgagatattagcaggtcatattgtacatttttcttattccctttttcaaaacctgtattctaggttattaaagtgcttttaaaataacatttttagaaaatagaaattacacctatctaatgttaaatacaattattattataacaaatgtaagaaaatattcagggaaacatactttgtcatctgattccaaccaacaaaatatttttaatgagtgcatgtctattaaaagaatcctcaagatgctataattattattcattttctagaattgtttcaccatgaagctttatgcttctatggggactttaatgtttatgttttgtgatggctacattgactattaaaaagcaatttggctgacattttaggtcttttgttgccagttttaattggattgttcatcaagcatcaactcccccgttaactgcaaaaatttcaggccaacgtcagtttacagtaatgactgtttaatgattttatcctgtcagtatacaagcttcgtatggatatatgcatgattagtttcatatcaagacctgtaattaaataattgaagcctaaacagaatggatatcaaacatgaacacatatttaataaagactcagaagcttatcaaaatactgattagcaattaaaagtcaatgttttgagttcatctggtgtcagtacatttatgatactttagtaaatatttgtatgaagattttgcgtaaagttaaaagacagaaattctttttggaaaagcagcaaaattgctttttaaaaaggtaatttatatccaatgtgtatctatctgactgagtgagaaaactcattttaagtattatttcatctggagaaaaaattagccaaagcagaagaactctagagtaccaataaatattcttatcaatcagacacaattccaatccttaaaaagttgacctatgtacacctaaactaagctgtcacctgtttgcatgttagaatgaaaggactgaggagggccttggaaactatttattctaacttacttattttacagatatcgaagtccagatgagtaaagtgacttgcctaacatcatatagctaattagtggcagagtcaagacaaaaaatccaggtccaacattttaacttatatattcctggaagaaagcagtttaaaacatcttttgtgtattggtaaatttattttcttcccatttcattacattaacatgctttgtaacaaaacaagctaagaaacaaattgtttaaagaggtgtacagtaagtttcactttgtcttttctccccacccacttcatttctcctccaccccctgtaaccatttttactagcttcttattcatctttccattatatttcacaccagtacagaatatcagaatatatattataatatcactctttctgtacacaaagcatagtatattatatttacatttttacaccttacttatttttgagatagggtcttgctctgttgtacaggctggaatgcagtggtgcaacctcagctcactgcaacttcgacttcctgggctcaagtgatcctcctacctcagcctcccgagtagctggtaccacaggtgtgcaccatcacacccagctaaatttcttagttttttttgtagagacagggtttggctgtgttgctcaggctggtctcaaactcctaggctcaagcaatcctcccacctgggcctcccaaagtgctgggattacaggcgtgaaccactgcacccagaccatttttttttttttttacttgacaatacatcttgagatctctccataccagtgtatagaaatctttcttgcgttctttttctttaagcctgcatagtattcccttcatggatcttatagtttattcaatgtgttggcaaattattgatcattatttgaaaatgttttatatgctaaaaattatttcacctacatataggaagtacatatttgcataactgaaacttagaaaatgtagatactgatataaaggctgaactccaatacaccgtgcacagcactaaggaactagaaaaaccattactttttctttgatttaaaattctagttctatatgtatagttattatttatcaattataaataaaaattaatttaaaagatcataaaaataaagttctagttctaaagcctgttgaataagatgtttttcagcatttactggcatgggtgagtgaaacaatgtgttattaattaaaatgtttacaatgtagcacacagaacttttaaattttaagctatgttcagtaagcacaacatttcaaaactctcccaccttcagtcccatagatcatactactttctttctgttcatggtaacccatatatagtcttcaatttaaaatagtttcattaaacattaaaatggaaggccagcctatgctgctatagtatagtgaaagacattagggagacagaccaattaaggtagaagcagatttcttgttaaatgacagatcccagattcccatttcatgaaacatgtattcctgccacatgccaaattcccattaacttcaagaaggaattatgcacagaaatacgtaagctgaagaaggcaggatgaattagtccagcgcaatccttaaatgtcagtttaaaatgcactggatgctttaaattatgtgtagtcatgttgtttgaattgaatattatccactcacacctactctctgatcacatcttcaaaatgaatggggcaaagaattgcttggaatagagaagagacatgaacagctcgatttggaattgtaagaaaagataaaattcaaaggtgtgagtcatgaaaatgtaatgattcctcaagaaaacagcttaagagaaagaaactactttccctcagcatataaaatatttacatttaagaaaatgtgtagaaagatgttaaaaatcctattaattcaggccagttggagagtcaagttgtattaagtgttaagtccatataatatttaaaatataaatgtgtgatagttactttcaaatgcactgtatgaatgttagtcactacttactagtatcctatagaagtttctagactcactggtttaaagaaaaacaataaaaatcttcattgtactactattgcttttaaagttcttaaaatagtttattctcttaggcaggtgaaccaaatcccctatattctttctttttttttttcttgagacagaggcttgctttgtcgcccagactggagtgcagtggcaccatctcagctcactgcaacctctgccttccgggttcaaacaattcttgtgcctcagcctcctgagtagctgggactacacgcacacgccaccacacccggataatttttgtatttttggtagagacagggtttcgccatgttggccaggctggccttgaactcctgacgtcaagtgatctgccctccttggcttcgaaagtgctgggataacaagcgtgagccaccgttccctgtccccctacattctttatactactctttccatggaatattccggggtaagattcaactagtactgtcaaaagtttttaaaattatgagacttttctatattaaatgaataaaaaatttgccccttaaatggcatataaaaagtgtaaacattttttaaaaatatggtctttaaaatagaatagatacttggtaaataataatctgaaatcatctcggtaaaaactctaaaataatattgtatactacaaatttttttctgtgccataaaagaagattttcattaaaaagctgatgttgaaagggctgatatgtcatactttgtcaattatgccaaaaaatgaaccttttcttattttcatgaattgtgcagacctcagtttgcaggaacatttgccactagatgggaccttatatctgtggtaataatctagcagccaacttcttttcatccagtttttataggactcaggaacacaaaccttcttaagaaaagtaagtctttattgacaaaataaaactttataacttacgcaactagccagctgggtcattgtaggattatttcctcactgtttctcagtagatgatcgaaaacataacatttagggcaatttccttgaatcaaacgatgtcctacactaaaaaagcagcaatgtgcctttctaatactctcaagcaagacctctgcttttcctttagtgatacaatggcaagcttggttaaaacattctctagaatttatctgcctaagcatgcctgtgacctcttctagttgccttggaagcactgcagttttctctgaaaccagatgtatcaagatttttttttctaatatcatgatttcttatgctataaagagaaggtgtgtggatggcaagtgaattttgctgtttgttaaccaaactaccctgaggcaatatagagtaggaattaagaattcggcttctggcaataatggtggactagaaaatgtaaaaagttttagcctacaaaaaaaaaaaaaacatgtaaaaatactggataaacattgcatgtgtccttttaaatgaaaaattgagctcacaatatgtggaaacaaaagcaaaaacaaaacaggagtcaaaaccaaggtgggaattttaaacctgagtggcatgttcaggagtctatgttgcagcttctctgcaagtaggtaacataaagatatgggttttaaggctaaggttgtcgaattaggaggtgatgactttggtcttcataaggtagggttttgcaaatgaaacccccgtatgttgccaatatatggacccccagaatgctacacttccaaaaagaatatactgaaagaaatctgcccactcacacaaagggataacaaagaagcctgtctgccctggactgggctctgggtgaaaacaatagaaaattgttattgagaatttataattatgggcctatatcaaggatggatttagagttgagtgtatactatccatgtgttctaatgactaccagtaagagaaattaacattaatacaaaggattagagagcctggcagaggcaaatgcaaataagatcacaacctaaagttaaaaattatataaggaaataatccaactgaaacaaaaggttcaccaaactataagattaggtccctaagaatttcagataacacagctcttgtttagagactgtaaaaaatgcatacgtttaaaatggttaaagaaagaatgaaaagcataagaacaaagcactatttttaaaaagagatcatatagacttaaaagaaagttgtcctaaaaatatatagtatcaaaatgtgaaactcaatggaaaataaaagctaaagggaaagttcaatagcaaatgaggcacaaatcaagcaagaattcatgaacttgaatgtgtatctgaggaaattacccagaatacagcacagagatataaagagatgacaaatctaaaagaaatgttaagggtcatggaggatagaatgaaatgatatgatatggatctaataaacattctagaaaaagaaaataaagaaaatgggaagaaataatgatgatggagaatattctaagactgatttaaaaatctgagaatctgaaaaaattttcagattcaggaagcatgacccgtcagtaggaaaaaggaaaattcatagttagattatctaaggcagctatgaaaatgcacctcccaatctatttatgtgcataattgaatgatagccccagctcctgaccttctgaatgtagtactggattcatgctgagtccacacttcttatgggctacttccagccaatgactgtactaatacaggccattcctacaagatggaggacccctataatgggtaactttggttcaaggggtctccatcagcctggccaaaactttcttggatctgcattgtagtctgaaactcttcctacttaatattccctcttatctccctcttcacaggtcagaccctgcatcattctaaaggttctccctcccttctcctgctccctctccattatccttcaaaggatcctccaaaacactctagcacatcttattccatcttggcagctgcttcttggatgatatgaactaacacagcaccatacataaagatataatagaacaactagatagaacagacagattagctacaatgaagctataattagttagaataacaacagattacttaatggcaccataaaccccgtctctactaaaaatacaagttagccaggtgtggtggcgtgcacctgtaatcccagctactcaggaggctgaggcaggagaattgcttgaacccgggaggcggaggctgcagtgagccgagatcatgccactgcactccagcctgggcgacagagcaagactccgtcaaaaaaaaaaaaaaaaaaaagtatggaaaactgttgtttgcttacctagcagccattaacctcttttgcattgctaacagaattcttacattgttcaggtatgaaacatgtgccccactccaaactccattactggtttaagcaagtcataatatttcattcttctttgccagtgactatattagtgggtgagcatgccacccaattctggctgagaggaagtctgaaaaaaggtttctggaaaagattatcttgtctgatagcgagagagagataggcaaggagaacttggctcttcctttcagcctttggacattatcatcgtgaggacatgatgtttgcagctggctgttatttaacaactataaaagaaaagccaaaagtgtcacagagaagctgactcagatttgtggtatattgagctgctcaattaaccaaccctagtactgcctagctctgaactgcttgttatggtagaaagtacaggtgactcttgaacaacacgggttggaaccctgcaggtccacttacatgctgatttttaaaacacagatagaaaatacagtattcatgggatgccaacttttggtatgtgctagttctgtggggcctactgtgggaattgtgtatgcaagaattttgatatatgaaggggtcctggaaccaatctccagcatttactgagctatgactgtgtacatctttattgttgaagacattattgttggatagtatgttacttgtaccaggaataaatctgttagttcatgaagtaatattttcaaaatgcttagagaaaacaactgtcagtattgcattccttatctagagaatttcttagtcaagactgagggtaaaatgaagacaacttcctacaaagaaggagactttaccactacagacccttgctgaaagaattatgagaggatgtacttcaggaagcataaaactgaacccagaagaaaggcatgagctgcaagaaaaaatggtaatgtaagtggtaaacatgtgggtaaatctaaataagcattgaatgtggaaaatattataataaataattttggggtgttaagaagaagtataatcagaatactggatgataattacatgtaaatgaagggataatgatcaaaattaaaacaatttaatttccatctgttgtttaggaaaagggtagagatactgatttaattttagactttaagacaagtaagaatgaaaacaatgaaaggtatctacaaaagtaataaaccttttcgatgaatatcgattgaaaagcataccaaaaatatttatctgtttatgtgcaaagtttaaagttttacaaaattttatgagtaaatattaaataacattttcagtatgtcataaatatttcataacaggaaaataaaggccaaaagaagtgggagatagcaaaaaagcataataaacttgtctggacatgttggaaattagatgggctggacacacaaatattccttttttgtgagtagccttcctgaatcactttcagtgatagtctgctaattgaaaatgcagagctcttcttcacagaggagacagacataaagaagagagggatccaagcaagcagaacttttaaatttagttttattattttattttttttaattccaagcaagcagaactttaacactcatccactctagcttcatcaacatcttcatttatttttggtttttgtatcttgggtttccgcttaaaatattgctttaagaaagggttctgcaaattaattctaagcagtcatcctccttctcatgtttcctcccagtattcctgacattaaactcctgaatctaaaataaaagttggaattatttaaaaataagtaaaataaaattaaataaaactcctgtatactaatactaactttctgcttactgctcttaacctctgaaggtcacaatgccaccttctgttagcttgagatcagtgttagtattccttttttgaaaaaaacgccacttagtaatcctatgtctgaattctgattgtattcaatgtagttatataaacttaacaggaaggaatgagtcccttctgacaaactgttgtttcacttatggtccttatagccctgagttttgtctttggagtactttgtcaagtattcaagggttctactgaaaagttagtactcagcttaccattggcctttttgactttgaagaattggtaaagtcaccactcatcattttccccaaatgtaagagtctcttccattattcagtctagtataaattcatttttcattctctgaattttattcaattccattttatgtattttgatgtgcagtgactggaagagtttaggtgcagtagaattgtgcaacaaggaagaaagaagtattctatttaattgccaatacctttcctgatgataattaacatttaaagtgtggaatatccttccttgtattgataaatttgctcacacaaacatatataatattttatttgccatttcaaataatttaatattgcaaaggtcagcaaaccttttctgtgaaggactggacagtaaatactttaggctttgcaggtcatatagtctctgtggctagtattcaactctaccagtttagcaccaaagcagccacagacaatgtgtaaatgaatgaacacagctattttccaataaaacttgattttcaaaaacagtcgataggccagatttggcccacaggccatagtttgctgacccctcttgtactgtcttggttttcattatccagtggattcgtttcaggaaacagagttcactaccaggatatttaattgttctcttaaattgcaaactacttttgttccagtagggacagttaaatgcctaggcagataaaacggggtccctggagaatctgcaactggcctgcgcactgggaggacgaggtggagccccgggaagtttgcgttgtttgcaggtgggaggagcctggactcctcagtttttatgtggtgacctgggattcaatctgtgaggcagagggcttgttagcaggactccatctcactttgctgagttttcttcctttttatccttttcgctcagtaaagtcctgctcccctcacccttcaatgtgtccgcatgcctaaactttcctggtcatgtgacaagaatctgggttttagctgaactaaggagcaaagctctacaacacaatgagtggaattttagtgcaaaaatttgcttttgaggactgaaataaaataatgttgctttggtttttcaatattctaaaggtatgtcagcttaatagtcaagggaatgcatttatatttctagtatattttaagccataaaaagtaaaagaaggaatttcatctgtcaatgtgagtaaatcatatgcaactcaatcacctcaaggaagattatttacaaattttacattttaattcgtagatagcacctaatctgcctataattttgttgacagctgaatttctgctattttatctgcctacagagaagcccttgaaattgtagaatctgtatggtttactgctttatttgaacttgatttctgaagcatctgtataaaaatttaagtgaaaattatatttttaattagctgccatttatatttaaccaaacaattcatctttattaaaaaatatggatatcagcagggtcatggtataatgtatgctgattacacactgtacaagagtgctccatttcagagtgtgccattcacattggagatactagggatcgtagaggataatgaaaatcaacagacttattaaaaggtttctggaatatagctgtagagagtcttattctaacaactagtattttacagtaagtttctgatggcagtaaagtgtcttgagggaaggctgtcattcaataattgtgggcataggttatagcctacctctttgacaatactgcagaaaagttaggaaatcatgaaaagtttatactgccctcctcaaagacgattcatttctcatgcttctttacagaggggtagttcagtaggcatagtgcacgattttcttataagtcccgattgcagtgctttttaccatacatttaatagaataagcatttagatcatacaaggatctaccaggaactatgcagtgctttcttagaaatcttgcttttcttttaatgtcatgttttaagttcccctagcacttgtaaacgtatgccactgagggaatggttttcaaattgtatttcatgagcacgtcttagggactaggatggggcctgaagctttgagtatctcacctttacttttacccattatatactttgaggtcacatataggatctttgtgcaaatgggaaaagttttaaaactgttatatgcagagggcagttccaaatacactttttcccctggaagttgactctaactgaaagatgccaacaacaatatttgtggcagtagcaattcccactctttaaacacctcatacatggtaattcccaccatataatctctaattctcacaaatatcctgcaaggggtagttgatactattctcattttacagatgaagaaagcaaggctcagaacatttaagtaacttgcttaaggccacccagttagtaagtggcaaattgggaactaaccttaagtctgtctgacctcaaatattcacaatcccatacttttattttaatataagttatttattagcaggaaaacacaaaagaggttttagataccccccattttaagaggatcattcttcccagtatagattagggattaggctcatggaaaattaaaccacaaggtctaaattacaatatacttatttagtgcataaaaacacatatgaggctagacagaaaaatgccaatgaaataaaattgcattttcaaactccttgcccaagcactcatttctcaacttattatcttattctgaaatatctccggttaaaattacaacccttcaaggaccaaagcgtgcttatacacttcaaacagtaaatttcactaagaaaatatggttgttagcttttaagaaatatagttctgctagagtaagagaaattcataccattggtgattcacatcacataaaactttatttgttgcctcaatctgattttgaattcaagatggtgtttggtgatactattatttcagttaggcatctctctttgagcagaaattgggactttagatggcttatatcagtgatggtttgcaactgtgatttaaaacaaccaaatatacctgcaaatgactttgtagcctcaggagaatgtaaagtgaggtcaccagcagggacaagcagagccttcagtcactgatggaaaaatcattatttcactacctctgttaattagttagatgtctgaagttgaagagaagtgtactagatacactcgccaggactacaagaaggcatataggaatagaatccattattttctgagcatctcaaaagggacaagtactatgcacaagggtacagatattaacacgacttggtccctaaattcagggaacactaggttcagggaacactaggcttcatctcttgccaacccactttccttgtcataccttcatctttgctgctgcattggaaagacctttcttctctctctttcatctttagtttgtgtggtcacttgtactgttattccaagacaagctcaagagtttcatgcttaacaaagatttttcttgaacattccttcctttgtgccccaaccggaccattctatcataccacttgttaaacattattgtactggttgtttacctttatgttaaccttactgtcccatattacttatttctaataaatccctcaaaagtaagggttattttttgtttgtctcattaaataactaatattttattcaacaaatattacttgagcctttttatgaaccagcagtacagttatctaagcacaccatacacttaatacatgtttgttaaatgaaagaataaaatccaacttccaaacttacatcctaatgatcccatgcattcttaaacacaactcttccaccaacccctctagcactcggattcagtttgtgttgaattaactcacatttactgatatacataaaagttgtcaagttgtcatttgggtgtattctctctcctcagatagattaaaaactccttgagggaaagggccatataaaatactctactttattttcctatagctcttgacaaagggctctgatctatcaaacactcaattattaccagtctaagtaagcaatcattttttttggatgagcattattatcatgatatagagtaatcaccattcatctaggctatcaacctattgctcaagtcaacaaactctggcccctgaattctcagtcatcaaatctggtctccaaaatgtatccctgtcttatccctgatgcaagtggctccttaagcattgcctttaggacctgactatctctcacttgcactatgaaaacagcctcttatctgctctcctgcttttagtatctcctcctacaatccatcactgacactgcaaccagggtgggctttctaaaaactaaatctgactatttgtgacagagaccaccaagttgttcactacattcctctcctcttcttccaaggaagaagttagacctcatttcccaggctttcttgcagataactgtatacatatgactgagtttagaaaatagaagtgttgagtaccatttccaggtctggtcaataaaatcttccactcatgatctttgctctcctcctttcctctagcttgatgtagacaaacatggcaacttttcaagccatgtgttaaagacagtggcgctacaaggatggaaagagcctgtgccctaagtcaagcccaggagaacagcctactaatcaggaattctccagttgcattttaggtgaatgagaaacaaactactatttttgagccattgtacaattttaggttagtttgtaacagaagctagcattgtcttatacaccatacactgtgctatttctctgggcaagatccttaattcactggctatcatattgtaggcaaatttcttggaacaacacctataaggcccttataaatccaaatgtgactcactctatagtctcattctacttttaatccttgactcttacccccctcccatgaccatatataccataccctatgcttcaaccaaaatgacttacttggtattaccagaaaaataaatactttcatgcctacatatacactgttctttcatcttggaatacatccccttccttcagtctcatacctgaaatttctttttatcattcatggaccaattcacctcatcatctctcatacatctctgattctctttgtcagaatcaattgtcctcccattgccactcccataacacatttaaaaaaatctatgtcatagcattaactacattttaaaagctagattgtcatcaccttgaagaccgatattgcatcctattcatccttataacctccgagactcttatacacagcagatactaaaaaatgtaggtcaaactgatattactcatttatttaacagtttaaactttttgaagtatttttcatatacattatttcatttttagtttcacaatgattgtatggatttaattgacttgacttaaataaggaaaaacagttaattgtagagtgcagtctgacaatattctgacattgggcatggttatggtttagccacctgaaggagaaggaaaagaaaattagttgggtaaagctacctaaccagaaaagttcgttcataaaaatgataatgcaaatttctctatgatatgagtgtactcagtctgcaagtttgtgtatgtgtgtgaaagttgtactagtagtagcaaatttatgttagataatttaagatttaagatgatttggaaagatacctatgatatattgtgagtgtgagaaaagcatattgcagaaagatgatatatagtaaagtttgacttgtgtaagaaatatcaggaagaatactcatctctcagagtagaatagtgggagaaatagaacttttaagtgtacattacataattctgtactatttatttcatgatctagttattatataaaaattgcttagaacaatctagcatatattgtgttatacacatactcgttatttttatgataagcatgtgttataataatttttaaaaagaactcactataaagagcaggaagtaatgtcgaataagtggtgagaagggtatagtttagtaagcttctatcataatctatctttctgcaggtgataatcactagacaaaattcaataaaaaaatcgatgacctttaggaactggagagtgaacaaaagaagcagattatggtggggaatcaacacttggaagaagggaaggcatgggttaatttccagtttttatttatttattttttatttttttaaaccagaaggtaggaaacaatgaggcagcacagggtggcagaaatcttgacagaaaactctcagtatctctcacataaaaaaatagggaacagagtttaggcaaccacaaccactggaaagtcaagggggcatcccccaaaaaagataagagagagaatgcaccccatattctgtatataaactctgcccaaatctctccctgacctggaatcatgcatgtgtgaggctgactgcaactgagaatgaagaaactcaactgagatttgagctgcagctcaagaaacagaatttgtcattggagtccaaaaaatttaattgccttctacatgaagagaaaaaaattaaaactatttagaataataatagaacagaatctacagtctccacaaaataacaatcacaatgtccaaaatacagtccaaaattatttaaaatatgaaaaacagaaaaatgtgactcattctcaagagaaaagacaacctatagagaataactccaagaaaaccagatattggaattagcagaccagggttttaaagtagatactataactgtgctcaggatatgaaggaaaataggcccacagtaaacagaaagaaaggaaatctcatcagagaaatagaaaacaaaaaagagaatggaaattctaaggtgaaaaatcacagtatttgaaataaaaagtgaggaaagacaagtcattcatgatcatgcctaagtctcattagtctcttcatatacagcagccaatttttagatatttgcttagctcaccttccctttctctgaaaactgcccactatccacagagataaggctcctgtggcagttatatgattcttcctctaatattctgagagtcaaatactctggcagctggcccctgatccaagttttactaataagatgatctctcctgggattttaaagttgggacagaatattagttagtcaggttttaaaatttgagatattatgtccattcatgatcagaagtatggccctttctggtcacatacagagggaaggagagttcatctgcagagagaataaaacaaacacacaagaggaatacatgaaaaaattgagggtgtgggagttactgatttctttccaattcctagtccagtccctcaattaggccttatagtgatttctgtccttgggttctgagatactcctatattctaataataaattgaatttctcacttttttgtttacatttctgttatataccatcaaaagaatctcaattacatggcaatgtatatttctattctttggctagtcacctattgaggaagcgttggatacagcaatggtttgaggctattgtaggcaatatggacatgaaagtcctcccaaatttaaaagtaaagaccattaattgagaataaaattaggaataaaatgtaatgaatgagattagttgtagaaggagcccattctaagtaataatctgtaactgagtggtcaagtattttaggaacagccagatgtgattaagctgatatggtaatagttacagtagtgggaagaaagaatgtgctattagaaacatgggacatagaaaaggagaatcatagaaagaatttatcattgttatccttacccatgctgtctagttaaacgggtcaccttattcaggaatctaagtatctgatgctgggccaggcatatcccataatggactactcagagtttggtcttccaactaacttcttttttctctcatatccatccttgtaaaggaaccttctggttatcatttggtttcccatgtagcttcccaacaggaaacaatactttgaccaaatactttgaccactgacaagaatattttgacttgctttgaagttatattttatattgtaaatgaatcagttgactgactggttttatacatcagtctcaatttggttaaggtaaggcagaccttagaggtcaaatcactttagatgctgtaacaagtgctaaacagaatggacttgaagtaacagataatggaaaggataatacttcctcatgagacccgatttgtcagccagtctcctggacaatgattctatcttgtcatgctgtgtaataaatattcaaaatggtgacatttcaaattattcacaaatattgtactttgctcaatagtgtttactctaattttgaataatccatgaatatttggagcatcttatagtagcttcatatggtgaatacatttgcctcaagtagcgtttatatagggcccatgtatttactattagtataataggtcaatgttgctcctgaatataacaataatctacatatatacaattttttggagaatttccaagtaaagctagaaaatatacatcgtaagaatgttaactataaagcataatatatattcactatgatattatcttatttggaagcaggaagataatactgcactatattctctatcttaaccatgctttttcaaattgggaagcagttgatatttgtacaggaagacacgaataaataggtatttgcttctgccattcagttttcagatatatctcttgcatatccatcatatgtgatctggcaaatgtattattatataaataactggtgctctgttaaattatattttgactacatgatttaaaataaacttgtagtaaatcgtttcacaaaacaaagagtctccctttcatatagactactccctctaacacctactcacacgaatttaggtttctggcatgcaggaggactgcgtggtcaacttcaaaggatttagtggtccatcagtcaacatttaaattattttttcaaacactgatgaaattcttaaatgaacactatccacaaattgaacatttctggaaataaactgtatccaagtgaaagggcttaatagaaccatatatatgcaattgtcacaaagcaggtttgaaaaaccaatggagtcttgctgttcccatgcctgagttttaatatggaaaacaatattattatggttcaacaatttgttagttttttactgagcaactgtttatatggacaaagctagtaatttctgaatgcttacccttccccttcctatccatgataaggcaaaaagcaagccagaaagacaaagcaaaggaatgaacatgacctaacaactcagtaaaaatatgtactcattctttaatatgtaataataaaaatatgtactattctttaaaaaataatgtaactcaatataaatatatgacatcaaaatctcaattcaaaagaggttaacagttctgtactcacgggagtcttatactttcagtattcatggaaacattagtaatttcattcaataccctgttttatcatttaaataaaaaatattattgcccactcaacacaactctcaaagtattatgcaacatttcattacagtgctaatttttaaccttttatgtacaaaagcagaggcatattaattggaactgatttgaggtcatcagctatagtactgctcagtcattgaagttaatattctgtgaaaatatctggaaagtgtattattaataacaatgtatctccagacacattttgtgtatactttcaccatatggaattaactcacttaaatgattttacaaactttgggaaagtttaccctcttgtaaatcttgcctggatgttactggctatacacagaatttgaaataagtttgatttgggcccctttcctttttctttaatcctttgatttcaggccctgcctttagcaatactcttgatgtaggtgatatccattgcttatggtatcagaatccacctccatcaaaaagatgttggaaagtcacaaattctcaacaggttatctcttgtccctagagagcatattcagataacagcattgaaatttgcctgtttggggagaaaggtattctgacaatggtgtaagcttttctattattttctaagattagactaaaatataagctcttaatattatctttacaaatttccaataaaaatattttaactcctccagttccctaaaggtgtgctaaattatttacaatgcttaagaatgctagagaacaatgaaatgagatagattctataatatagtatatgtgcttcagcactgtattagtctgttttcacactgctgataaagacatacctgagactggacaatttacaaaagaaagcggcttattggacttacagttccacatggctggggaggcctcaaaatcatggtggaaggcaaggaggagcaagtcacatcttatgtggatggcagcaggcaaaaagggagcttgtgcggggcaactcccgttttaaaaaccattagatctcatgagacccattcactatcatgacagcagcccagaaaagacctgcccctataattcaataatctccccccaggtccttcccacaacacgtgggaattatgagagctatatgatgagatttgggtagaacacagagccaaaccatatcaagcactaacataaactagcaggaaagacccatccccataattcaatcatctcccactggtcccctcctataacacacggaaattatgggagctacaatatgagatttgggtggggacacagagccaaaccataccattctgtacctggcctctcccaaatctcgtattttcacatttcaaaaccaatcatgccttcccaacagtcccctaaagtctcaacgcatttcgacattaactcaaaagtccacagtccaaagtctcatctaagatgaggcaagtcccttcctcctatgagcctgtaaaatcaaaatccagttagttaatttgtagatacaatggggatacaggcattgggtaaatacagctattccaaatgggagaaactggccaaaacaaaggggctacaggccccatgcaagtttgaaatccagcaaagcagtcaaatcttaatgctccaaaatgatctcctttgactccatgtctcatgtccaagtcacactgatataagaggtgggcttccatagtcttgggcagctccgcctctgtggctctacagggtatagcccccctcatggctgctttcatgggcttgtgttgcatgtctgtggcttttccaggtgcatgatacaagctgtcagtggatctacaattctggggtatggaggacagtggccctttccttacagctccacttggtggtgccccagcagggactctgggttggggctttgtcccacatttcccttccacactgccctagcagaggttctccatgagggcctctcccctatagcaagcttctacctggatatccaggcatttccatacatcttctgaaatctaggtggaggttcccaaacctcaattcttgacttctctgcacttgcagggtcaataccatgtgtaagctgccaagacttggggattgcaccttctgaatccacagcccgagttgtaccttggccccttttagtcatggctgcagtggctgggatgcagggcaccaagttcctaggctgcacacagcaggggggtcctggacctggcccaggaaaccatattttcctcctagacctcccagcctgtgatgggaggggctgctgtgaagacctctgacatgccctggagacattttctccattgtcttggggattaacatttgtctcctcattacttatgcaaatttctgcagccagcttgaatttctcctcagaaaatgggattttcttttctattgcattgtcaggctgcaaattttctgaactttcatgctctgtttccttttaaaaactgaatgcctttaacagcaccaagtcactcttgctgcttagaaatttcatccaccagataccctaagtcatctctctcaagttcaaagttccacagatctctagggcaggggcaaaatgctgccagtctctttgctaaaacataacgagagtcatcttagatccagttcccaccaaattcctcatctccatctgagaccacctcagcctggatttcattgtccatatcattattagcattttggggaaagccagtcaacaagtctctagggagttccaaactttcccacattttcctttcttctttggatccctccaaactgttccaacctctgcctgttactcagttccaaagtcgcttccacatttttaggtatttttttcagtagcgcctcattctactggtaccaatttactgtattagtccattttcatgctgctgataaagtcatacccaagactgggcaatttacaaaacaaagtggtttattggacttacagttccacatggctgagaaggccttataatcatagcagaaggcaaggaggagcaagtcacatcttacatggatggcagtaggcaaaaagagagcttgtgcagggcaactcccctttttaaaaccatcagatctcatgagacccatgcactatcatgagaacagcacaggaaagacctgcccccataattcagtcatctcccaccaggttcctcccacaacacatgggaattatgggagctatgagatttgggtggggacacagagtcaaaccatattaagcactaacaaataaactagcaattcaaaggtagcacaaatgtagctcaaattaggctaaggctttcatttggaatgtatgtggttgtactttgtcatatcttaccatattctcctactttttctaacatttgatgacatttgtatggcgctttatactttacaaaatggttccacctgactgtttttgggtacgaagtcactcagagaaagtcagaggctacaaaagctactccataaactatttccaaatacactctcattttctccaagagccgtgaggagtactacttctccaataactttttattgagaacatatctgaaaaaagtaaagttaatggaaaagaggaacatcaaagactattaatttttttagctgctccaaattaaatccaagttaacttggatgagtaaagacaagtttatttttctctattattcagcaaagaagagaaatttgtaagcaaaaatatgggagtagcatttaattttggctgaaagagttttataattttaccatttagccatgtattatttatataatactgatttatagaatacttatttatatgtataatattgacagccaaagaccaaaagtaggtaatgtccacaatagaaataaaaaaaatagtaaatgaatgggttagcattttacttaggcttctactgtgaagaatactaatttgttaatgtgcaaggtgacacgttaaagtgctaaattagcctgagcccttgttgtaaaatttaggcaagcagaaaagttcaaataccttatcacatattaattgccaataattacttgcatcaaggtaacttgtgttatttaaaataaattaacagatacagaaagaatcctagttaataaatttaccaattatctgccttggtataaatatgaatttatgttctgtttttagtcctattcacatatgactatgcattctatttataacgatttctgaaaaagcagcggttggctacatgacctgtcctattttttgtgaccatcatttctttatctcttctctcaatgctttctcatagaatgaaagcatcaaagcaaatgataacagtctacatatatacaaaatatatcactaggaaataatttcttttgaaaaaagttaccccatgaggtgcccaaacaatgccatacataaaagataaacaattcaagccagccactgtataatgagatttaattgtctcccattcttttaatatgcatggacaaaaaacgcttcttttccattacctcatcttaagtagttttttaaatcaaacacatactcacgctcatgctgtcactgataatggatctcatgtcaaagaaaaagagcagaaaggacctgataataagtgcaattatcaaacatcaaaaatgtagatcaaagtggatttcctgactcttctacatgcagtcacttcacagaatttcactattcatattatgtgaccctgacaggatatattaattttctccattatgggagcaatgggataggcatacttcagtaggaagctggcaataagtagagttattatttcactgtcttatttaatggcttgtgtgtgcataattgcgtgtgtgtgtgtgtgcatgtgtgtaaaatatgctccccagacacaccacactgtgtctccagagttgacagaaagccttcagggagatgttaaccttcctatgaaggatggatccagggaaggattttatttctttcagatagtacaatatttcctctctctgggaaacacccgacctatctttgggaggactgaattatctcagagggaaattgggagtacttctagaagtttgccattctgaatcatttcaataactcaagtaatcaaatttccacttctacccccaatcccatactccttcctttccccagaactttccttgatacattttttatttgaaaaataaattcattttcttttcctaccaaatgctgaataaaaatcatgtgctaggtgttctgtagtgaaatttccagagtctatacagcctacacagatttccagtaggcataggtcgttttgtttttagattgtgcctatcagttggtcagtgccttaaacatgccaatgtcacaggaatgaccatttctgaactcacattcatccgaagtattcttgaagattataagaagagagagaattttctagttcttttcacaaacatctacctataattccaagggacagactttgacagtaataaactctttagagttgtgttatgccatttctcacccagaaaaaaagctaacattgttacatatcttttatgaaaattcgaagcatatttgttagaagggaaatagaccatttgcaaaaggcaaagggcaagcccataaggcacaatgacagatgaaacctagccatgagaaaaaaagtatccctaggatgaaaaaaaacattttaataaagcaaaacactttcaaattagtaaattaaaaatcagttgattacagcaaagtttcaaggagttttaagtatttcgaagttaaaaaataactagacaatatcattatttttaacttaataattttgctttgttttacacatttcagtcaattaaacttctctgtatacttgggcagttcttgaatgttagtttgaaaatagactaatttctaaacatgggccctaacatatggctaagttaaattaaaaccctatcattaaagaaacaaatattacaatatatagattagtcaattaacatactttttttctatggagtaaaatgactctgaacctggaacagcagctggagttgttcaccacaatagtattagatgcaagtttctggaattaaatgtgccaggcaggaaaataattttatagtcttttcctcatgggaggaagtctggataaagagtgtgagatgtcagacctcatcaataaattatgatcaatataatagggttgaagaattgggtagtggtttctatgatgatcagtaaatactactctggtaattatttttaaggggcaaagggctaagaaatatgagaaaataaaaatgaaataaaatagaacaaaatcacagaatatgtagactggaagcaggtatcttaatattatacaaccatcatcataattattctccaggccataaaacatgtagaacttacaggacaaaaaataatgaaaactaagatttctctggtagtcttggtaaaagacctgcttattagaaagacaaaaaagacatttacaatcacatgttatattatactgaaactgaaatatatagtgtaatggttaagaccatgggttctggaaactgactgccaagattcaaatcttagcacaccaccaaatgccttggtgaatttagaaattacggaacttctctgtgtcttcttcttcatctgcaaaagtggccaaacgcatatttcatagctttctgcagagaactacatgagttagttatgtaatgtacttagatcagtgcttggcatacagtaagtgcttactaaatttttcatttttattaataaaaaggaactcaaaaatttacagaaaaatatctagtagcagacccggctctctccaaagttgtgaaatgactcagtttcttttacagcactatttccatctctttttaaaaacctctttccctttctatcttcctcctcttctcccaagtggccccttgccctctggactgtgaaatcccacccaaatctgccttcttaatagaactgcataatccagaccttttaaataaaaaccttctgtatcccaacggaactcattcaccctctggcacattgtctcgggtcagtctcaggaaacaatgtctaatatgtggaaccaccattgagatagtgctgatattttgagtagagccatcaatgcctgaatccaaaggaataagcattcgggaactaaaaagaactgtaatgactctaaatgtcgctgtttgctgactcctcccagtcagtagcaggctaactatgtgctcctcaagcctaggtttgtgtatccagccaaaattcaataacagtttggatatctcatagacaagtatttaacatacctaaaacataattcttgattcccctattttcactatgcccttttgctcatctagcctaagtgacaccacaaggtactcagttgctcaaacaagataatagaatcataccgatttctccttgtgccttaacttccacatgcaatacgtcaccacattctattggtttccttcagaaatatatcttctctctatccacctctctctgtttccaccgtcatctctcatctgaataagtacaatagtcagcttcctggtttccccacttccaatccccccgccaacctatttactgtacaatagtcagccctagaataaactttaaaaaaacaaaactgaacatcccaccccttgcttaaactccttcagtggcttcctattgtacttaggaaagcatttaagctcattgtaatggcctccaagaccttctgtgacctggttgctgtttagcttagagtttcctctgttgagctattctccccttagtctatcacatttttgacacacgggtctggttgcatttcttagatggggtcatcttcttccaccacaggccctttgcatatgccggaaagggtcttcctgccctcaccatccattgaatgattgattttctcttctcatacttcaggtcccacctcaattgtcacctcctaaggaaggatttttttcagctttccctactgttaacgtagtttccacaatcacctcccttattctctgaaatgaatggtattaccatatctacatatttctgttttgactttttgcttctttctcccactgggatatagggcagcattgttcaatgttacatctctagcatctggcacagtgcctagcatgttgttaagtgctcaaatatatactgaatacataaataagtagtagtttcaatacttgaagcctagtagtttcaatacttcaagcctagcatgttgtaggtgctcaaatatattctgaatacataaataagaagtagtttcaatacttgttgaatgcatgactgggaggggatgtcctttatctcctcaaatgaaaagatgtagatagcttataattcctgcataattgctgcaatgtataagactaacccattatctaaaaatagttacctcaatacaatgtccatgtggcattttgatcatacaaaagctaactatcttgcaaagagagctaatattttagtggtaaatatgatggtaagtgtaatatagcctgtttttctttgtcatactatgttccagttagtgcctactatacttgtgaagtgtctttgctttctattgaagtagtaagttcagtcacctcttttaattcagaaaaaaaccaccctaagagatgaaatgtcactttaacctaaggtggcagtttctttttttttttaaatttaggcggtggtttctgagtattcagtatgtaatgtgataataacatttttgacaggccaaaatgtggaacaaaagtgggtttaaaatgaaaggcatgagacagctctggactccagcttattttgaggatctgcttctgaaaatggcctgaaaaagcaacagaattgcttttcagaattgtaacttgattataggcactttccttttaaagattagtaagggttacttggttctattttacttggttctattttattctaataatactctaatgatgtcaattaaaaatcactctcatctactctcaagggctgagatagtctctcaatcaaactgactttattagctttcattttgatccatgccatcacattcaaagaggattttctttttacaagaaataatattaagaaaattcaaaaaaagagccagcaaaatactttcatttccagatttactctttaaatctaacgaaaatatgacaatcttatttgtgttacctttgcagtaccataattgttctctgtgagaaggaagttatttcttatgaggaattcatatccctaactcctttaagtgatttggtatcagattaaatattaatttgaagtacatctgtgcttattcagttcagcaggtcctgcttagaacacattttcattttgcagccatggccatatgcactacattgcttttccaccagggatcactattttggaacagataacagacccttatgacctttgcattatattttatgtacttctctatccaagtcaatttataaaatcgggacttctcgacttaaaaacacaggaaaatcttgctgttttcttctttctaaatcaagtaccttgagtacgactatcttgggactggcatcaaacatcagattttaaaaatattgttctctgctgggaagagctcattattatactaaatatagaagatatggtatatcaggcagaataataattttatataaaatatcaacctatcttttctggaatgccagatacagtcttagttacttaagcctcaactataagatttacacttaaggaatttgacatttattgttataattggcctctttatgaaaaaaagagacattttcctagattgtgaatgataattatatataactgaattttaccttggtgtttaaagcaaccatttgattacaatgagtatttctagatttctactagcttctctttcatgagaatgtcatggttaggaataaggaacatcagtctaatttgaatcaatttatctaggagttgaaagagatatagtcatttctctttccctagccacttcaccatgagctcacttccacgcttcttccaactctgaaatggattagatttgtatttgttccgtgtccaaaagtagactttaaactcctggcatttttgggttgtagcttactcaattttgtagcccatgaagtgccctgtatatagtaatgagtcaaatgtctgttgaactgaagttcgtgctgatgtgactgaactggatgggtctggctttctctcttcaatcaggcaagtagataaacaagggcaacctgcagttgattattctttgaggggttttccatagcacatagttccttggggctgcccaagatggattttaggataccttcttccactggctttttagtcactaggtattcctagagacttgtccatccagatataaaattactatgatgaggctgaaggattaaaatactggaattcaagaacttcctttcaaaggcccctattaacttggttgcatttttcagagacagtggcatgacttatttttccctggaaacataattaaagtgttaacattataacagagttagctaggtaataagagtctttgatgaaggatgggcttattagttgttcttaataaagggatttggttacttgataaagttagccgtaaaggttttttttttttttaattttactttaacttctgggatacaaatacagaatgtgcaggtttgttacataggtatatgtgtgccttggtggttttctgcacctatcaacctgtcacttaggttttaagccaagcatgcattagatattgtcctaatgctctccctccctttgtccccaccctccaactggcccaggtgtgtgttgtttccctccctgtgtccatgtggtctcattgttcaacccccacttatgagtgagaacatgcagtgtttggttttctgttcctgtgttagtttgctgaggatgatggcttccagtttcatccatgtccctgcaaaggacatgatctcattcctttttacagctgcatagtattccatatatgtgccacattttctttatccagtctatcatcaatgggcatttggcttggttccaagtctttgctattgtgaacagtgctgcaagaaacatacatgtgcatgtgtctttatagtagaatgatttataatccttgtagtatataacccataatgggattgctgggtcaaatggtatttctggtactagatccttgaggaattgccaccctgtattccacaatggttgaactaattaacactcccaccaacagtgtacaagcattcctatttctccatatcctctccagcatctgttgtttcctgactttttaatgatcgccattctactggtgtgagatggtatctctttgtggttttgatttgcatttctctaatgaccagtgatgatgagctttttttcatatgtttgttggctgcataaatgtcttcttttgagaagtgtctgttcatatccttcaccctctttttgatggggttgttttttttcttataaatttctttatgttccttgtagattctggatattaaccctttgtcagatgggtagattgcaaaaatattctcctattctgtaggttgcctgttcactctaatgatagtttcttttgctgtgcagaagttcttcagtttaattagatcccatttgtcaatttgggtttttgttgcaattgcttttggtgttttagtcatgaagtctttgcccatgcctgtatcctgaatggtattgcctaggttttcttctagagtttttatggttttagattttacatttaagtctttaatccactttgaattaatttttgtataaggtataaggaaggggtccagtttcagttttctgtgtatggctagctagttttcccaacaccatttattaaatagggaatccttaccccattgctttttctttttcaggtttgtcaaagatcagattgttgcatatatgtggtcttatttctcaggtctctgttctctttcactggtctatatatctgttttggtaccagtaccatgctgttttggttactgtagctttgtagtatagtttaaagtcaggtagcatgatgcccccagctttattctttttgcttaggattgtcttggctatatgggctctttttttgttccatatgaaatttaaagtagtttttttttctaattctgtgaagaatgtcaatggtagtttaatgggaatagcactgaatctctaaattactttgggcagtatggccattttcatgatattgattctttctatccatgagcatggaatatttttccacttgtttgtgtcctctcttatttccttgagtagtggtctgtggttctccttgaagaggtccttcacattcctagctagctgtattcctaggtattttattctctttgtagcaattgtgaatgggagtttattcatgatttgactctctgcttgttttggggctgagacaatggggttttctaaatataggatcacactgtctgcaaacagagacaatttaacttcctctcttcctatttaaatatcctttatttctttcttttgcctgattaccctgccagaacttacaatactatgttgaataggagtggtgagagagggcattcttgtcttgtgtcagttttcaaagggaatgcttccagcttttcccattcagtatgatattggctgtgggtttgtcataagtagctcttataattttgagatatgttccattgatatctagtttattgtgagtttttaacgtgaagggatgttgaattttaccaaaggctttttctgcatctattgagatgattgtgtggtttttgtcattgcttctgtttatgtgatgaattacatttgttgatttacatgtgttgaaccagccttgcatcccagggatgaaaccaattttatcatgctagataagcattttgatgtcctgctggattcagtttgctggtattttattgaaattttttgcatccatgttcatcagtgatattggtctgaagttttctttttttgttgtgtctttaccaggttttggtatcaggatgatgctggcctcataaaatgagttagggtggagtccctccttttcaattacttgaaatagtttcagaaggaatggtactagctcctctttgtatctctggttcaatttggctgtaaatctgtctggtcctgggctttttgtggttggtaggctactaattactgcttcaatttcagaactttttattagtctattcagggattcaacttcttcctggtttagtcttgggatggtgtatgtgttcaggaatttattcatttcttataaattttctagcttatttgcatggagctgtttatagtattatgatagttttcatttctgtggggtctgtggtgatatcccctttatcattttttattgtgtctatttgattcttctctcttttcttctttattagtctagttagtggtccatctattttgttaattttttcaaaaaaacagctcctggatttattaattttctttgaaggatttttcatgcctctatcttcttcagttctgctctgatcttcattatttcctgtctgttggtagtttttggatttgtttcctcttgcttctgtggctcttttaattgtgatgtcagggtgtcaacttgagatttttctttctttcttatgtgggcatttagtgctataaatttccctcttaacactgctttagctgtgtcccagggattctagtacattgtctctttgttctaataggtttcacagaacttcttgatttttgccttaatttcattatttacccagtagtcattcaggagcacattgttcaatttccacgtagttgtgtggttttcagtgagtttcttaatcctgagttctaatttgattgtgctgttgtctgagagactgttatgatttcagttcttttgcagttgctgaggagtgttttacttctaattatgtggttgattttggaataagtgccatgtagcactgagaagaatatatattctgttgatttggggtggagagttctgtagatgtctattaggtccacttgatccagagttgagttcaagtccagaatatccttgttaattttatgtctcattgatctgtataatattgacagtggggtgttaaattttcccattattattgtgtgggagtctaagtctctttgtaggtctctaagaacttgttttatgaatcttggtgtattgggtgtatatacatttaagatagttagctcttgttgttgaattgatcccttttccattacgtaatgcccttctttgtgttttttgatctttgttggtttaaagtctgtcttgtcagagactaggattgcaatccctgctcttttttgctttccatttccaaatcttcctccatccctttattttgagtctatgtgtgtctttgcatgtaagatgggtctcctgaatacagcacactgatgggtcttgactctttatccaatttgccagtctgtgtcttttaattggggcatttagcccatttacatttaaggttaatattgttatgtgtgaatttgattctgtcatcatgatgctttctggttattttgcacactagttgatgcagtttcttcatcgtgtcattggcctttatattttggtgtgtttttgcagttgctggtaccagtttttccttttcatatttaatacttccttcaggagctcttgcaaggcaggcctggtggtgacaaaatccctcagtatttgcttttctggagaggattttatttctcctccacttattaaggttagtctggctggatatgaaattctgggttgaaaattcttttctttaagaatgctgcatattggcccccactctcttctggcttgtatggtttctgctgagaggttcattgttagtctgataggcttctctttgaaggtgacctgaccttcttctctggcttcccttaacatcaaggttcttagcttctttgcattgggttagaacatgctcctttagctcagtggagtttgttattactgaccttctgaagcctacttctgtcaatttgcccatctcatcctccttccagttctgtccccttgctggataggcattgtgagcatttggagaagaggcactctggccttttgggttttcaacttttttttgttgttgattctttctcatcttcatgagtttgtctagtatccatctttgaggctgctggcccttctatagggtttttgtggggactttttttggtgctcttgttgttgctttctgtttgtttttctttcaatggtcaggtccctcttctttagggctgccgcagtttgctgggggttcatttcaggccctattcatctggttcactcccgtacctggagatgtcactcgaggaggctggagaacagcaaagatgggtgcctgctccttcctctgggatctctgaccttggggggcaccaactgcctcccttggctggggggctgggggctcccttgccccatatggctcccacatgggccaccacaccacactgttcttctttcctctctgtgggtcacaccagccgcctagtcagttctgatgacagaacctggatacctcggttgccattgcaggatccacatgctgttatggttcttttcgatgggagcctctgattgctgctggttttagttggccatcttggccccaccccccaataaaggtttcattctaagccccactgcttcagcctcaagtagctctattagtgcaaaaacaaactattgtactgcaaagtagggtgcagcagaaggatgtgcttgttgccaagttatttctattgataacatagtagtatctatgtcatcaatagataatagagtttgctaatagatatcagtagtggctaagggtttgaatacccccaagtaaaattcaaagaaatatttttaaagaggcaaaaatacattaacagtttttaactctttcttataacaaagcccagttcatactactgtaaacaaattttaaaatctactttctcacctctcattcacattttttcccagtgatcaaacattttaatcacatagaaaagtaccaagagtaatataacaaacatccataaatccaccaagggataataatgaatgttaacctttcattatatttgcttatattttttattaaagaattaaagtattacagttgctcttgaaacccccttcttactgcttctaaattctgttctgctcctttgctccctggaggcaaccactaccttcaagttggcatgtattctttctgtcaattacttgaagacagcaagctgtttcttgcttcaaggcctttctaagcgctcttatctcttgctggtatgctcttctccactctcttcacctggatatcacctgtttatccctcaagcttcagtggaaatgctgcatattcatagagagctttctatcctctctatccaaactgtactcatcctgctccatcatgaattctaatggcaccctctcattttatacaacagtacctataacaatacttacctagttgtatgcttatttgtatgtgtattgcttgtttatttgtgaagcccaactacactgtaagattcatgggggcagagaccatgtctgcctcattcaccattgaatacattgcacttaacccagttccttacacggagtaagaaatagaaaaattttttaaaggacaaatcaaaataatctgacaatcaatataatccataataaattctcaatatttggctacaatcataaactcagccaatgtacttttacatttcatttgaacctcatatgtggcattgtgcaaataaatgacaacttgaagcattgggtaattaagactacaagttatagtacatgccttgtaggaatctaaagcactaagatgtatacatgtattttaaattttataggtgatataactgtgttcccacagattttaatgttttaaaaaatcttaattggcagtaattgcactatttacatgttaatgaacaacacctggccccagctgagtataaagaggctgacaatgattttctctcttctccctggcaaagaactaagcatatgcaattttaaagagacctgcctgccaggaataacacattcataattggtaggacaatatgaaattagtttgcatatttcaccattctcaaaaaaatgcataacatttttcatgtttaaaaaaagctttatgattcaaagaggaccttatttcctacacttggtgattattcacaatcattaaattattcctgtcaatgaatgtgccagaaactggctaaatggaagcccaagtggcctcctataataacggcccagttcctggcttaataccttgaaaaaactgagtttcctttgaagtcattcaaaatctataattaaatatgttaatttcctggttctactatcctatgatattctaaatcactgcagttttgattccatttccccctacaatcctaaaaccaatgaaaaggttttcaaaaatgacttccaataacaaaaatttcttccactaacaaagaacgaaaattcttcttcctaaattttgtatatcatcacctgtgaaccaacagacattaacaaggaccacaagaagatgaaaaaataagaaccaagttctccaattgtttgttttcctagaattatattttaccaatagatataacaaagtttgacactgctattctatttcgagatatagacaaaccaaccaacaagtagttattgagtgcttggtatcctcagtgttataagaggtgctttgtggagggaataatggatgtacaagtagaagaattcacataaagatgtttataatatagtttgcaattaaaaatacaaaaaaaaattgcaaaatggcattggtttttgtgacctagggagtattttcaattcagaggagagagagtgtattcaggcaagtcttcataaaaaaccctgtggagtgagggtgggagaaaaaaatttagtgtcttccatgtgttggtaaatatgctagctgctttatctcatttatcttactcaaagtcgcacaattactaagacctagtaagagctgggacaggaactcagatatgacaatatgtgtattgctctctcagctacatgctagccttgaaggatggcaaaaacagataaggtgagaagaataacatgagtaatgggaggaataattttgaaatgtgttgtgctgaggagattgctgcaatagcaaatacgttgaggagtcatagaaaataacaacaaataggcattaatagaagcaatatataatagttctaaccttgagagcctggaaaaaatttgaaattcataaagtagaaattcaagtcaaatgagttatgtggtaaaatgggcatactagtttttcagaggctgataagatttaaaaaagtgaaagaggaatgaagtatctatggactaagcctccagacctgccctggcaccagatgggaaagcatagcccttgtgcagtgaactcaatgtgtgtccctgctggatatctacagtggccgtgggccctggataaatgtcagtggcaagcaggcctcagcaaccatggggcttctgctgcaccccagcactgcccccaactcagccacagtactacaccgactacagtggtccctggcatagggcactcccctagcaccacaacggccacagccatgccaggcttagggaccaggccagagggcctgctggagtctccggaagggcttattatttaaaagcattcccaggcaaagccaatttaaaaaaactggaataagtaactatttcttcaaatatgcaaatatcaacatatggccacagagatcaagaacaatcagagaaacaagacattattagggagacaaaataaagtgccagtgactggccataaaaaaacagagatatacaaactacctggcaaagaattcaaaagaactattttaaggaagctcagccacattaaaaaaatacagataaataattaaaataaatgagaaaaactgtaaagtaaccagaataagaaatttaacaaagagatagaaataatttttaaagaatcaaagataaatcctggggctgaaaaatacaatgaaaaaaacgcaatagagaacatcaacaacagaattgatcatgctgaagaaataatatgtgaacttagattatttaagagtatctagtcaaaggagagaaaaaaagaattaaaaggaatgaagaatgtcaatgggatttatggaacagcattgtaaaagcaaatatttgattcattggattttaagatggagagaagaaagatagaagagtagaaagcttagagaaatgatagcagaaaaacgtccaaaccttgagaaagatgtacatccaggtacaggaaagtcaaaggtttccaatcagattcaatccaaataacactacctcatgacatataatcaaattgtcaaaaatcaaaaacagagagaatcctgaaagcagtaaaagaaaagaagcaaagaacaaataaggaagttccaatacacctagcagcaaacttgtttgcagaaacgttacaggctaggtgtgttagtccacttttgcattgctataaaggaacacttgagactccgtaatttataaagacaagcaatttaattagctcatggttttgcaggctctacaggaagcacggcatcagcatctacttctagtgagggcctcagaaagtttacaatcatggtagaaggcaaaggggaagccagggtattatgtggtgagagcaggagcaagggtgggggaggtaccattttctgtgttaaatctgttcttgcattgctataaagaaatacctgaggctaggtaatatataaagaaaagaggtttacttggctcatggttctgcaagctgtacaggaagtatggcagcagtatctgcttctggtgagggcctcaggaagtttacaatcatggcagaaggctaaggaggagctggtgtatcacatggtgagaacagaaacaagagagggcaggggaggtgtcacagtcttttaaacaatcagatcttacatgaactcagggcaagagctcattcattaccatgaggatggtgctaagtcattcatgagaaatataccaccatgatccaaataccttccaccaggccccacatccaacattggggattacatttcaacatgagatttggaggggacaaatatccaaattctatcaccaggagagagctgtatgatatatgcaaactgctgaagtaaaagaactgcaagccagcaagctgtcctttagtaatgaatgagaagtaaagactttaccagacaaattaaagcagagggagttcataaccaccagatcttgtttacaagaaatgctaaaaactaaaggaaaagaatgtcaatgaataacatgatatcatctgaaagtataaaacacactggtaaaagcaaatacagagtcaaattcagaataatctaaaactataatggtggtgagtaagtcacttatactttagtatgaaggttaaaagacaaaactattaaaataatagctacaataacctgttaagtggtatgcaatataaaaagatgtaaatggtgacattaaaaaatcaaaatgtggggggagtgcagtaaaagtgtagagtttttaaaaattgtcatcaaagttaagttgtgataagcttaaaataatctgttatgactgcaagatattttgtaagtatcatggtacccacacagcaaagacacacagtagatgcaaaaaaatacaaagtaaggaatcaaaatatatcactagagaaaatcacttacacacacacacacacacacacacacacacacacacacacagaggaaggaaggtaccaaagaatctacaaaactactagaaaacaattaacaaaatggcagcagtaagtcctcaccttgaatgtaaatggattaaattccttagtcaaaaaacagagtgtctcagtgaataaaaaacaacattcagctatatgctgcctacaagagacatatataatctataaggacacatatagactgaaagtgaagtggtagaaaaagatgctccatgcaaatgaaagccaaaacagagcaagaggagctataattacataagataaaatagacgttaaggaaaaactataaaaatagacaaagaagatcattatataaagataaaggggtcaatttagcaagaggatataacagttgtacatgtatgtgtacccaacatcagagcacctaaatataaaaggcaaatattagtagagctgaaggaagagatagactgcaatacaacaataataggagacttcaacactccactttcagcaatggacggatcaaccaggcagaaaatcaataaggaaacatcagacttaaactgcactctaggccaaatggacctaacggacatatttagaacatttcatctgacagaagcagaatgtgcattcttctcaacttcacatggaacattctcctggatagatatgttagatcataaaaccagtcaacaaatttaataagactgaaatcatatcaagtatctcttctgacctcaatggtataaaactagaaatgaatatcagaagagactttgcaaaattcacaaatacatggaaatcaagcaacatgctctggaataaccagtgggccaatgatgaaattaaaagggcaatttaaaattttcctgagacaaatgaaaatggaagcatgaaacatagcatgccaaaacctacagcatacggcaaaataatttctaagaggaaagtttatagcaattgataactacatcaaaaaagaagaaagatctcaaataaacagcctaatattgccttaaggaattggaaaaacaagaacaaactaagtccaaaattggcagaaggaagggaataataaagaactagcagaaataaaatagaaattataaaaacaactgaaaagatgaatgaaacagaggttttttttaaaagataaaatcaacgaacctttagctagactgagagaagactcaaacgaaaatcagacatgaaaaagacattacaactagtaacacagaaatacaaagtttcatgatatgattatgaacaattatatgtcaacatattggatagcctagaagaaacggatacactttttgatacattcaattcaattattcatgaataatgaagtcatagaaaatctaaaccgaccaatagaaagtaaggacattgattctgtaataaaaagtctcccatcacagaagaacccaggacctgatgggttcactacaaaaatcaaacaaggacacagcaaaaaagaaaactacagaccaatactccaggtgaacacagatgcaaaaatcctcaatgaaatactagcaaacctacttcaaaagcacattgaaaatgttatttaccatgatcaaggggattcatcacaggaatgaaaggatgattcaacttgtgcaaatcagttaaatttgatacattacattaagagaataaaggacaaaaacatatgataatttcaataaaagcagaaaaagcatttggcacatcctttcatgataaacaatttcaacaaattagggatagaaggaaagtacctgtattaatcctcacgctgctataaagacatacctgaaactgagtaatttataaagtaaagaggcttagaggcttaatcgactctgagttctgcatggctgggatggcctcaataaacttacaatcatggtagaaggtgaaggggaagcaaggcatatcttacatgacagcaggagagagagagagagagagagagagagagagagagaagcaggaagcaccagacacttatcaaaatgaccagatattgtgagaactctatcacaagaacagcaaaggagaagtctgcccccatgacccaatcatttcccaccagaccactgccccaacatgtggggattacaattcgaaatgagatttgggtggggacacacagccaaaccatttcagtacctcaacagaagaaagaccatatatgacaaactcacctttacatcatactcaatgcagaaaaattgaaatatcttcctatgagatctggaagaagacagggatgcccactctcatctcttctattcaacatagtactgaaaattctatccagaataattagacagtagaaataaataaaaggcatccaaattgaaaacaaagaagttatgttgttcctgtttgtagacatgatcttatatatagaaaatcctaaagccaccacctaaaagctgttagaacaaataaaggaattcagtaaagttgcaggataaaaaatcaacatacacaaatcagtagtgtttctccaacttaatgagttatctgaaagagaaagaaaaacaatcctgtctacaatagttacaaaaaaatacttagaaataaatttaaccaaggaggtgaaagatctccacaatgaaaactataaaaccttgatgaaagaaatggaagacacaaacaaatggaaagatagcctgtgtccatggattcaaagacttaatactttaaaatgtttattctacccaatgcgatatacagatccaatataattcctaccaaaatactaatgacattctttacagaaatagaaaaaaaattctaaaatgtatatggaatcacaaaagaccccaattagtcaaagcaatcttgagcaaaatgaacaaaactggagtcatcaccctacttgacttcaaaatatattacaaagttacagtaaccaaaacagctcagcaccagcaatttcaaaaagacacatagactaacataacagaatagagagcccagaaataaacccatggatttatagccaaatgatttttgacaaaggcaacaagggcacacaacggggaaaagacaatctcttcaataaagttgttaagaaatctggtatccacatgcagaggaatgaaattagggccttacctcataccatatagggaaataaattcaaagtggataaactataaaatgaccaggataaaacacagggaaaaatctccataatattggcttgggcaatgatttgacctcaaaagcacaggcaatcaaagcaataatagaaaaatgagattacatcaaactaaaaagcttctgcatagcaaaggaaccaatcaacagaatgaatatacaacctatagaatgggagaaaatatttgcaaattatagatctgataaggggttaatatctaaaatatctaagaaacacaaacaactcaatagcaagaaaacaaattacctgattaaaaaattggcaaaaggtctgaatcagtgtttctcaaaaagtcacacaaatggccaacaagtatatagcaagatgctgaacatcactaatcatcagggaaatgcaaattaaaaccacaatgagatatcacctcactcctgttatgatggctattataaaaaaagacaaaagataacgagtgttggcaaggacgtggagaaaagaaaaccctgacaaactattggtgtgaatgcaaattagtacagtcattatgaaaaccagtatggagatttctcaaaaaattaaaaataagactgtcatataatccagcaatcccactatggggtatatatccaagggaaataaaatcagtatggcaaagagatatctacactcccatgttcattgcagcactattcacaatagtcaagatatgaaatcaacctaagcgtacactaacagatgaattgataaagaaaatgtggcatatatacacaatagaatacaattaagccatgaaaaaggaaatcctgtcatttgagacaacatggatgagcctgcaggacattatgttaaacgaaatgtgtggaatctaaaaaagttgatctcatagaagtagagagtataatagaatgaagactaccaaagtctgtgaggttgagaatggtttttccagaagtgaaaattgtattttctgagcagatgttggtcaaaggataaaaacttacagttagataggaggaataagttcaagagatctattatgaagcatggtgattacagttaatgacagtatcttgtattcttgaaaaatgctaagagaatggatatggtgtttttaccacaaaaatgatgactatgtggggtaatgcatatgttaactagctagatttagccattccacaatgtgtatatccttcaaaatctcatgttgtacatgataaatataattttgtctgtcaatttgaaaataaatgaataataaaaatttgaacaagctaaaataagatagcatttaatgtatcattatgaataatttgttaaaatattgatatgtgtcaggaaagaaaagaaacaagtaatctcaattattgctaaatatgaagatttattttacattcctatagatccatgcaactctaacgtctatctagcaaatgtcatgaatttgtcagtatgattagtgatagtatcattatcacaaaacttgataactttttataaatcacttttgggaaaagactttcaaattgtttctacaaatcagaaacagagatcacaataaaaaaaatgctgaaggacttcattgatccttcttattctatttttacctttatatgaatagactgtggtaacaaggaaaaatgtttttccttcctcatatgccagttttccaagtatacaatgagcacatatataaaatcatctttagaattaaaaaatgtaaattaaaaatggaaatacatgatgtaagaaagtagtttggattaaaataagtaaaaccactagaactttctcaactacagcccaaatgagccagccaatttagaaattcttaaaaatagaacttttttttctttagatttcttgattaacaggtatagcttgctttttccaggaggggcatttttaaattacatggaacatttaaaaaaacaattatacacactcacacatacccacagaaatgataaaagacaaataacaaactgggaaaagtctttgtaaatcaaatcccaaataaatgactactactttacttaatatataaatagtatctacaaatcaataataaaagaccaacaatccaacatagtaagcaatctgaatgatttacagaaaatgtaatattactgacttttgaacatatgaaaaatggctgcctctccttcataataaaataaatgcaaaataaaaatacagcaatattggatttagtgtttatcagatgggcaggattaaaaagtttgataacaccttatgtttacaagtatttgaagaaacaagtactctcacaaactgataatgggaattccaatttatcaaacttctatggagggcaatttgacaatatttgtccaatatcattaatatttatcaaaataaaaaatgcacagatacctaggaagaaattccacttctagtaatttacatgtgtaaaggcacacacataaatatattaactacagtatgtttttgtaataacaaatcaatgaagccaacttaaatttccattgagaagtactggttaaatacattatagtacagttgtgcaactggaaactcagcagctgttaagtgacaaaatgcaagatgttgaatagtgaatacagtttgcttctatttgggcagaaaagaggcaaatatctgcatatgtgattgtatatttacagaatatctctctaaaggtactttagaaaccggagggagtggtggctttcagagaaactggggtgagggagatatttgcctttactgcatgccctctacattaggttgaactataaaaaaatgccaatatgcaacttttttgacataaaaaagcagcaattccatatggttcaaaaaataccagaataatttctaccacgtgcatgtgctacctattacaaaaaaaaagaagtgtcttaatgaaagctgcattgcatgagaatgattttattatttcttaacagaattagtatagtgtcatcaaatgaatttaagacctagtcaattgtatagatggctgaaggatagaatggccaagagggagacagcatagtttaccttttgggaggcagttgtagtgcagaagttaacagcttcatttctagagtcaggctgcctaggtctgaatccttgctatgtgaccttggacatgctaaataactataccccagtttcatctgcacaatgaagatagtgcctaacttactaggctatgttaggacaaaatagacataatggataatgtgtttggaacaatgcctgatacagagtgctccatgagtgttaactgctgttatcgtcatcaccattattattgctattgtttattattattaacatggcttattcacttcttaggggttcaaactcattttcacacttttgttctctcattttccttacagtagcccactacaactgtgcttgttttgggtctgattgtcctcagatccatgtccttagatcatatttctccttctctgctccttatcctagctccccattccaaggtttccatatcagctgactcttcccttgtccctccaccctagatgcattggtgttgctccctgttgttgcttatagttaggtggctgcaatgtcccatattcagcttctcagttcttccatggcctgcgtaaccaagttccattagtctccctgttttaatttatatttccactttcctggttagacctttactgatagagtagggtaaacacaaaggggtgtgataaaggaaaagggaggggcaggatatgattggccaggaataattccagttcctgacctgccttatttaacagccctttgggtataagctaaagctgaaagtagcctccaatgccaggtttgtggtaactaagtcctaacagtatttaacattttcactaaatcaaacaaacaagttatttctgtctagatggtgtatatccaatgttttcatcagtaaatgctgcaaactattaatttaaagtttagagttggcctaaacagtactgaaagcaaatgtaagcatcagtagtaatgcataatcaattgcatgtatttatgactgttccctcattatttcctaatgaggagttcaagaggctatgcatggctgtggatagctggtaggctactgcatcaatatcttgggtctgtcagagtcagctcagggttttagaaatgcttatttatatacttcatgaaaccaatgtgcataaaataaaaggtttattctctatttatcctctatcaaattatatgctgtagctcaattgcaaacatattataaaacaaaacaatggaagtcatagtgttcttcagcatccaaaagacaattttcagttttatggaataaaacattgcattaaagaagcttacctaaaaccaagacacaactgacttgctctgctaaaactagggagtttttttccaacattgatttcattatacaacaaattttaatgttctaattgggactttctaaaacactagacaatattaaattttaaataacgattgtcctttgaaatagttgccagaaaaattatgggcagaagcaaaacagattctatttttttctttaaaataccctcagtatgtatacagcatttcatattttagagtcaattttcaataataacagaatctctgttcattaaaaaagagtactttagttgaataaagaaaaaaaattaaacactgtactctagaaaataaagctgatttaaaacattgcgaatggttcagtgaaacagaattattgaatgaaacaatctgaagagactctgtaaatatttatttaaatattagatagaatagaaagacttctatgcaacaaaataaggtaaaatagctgagagaaggattcctctgtatgaaaaatggtatttgtttccaattttaagcagttttaaagaaagtttctttaggggttaagtagatttggaagtaagtaaaagaattttaaaatattgtaaaagtgtgttgatgaaaaagaattgggtttgaagtttgaaaatgaatagaaaacgtttgtgtttcttcttgaatattttggaaattatttgatttgtgaatatattcaagagatgatcacaaagataatcatatagctgccataaagacaaaatcaatcattgggcataaaatggtagttatatcagcatcactgggaagaaaggagatgataaaataggtgttgataaaacaaaatacacaaaataaacttttctcagaccaatttgcaaaaaaagtttgtaagaactacagatcattaaaaaataaatgcataatatgtatgaatgcatgtatgtgtatatgaatgcatgcatttgtgtgtgtactcacaccatattcaaagtatacaatagttcaacataggctaataaaatatctttaagcacttgcttttggaaatacagaagaatgactcataatttgcatgttatttatatgtaaatgagtgcttataaagtgtttgaaaacactttagtttctctcaaacattttatactctctggcatcttatttcatgtctgaatttgcttatcaatccacagcttaaacagaacaaggagatgcagcccagccactgtactcataatcataaataattaatggtttcagaattaatacattttcctgtagaaaacttataaaatggaccatttgctctaagattcaaaaaaattaccttagattagtattttatcattgtcattttctacaaatggaacaaagtacctttctaattaatcatttgtatacattccatataaaatctgccattttcctctttttatttttattattatttttaataatagcttaatttattttttcaaacaatgttcctatttctttttttaaaatttaaaaaaaattatactttaagttctggggtgcatgtgcagaacatgcagttttgttacataggtatatacgtgccatggtggtttgctgcacccatcaacctgtcatctacattaggtatttcttctaatgttattcctcccctagcctcccaacccccaacaggccccaatgtgtgatgttcccctccctgtgtccatgtgttctcattgttcaactcccacttatgagtgagaacatgcggtgtttggctttctgtacttgtgatagtttgctgagaatcatggtttccagcttcatccatgtccctgcaaaggacatgaactcatcattttttatggctgcatagtattccatggtgtatatgcgctacattttctttatccagtctattattgatggacatttgggttggttccaagtctttgctattgtgaatagtgccacaataaacatacgtgtgcatgtgtctttatagtaaaattaaaatttgccattttcaaacaatattcttttacttgtgcatcatatttcatgtattcctgaagcaagttatatatttttaagttgccttcagaccctatatcctgggattctcacagtagtggcagcagctatgtcagaggacccttacatacaggaccttattcaatcgccataggaaatcttatactaagtggttttacctccatttcacaggagaggaaactaaggctctgagatgttaagaaacttgcccaaattacacagcagttaaatgacagaacaaagattctaatgcagtcatttcctgcttcaaagccttcgctttctccactatgctctatttactggctctccataaaatatgtacaagggaatgagagagttggcagaggaaaacaagataatattaaagcttcaacaacataatcccacccatacccccaggaaagaagaaaagaaaagaaaaacaacttctagagaatgttatggcattatttatacatttagtctaatgtattatattacacattttctgtttaagatactgcataaaacaattgatgcttggagtttcatctggggccctgagaaaatcttcaatcagctatcctaaaattcaagaatgtcttctagattctatttactgaggcagggctgtcactgatttttttttttaattgcaattaaaaggattaaaatttaaaaaattgaaatgtaacgctctgttaaccagaaaattcaattaattagtatacttcatttcctgaaaactgatattagtgaaagctttatttagcttggctctttcacagatttgtactgaatgtgataatgcatgtaaagagcttagagcactgcctgactcatcagtttgtcaaactgttttccgtaactgttgttcactggttcatgtaacaaaagtttactaaatgcctactatgttccaggcaaaatgctatgtgctggagatagagtggtatataaaacaacattcctgcccttgcgaaatttatcttttggaggtataaatgtgaggcggtaatgcggttgctattttattgttattttcaaaatcattatcattgtcatcataattatttctcaataaaccaatgtccaaggatacaccatctctgaacttaataccatggctatatatatcttctctcactattaggaaaatctattatatggcaggacatacactctttataattctcctttagagaagttgtctctcttaatctctaaagcacctgaaaggatacctgaaaggatagtgaactaggattttcttgagattacagaacaggttacatgaactgttttatgtactgaaatgctaataaatgtttaaataataaacatttgtggtaggatttggtttgagattttctttgactataaccccatagtgagattttggagagagtcaccctcaaccaccgtaagacttctttggaggttaccattatttatcaaaaagaacctaagcattctgcatgataaaattggttcaggtcagtacacaacagaaagctgttgggttgtgtaacattaaacattaaaaacaaactaaacaatttgcctaagagcaagcatagtaaacccagagtaaggttattgcaagggtatgcaccccaggccaatgtcaggcaaaataagacaatgatgacatgattctggggagaaaatataaatttcatataatccaacaaagatttaaaagttcaaccacaaatttcagtgtaatttaaattgactatgtgttattattgacagcaaaatcaagaatggctagcatgaaaataattattgaaattcatctgaatttcaaaccatctgggtgcttgaataagtcctaaatttaaaaatattttcattgcacagtcttatgaaccaagtcacttaaaataagaggaagaacagaaagaaggtacaagaaattagtgagtttctattgcaccttaaaaattccaaagtgattttaccccatgaagtgactgtcctcattgattaaatgagaaaacttatgtgggagaggtttagtgacttggcctatcattggcagagtatagaccagaatctagaattggcactagatcatacggtctcagtggtgtgacatctacagtcttaaactctaattatttctttactacaaaattgtgcaaatcaaactttaccaatagtggctcttcctcaggcaagaggcaagagaacatacggcgtgagagggtgggggaaactgtttctggcctacataattgtaggaaacttcccttctttagctactgctaatcttagccctctctcactcatcagcaccacgaaattgtcaagctccaagatttttaattaatctgaatgatactgggctatatgactttaaaatattccagtaacatttcctttcctttccttttttttttttggagacagaatctccctctgtttccctggttggagcgcagtggcatgatctgggctcgctgcaacctctgcctcctgggttcaagtgattctcatgccccagcctccctagtagctgggatcataggtgtgtaccatcacgccaggctaatcttagtagagacagggtttcaccatgttggccaggctggtctagaactcctgacctcaagtgatccacctacctcggcctcccaaagcgctgggtgctgggattacaggagtgagctgccccgcctggctctgttcccttttcacgtatgggtcaatgtgtttttgtcctagtattttgccttaatttcagttctccaacatgcagcccatcattttcatttcaattcttcccggtctcagacaacccattttgcttccttactggcttttacttacacttttcagtaagtcatacattactttcatgtctttccttatacagttttatcttacctaaagtgaaagaaatccttcctcccagccgcccccccaccacagatcttccatttttattcatttcatttgggttctctccaattcaactgatgagtagagacagacatgaaaatagcatccaatttagatcttctggggatttttagtgagcaagtgggatctcacattttaccaagaatcacaaagtcccagcattagaagggtccttgaagttcattgaatgcaatcactcaaaaatcttatgtaatctttgtccattaaggcttgtcatcagtgagaatgtgaactcctcacacttgtactgtttagtctcagtactctgcattctctcaatgtaagtaagcattttatactatgtatatggttacatagttcaaataatcacataatctgttaggggccataatccacttaattgaactccctcatagtgcaggtgggtaaactaaggcctagagagaagaagaaacctactcagggtcacatattcagttggtgatatccttcctgagaaccagatcttctgccttgcaggccagttcttgccttctgatgtaacctacacttaacatattgccttaccagtattgcttccccttttgttaagtacatgttgtcttctattagatgaaggcaaaggttaaccaaaggctgagctcaatctcccttctttacgtaaccctccacagcatctaccacaagatctgggacagagcagtactttagaaaatttcataaatatgctcttatttccttctcctaattttcaaatttctcaacacattaagataaaacagacttaccaatgacttactaaatacttcccttgtcatttatcaatatcttgtacttatcatttagttgactatctcactaactccaagactgaattagcattgcaattaagattccataagacaggtgatcactacagagaggtggcttgtccttccatttctgagtcacaaataaatcactatgttaacaggatagagaatgaaaagttgcttaaaaatagacatttcttccaagcactcaaaatccccaattggtacaattcctgagcttgggtaagatgatatggcacttcagattaccatgaaaaattagaacgattagaaaaaatacacatcatgaaagctatactcttcccatgatattattacccatgtaattttctacaaaatagttcatgaaaagagaactattatttgaaatgttgaaatgaacttgctgaagaggttttcttctggcaaatgactctttaaaagcaaaagagaagaatttagtatagaataaaaccgttcaaccaatcttcccttgacactctattgtgagaaatattcttcagaagagcagagaattcagtgcaggtggaagcactggttctgtaattcacacttttatcacccatttcttcacagcctaggtcacttaaggacaaatatatgaactttaagaagctaagagagttttactcagtgatagctttagctaggctttgggaatggtttgaattctattccatgggaatagtgacaagaatatcttgggcttaagccacttgtacagtagaaaattcactgtttggggagatgaactagccatcacagattactagggtacaattatggcctgatgatagtaacaaattgttcaagaatgataataataatagctggggcagagactattagctatccaccaaaatctgttttctttttcttccttggtaatggagttatagaaatcacatgactgctcagccagagaacacactttccagccccagttcaggtaggcaactacgtgctcaccaatggaagccttaacacatcacaagtatactcctaacactttttcccctttctccttgctagaattaggatgtggtaggaatcgtttcaaatactcagatgataacaatggttttagaggatgatggaagaacatgaagagatgaatcctggtccctgcatagtgacagactgtgtgcagcagtgtctgctcacacctcatggactgttacatgaaacaatctttgttgtgtcatttcgttacagcaactaagctttttactctaacaaatgtagctaatgcttattatataccagagactgtttaaagagtttattacatgtgtctgttgcatccattcacttgtgccaaagtactccttgtactgtaggtcataactgaaatggaacttctccacaaatcctttccaatttaccttcaagcttccactgcacttgaacttatttgcccctttctcaaaggacttctgattttctaacctcatattataagccctgtttttatatatcttatttcttctagcagagcaagcttccagagagtaagttcatatcttattctcctgtgtaacctgtaaagtgctggtactgtgcctctctcaagaagtgcttattgaccgagcgaaggactgggacatttgagcttcatgctgtttgtctataatccagtgttgcagctgaataagcctggagcaagcacacatttgtcatgggcaacagaagcagaaaagaatctaggacccagaatcggtaacaggttgaatgcaaaaaacttttacctacaatcctgctatcttatgtcttatgtttccagaatttcatagtaaccaagaagatataggaaagtaatggatgatagctgaagagcttacattctacttatgaccaagtcctaactgggttgtgggaaaacgctcattggtaacaacttttgtcctcttgcaaagtcttgctagagtcaaatgctaataggctaagtactattttgagtctaacacctacactgttatactaagctgcttgcttttcttttacttgtcttcatatctcacaactattcctataatatggtagacatctacatgttatatttggtactaaagggcaataggcattggtaaaaacggaaattcaagtgaaattttcagagaaattaattagacggatgtgttataacagagtctggcatgaggcagtgatcatttgagtaaagctgatcctcaaataaattatgtagaaacaaataaatatactgacaaatttgcacatgggatcttgggctgggatttattattattttttgcatatcattctaaatcaatgtaaaataggaaaattggagcaaagcagactacttaagtttttttgtctttgtgttttgatatatcattatcattaacatttcttaattccttttgcccggcaaaggagaaaattaaaatacagaagtcgaaatactaaaaagtagcttttaactatggaccccaaaagagtagtatgtgagtatactactcttatagatttagtttttcctcgtgaaaaaaatttaaaatttacaaaagtaatataggtttcacacacaaatttagaaacaatattaaaatgctatactaaagataaaatttagaaacaatattaaaatgctatactaaagataaaattctgtaatgaatgaaaaaaaatcttgtcatccagaggtaacaatcataagcaatcataatcataacaattgagtggatattcttctcattgatttaaaacataactatgtttttcaagaaattatgatcatcacatagatactgttttattaccagcttttttccacttaacatatcatgaaaaacaccccatgccagttttctaaagcatttcagctaatactgcataatgctgtatggtataggtacaccatgatttatttaaccagacctacattataggacttccttcctttctttatttgtcttcatgccttcacatttatttcatttacatttaactgcacaaaatgttagggtgaaatagttatcaatatttaataaaatattttatgaggaatttgcttttttgacaaaatttttcctaaaaacttttaagagaaaattgcaaactccaaactgaaatcagtttgattaactgtctggtgacaggaaaggaaaaaaagaaaaataattgctgtttatttaactcagctgattaatggtaaatgaagcaaatgtcatggatctgtcagcatctatttttcttaactgctctattcactttacacattttctttatgcacttcatagacagccacaaaaagacaacactaagtgtggttagtagccacctgatggaaggaagaaccaaacagcttaagtaaaagaaggagtgccacatacatgcctgtactcaggcagtctgcgatgaaaagtgtgctatacctaattcccaataattttatgatctttgcatccagcttgagaggtaataacattttccattttacagattaaaacacatttagtttccaagatgttaaactgtctaagatcatatagctggtaaaaggcagcagcaaaattggaatcatgagtgtttggcttcaaaatctaaccactcttaaccactgcaaagttgttcttaccatgtccagataaaatcagaggaggatatcattttgaatattaaaaacacaatccatatactgtgtagtactactaatgtgcaatattacttcttaccttttcacactttaatgtcagattcatgttcctctttagggtgggatgttggccaacttgaggatttccagaaataaattaaccccacatcctaaatcttgccttaccaaaaataaaattttaaaaaggacagagatttcttcctcattacacaaaggtaacttacactgaagtaaaaatgatgaaatgggaacgtgacgagacacaggaaagtaaggaaaataacattatcttatatattgattttggattgtatgatattctattagtagaaatcaacaaatttctttttcatacataagctgactttcttttttttttttttttttttttttgacggagtctcactttgtcacccaggctagagtgcagtggtaagatctgcaacctccgcctcccgggttccagtgattctcccacctcagcaccccaagtagctgggattacaggcgcccagcaccactcccagttattttatatatataatatatatatttagtagagacagggtttcatcatgttggccaagctggtcttgaactcctgacctcaagtgatccacccgcttcagtctcccaaagtgctgggattacaggctggagccatcgtgcccagcttctttgtctccttttaggtggaaaactggataggacatatcaatttcaaaagatgtaaacaattcagatatgctacttctgcacattttaagttttaatcctgtgggctataatatccatgattgaaaataaagaaaagaagcaagcattaattatgcaaatgtttttccttttgattctttctaatccccaattaaccactctttgcatttaacttatatatgtttgcataatatactttaaaaatattatttcaaacatgcatcgatacttaataggtgattcttactgtaaagaaagggccttgtctccttcagaagggcctgtggtgtaggatgtagccgtcaggtgtgccattgagtttacattagtttgaaaattattcaaagaaagaaatggtaattatgctcaccaaattaacacagttaaaaaaataaaattcagtgctggtgaaagtgagtaataggtcctctcatacactatcggttgtaacataatttagttaagtttttctgtaaattaatttgaaaccatatagcagaaaatttttaaatgtctattctgtctgacctattattttactgctggaagctctactgctgaaataatttgaaatgtaggcaaagatacatgcaagaagtgctcaatgtagaattatttagagcctgggcacagtggctcaaaactgtaatcccagcactttgggaggcctaggtgggcagatcgcttgaacccaggagttcgagaccagcctgagcaacatggagaaacccgtctctattaaaaattgaaaaattagcctggcgtgttggcagacacctgtatttctagctactcaagaggctgaggtgagaaaatcacctgagccagggatatcaaggctatagtgagctgtgatggtgccactgcaatctagcctgggtaacagagtgagaccctgtctcaaaaaaaaaaaaaaattatttagagtgccaaaaaattgaagacaccctaaatatccactgttaggggaatatttaagtaaattatgagccataatagagtcattaaaatgatttccaaaaaattatttacagatgttagaacttacatgtggcaagtgttaaacgaaaggcaagatgtaacattacataaataatatgatccaaattatgtaaaaaattcagaaatctgcaagcaaataagccaaaatgttagcagttgttctttctgggttgtgacagaatagtttccccccttgcatttttatatttttctgtacttttgaaatgcacttgtctgtactttctacattttctaaaatgatcatctattttctcaaaaattaggaaaaataacatttaaaaatgacttgacatcaacagtttagaatctgagttttattaacaggaccaatatttgggaaggtcacactttttgctcacttcctcatcccttggttgtttcttccattactggtgtttaaaaaaaaatgtttctaatagcaaaaatgagtcagttctctccaaattacagattctttgcaagagtaaagcaagccaagaaagatgaacttgctaaaacttttaggcaggtttttaaatttttgtttgtttgttttttctgagacagagtcttgctctgttgcccaggctggagtgcagtggcgcgatctcagctcactgcagcctccgcctccctggttcaagcaattctcctgcctcagcctcctgagtagctgggattacaggagtgcaccactacacctggctaatttttgtatttttagtagagacggggtttcaccatgttggccaggctggtctcgaactcctgacctcatgatctgcccgcctcggcttcccaaagtgctgggattacaggcatgagtcactgcgcccagttggtttttaaaattttttatcaagcctacctggattactttcacttttctagctgagacatttgcaggtactcaataaggaagtgtaaatactgctcaagcagccccacaacaaaggggcttctcatgctaaacctggcagggagtgaaaatgcctttattttgcagtgaagtgaatctgaggaaatcctgtgtgaaaattttgcttgagggccctaaacaaaacacagatatttggcttctatccaaggtctgtgaccttccctgtggtcaaggttcacattattatttttttttatatggaggaagccctgaatatgggattgccaccaaagtcaataaaaatatcttctgcttttgaaagaagtgtcaatcggataagcagcgtgtacccttattattccaagaagagcatagttataatgccaagtcagagcttcatagctttactgcataaagaaattaacatacaacttaaaatacctttggcctgagttaactattcacaggttttccctctttaagaaaactcaatatatttaacacaggcttaaagaataaataaaaagaggtaaattattatttacactgcaggtcaatcctttatatgtatatatttcaacagaagacaacctttaaaatatgaagggccccagtgctacaattttcagatgacataaggaaagtagagaattaaaacttatgataaacaatcaggagtcatggccaatttaagagtaatcagaaagaaatgtaacagatgttaaaactgaatataaaaaaatttaaaaacaggttttaacaaacatttacagtttttcaacaatgttttcatttctaacagtaaatgatcttaatctagggttagtttcagaaataccacaatccttctgctctgatattaatacctaagtatttataatagtcataggatacatgagaatatcatcttattgaaacacatttctttacaattcttagatctatttggcacaagcacggataatagcagtgcccgctctatgctatactcctagtatagttgttattatattgttttagccacaactaaataaaacataaatttattttctagtgagcatttgcagtttatgagtcaagaactctctgagaagataatttcatgtactttccacctgcccttttatcaacattaaacaaacagtatgttttaccacaactcatttctgacattaacagttgcttttatttctctgccaacctcagccttgtcagcaggacttcagtgtgacagcaatggcagctcatgccaattagatccttttcaaataaatttctttttagcactgtacacatttgaatagatcaaaaaatgtaaaaaatcattattaaagcggctgagggcaaggaactaatccatcctgtatatgcctgtatctctccttatttaacaacactgacttccagctaaacacaagaaagaaagaaagaaaacaaaagaaagaaagatgcaaaatgcatcctgagtgtaagttctttggtagtttgaaacacaccactatatttatatgttctttggaaacgatattgatgattagagtatatttccaggacttgaattaataacaagtggtagaactcattttttcatgaattattatggaagtagtagatgggaaatttttgtcctgaggatttcacccacactcttcccacacacatatgtacaaatcctctaaaaaatggcttcaagaaagtctcccctctcttttatttaacaaggcagctatgcagcctgccatcctgggctaacagccagaagaagattatggcaaaaataatcacctttgcaacattaaggaaaacatgaaactggcactatgattcaggggcttatttctttccctctaaatatgataacacttttaaatttttatttgggaaatggttttctgcaagatgtatctaaaaaaaagagttgttttcttttcaacaaatagctagaggtgctgagagatttcctgttaaaactgtgtaaggcatttgactacttaaaagggaatttagtgctgatgaaagatgccagtttgacagtcacggaaaatgaaggaagcattctttattcccagagcacgtcatctcaaaatgaggaatcatctcttatggttaagagggtcacaccctattttttaatattcgttgggagtacacacatgctagatgatggaaagatacacatgaaacacactctgtgtcctctaagatattacattcttcaagccaccatattcctcatctcaggggcatagtatacatagactagtggcctctactttaaaagggaccaaggcaacaaaaggtagtgggtgagagattcaaatgaaggacaaaagagagcttagtttggacaacttcactatttcctgtaagtgttctcactctaaacttaaaagttagacctgcttaggctcttagttgtatgttatctgtatttataatctgtgggcaatattcatcacaaaccctatctacgtctaccccatccctcccaaaattaaaacatcttcataaatatttattcattgtgtgccttttgatagttcataaaacctgggaaaaattattcagcccccgtacctcaaacatagtactatcggtggcacttgggacacctgtgtagttaggtggtcccggcttagtgtaaactaagagtgggcatggggaaatataacatctcccaggggagtttatttgcattagttaattgaatagaaagtagcaggaagaggtgtttgaggacatgtgtcatatgcaaatttgtggtgggaaatgtgtggggctagaaatgaagaaataaggacgtggcttggcatgacacatgtcctctgcctggctccctgagtccatacattgataagtgcagctgacaaaggttgaaggagttcatgaagaaaggagcataagtggtgctgcttcagaaactgagcgaaaacatttgacacagaacaggggagaggggcagtctccccatttctgcctggtacatagtatggctctggcaacacagtgagaactgagaagcagtagcaacgtcgtgcattgagagatgggtggctttgggagtcctgaataggaaagggttcactcaaagagggtatcattagttatggcaatggccacctggatttcttgccatgtagtgatcatcaacataatttttagaatggaaatcatgaaaagattgatcttgaacatgtgagatacttggtgatctcagaaataattgggtcgactcaggttgcaagaggctgtgatcctgcaaattgcaggggaaagactgtttactgggatgctaggtaagtctgcgtgtgaactcatttgttcccaaattaatgaagggctatggtattcgtataatgaagaaaaaaaatcaaagctttttctaaacaggttgtggagcctatctaccaccattcccacctcttatacacacaaagatttttacaaagtttggacactgaactccacaaaacctctgcaggggggctaagagcatcacatatatgtcataagccactggagttccatgctggcttttgtttgcttatgttccacgtttttaggtattttcgtttttagctcctgggggtaatgggctgtgatgatttagtgcagggccagtccagagttgtttttgccttagtcaaggacaatttttgaagatctgcatttcccttgtctttttaccttatcccgaaagcaacactctcacgactttattttctgtgtcttgagtgctctatctctggagagtgtttctttagtttcacaacccactgcacccttcctctttccctagcctaaatttcttctcagggctcaaactaagagcttcctaggcatcctctctctctgaatctcttactcaaaagttctgaacaaaacctcgagcacctgaaagttcagctgatttaagggagctcattgtacaagcatcccacgggctgcactaaatattgaagcatgtatgtgtgtgatgagaaacggtactcaatgactcttgcaaatttggaagcggcttctttttcattattttattttattcattagcaaacagaagactgagactttaacaaactttgtaccagcaaaatggtgttatgtaaggaaattcactcactgtttatccaatggtccagagaaaaagcaagtttacagtctattaaggcatgatgaagaagaacttcggaattatctttaaaacagagtggtacttcaaggattctaaaccttggaagtactttaatagaggatctgctgctgtttccaaacaatgaaacccaaagttgacatcctgagaactaataacgtaacacgttactctcaaacttcaaatgtcctggcatttattgcattattaaaattgtgccctctgtgaagtcaactgagtatagtgtggacaaaaaaaaaagaaaacattaaaataggtcatggtatggcagcagtcaatgactttctaccctctccaaatatatgtttgtctcagagaaatatttcaccgactagcactttgtcacggggctcgcttctcattaccatttcaaatgtgctttctgtgctctgaggtacctctcggctgctctagggctttgccgagacactaaaaagtttagttgcagtgcataatatacaatgcaagttactagtatgaatttttaacagtgttttgttttatcacatcccagagtccctcgagatacaagaagtgggggaggccttatttatttatttatccctcctccccctcttttaatgcaactcttgccattgccgtgggtgtatgttcataacaaaaacttaaacaaaatttgggcaaatgaaaacatatgcatcttaaggcaattgtcaaaacaaaaataactgcctgtatgaaggctttagtagaggcaaaatgagataaataaatattgttaagggaatcataattatatctgaatagaccagtgttgtgtaatgttcaatatagtgtcagtttcttagccagcaaaagttagaggttagtctgatgaggtggttaagagcttgggctccagactcagactgccactgcctgtgtttgagtacaggctctgtaattcacttgctgtctgatcacccataaagtacttaagtcttctggctttggtttcttctttcataaaataggaataaaaacagtatctatctcatgtaaagattacaggaatttacatatagaaagccctttcttgagacagggtctggctctgtcacccaggctggagtgcagcagtctcggctcacagcagcctctacctcccgggctcaagcgatcctcccacctcagcctcctgagtagaaaggactatgggccttcattaccacgctgggctaatttttgtattttttgtaaagacggggttttgccatattgccctggctggtcttgaactttcgggctcaagagatcctcccgccttggcctcccaaagtgcagggattacaactgtgagccaccacagccagccagaaagcctttgaaacaatgtctagcaaatagtaagtatgcaataaaccttagatgttattattattggtcattagtcgatgtaagaggaaaacaaatggttgcgtgcattttgaccattaaggcacatctttttttaataaaaaataactaaaaagagccaaaggaaggttcaatggaaattatgtcctgtaatgacaggtggaaattaacaaaagccaacagctaaaagttaggtatgcagtataagttaaactgagagatttatacaggagaaagttgaacttctaaacataagctaaatcagttcaagaggtgtttactaacattctttaatgatggatctacaattggttatcaaatgatccctctagctctgtagaagcatttcgtggaaaatcaccaccatactttcaaaaagtttctgcccagaaagataatgagttgagtgaacaacaaggtaggttttgtgcagcaatgcttacgttctttgcaagatactggagccatagtgttaactgaacataatggactctgtagtccatttcagctttagcatcctatgattttttgactcattatatttctcatattttattacattacttgcatccttgaaatcgttcattagctttcagttagaacctacaaagagtaactcctaacctccaactgtctcattaaccttgcttagcttttcttttttccctagttctctacctcacagtcacagcttctcctcctatttctaaaccatatccccaaatataaataagtacacaaataatattgtatactttttctcttattactgagaaacaagccatttatatcactcttcaacttatcaggggctttggctgccactgaccactttatctgaagggaaattatgggagttactgtagattatgtcctttctatcaacccctgcatataagtggtcaccaatctcgtatatcggaccatcataatagcatgctaaatacacactcatgtcagggactgtgccacatcactgtagcctcaaggaagttaataacttgctaaagccacagagatagatagtaaatggtattgctggtgagaaaagaaaaacagctccgaccaatctgagctctgtgaggtctgcaggtccagaaagacataagtatgagacttcagtcatgccccccgccatgcctggggcaattgttgtcattttgtttctcactagctgcctcaaccaatatattcgtattcctggaattttgatgcaaagaaaaatatatagtcaatccatagtgtattttatgttattaaattaattaattaattttgagatggagtgctctgttgcccaggctggagagcagtggtgcgatctcagctcactgcaacctctgtctcctgagttcaagcaattctcctgcctcagccttccgagtagctaggattacaggtgcctgccaccacgcccggctaatttttgtaggtttagtagagatggggtttcgccacatggcccaggttagtctcaaactcctgagctcaaagtgatccacctgcctcggcctcccaaagtgctgggattacaggcatgagccactgcactggccagagtatgttattttaatataaattattggtaaacagctcaggaactgcctctactttccctttaaaaaaatccacttgtaactgctgctaaggggagtgtatattcagggcaacttggatctatgctcccaagtgcaaccctcaagcttggcccaaataaactctttactggcccaaaagaactctttactaatattaattttgcctcagctttttcattttaggtcaatactggaattaaaagttatttctgggagactctaaagttcatgctcacactggtgatgcagcttctcccccgtcatcttgtttcatcttccacaattttagtaaaccaatatttctcatttgagccaatgaaataacctcttaatcaactaccttgtctccagatttaaccattcctcaatcaatctttatttcaggatgctgttagatttagcttgctgaaatgcaaatgtaatcatgtcacttatatgctccccactgccttcagaagaaagtctgaattctacagataatataagagggcccttcataaagtggtctctgcctacttctctgccctcaactccccaacaggcacctttcactctggttaaactaaactagccttagtttcttcaataattccacgctctctcatgcctctgggtttttgcatatgtgattcccactgcctgaaaaggtcaacctcattttgtgacctggccaacttctgtctgtcctttaaaacttctcagcacacaggaggtactcagtagacatcttttgactaaaacatttataagactacctcctttgtaaaattaagggatagagatgaacatgggtaaatacagtaatctgatttgctaaaatgctataaaaagtacatttggggcttacgcttctagaaattgttttcccagccttgacctctcatctgtgaaatgctgcccagtgagcagatcataattatgaaatataatatttagatattaggcagtagaatccttgctgtattcattaaatatatattagttgatatttataaatgttttatatatgtattacaaaatgttaaaatacatttctgctctatgaatgaatttgttacaacgttaggttctagcttttattaacctcttaccctaagtgttaatatttcccatcctattgggagcaataggacacatttcccacattagcttctaagaggtcactgatttgttttcagtttgtctggtcactgagagttggcatagagttaccttcataaatgattcaagttaatgggaaatattaaaatgaaagaaattacagcaaaaacaggactccataagtgaaaaatgatcattggaatatcactccacaggggagtcatcccacttagctattcgttaaaagtagcttcaaggacatagggaagaggtgtagctgtttcaggcccaataggaatgcttttcgaggggatgaagttgggtttaaaatatgtaagggtgggctatggaaaggctcatgacagcattgccaataaaataattttccgtggaccacaggtggcttagtgatttttggcttaaggaataagcaggtgagaattaattacaatttcatgtcataccattaaagcatgttcaacataatttgataccaagaactgctgtctaaaatatgctatatcattccctatgtctacatcaattctatgggagagtacatatatgcatggatgagaaatatatttgttattatgcaggaaaataagtctacccccatttttaaagtaccatctatcttcccccactcccaggtccccttttgctgttagtgtctaaacctctctttgaagtaggagaagttgtttcctaacaactcttactttaaaaactttatatcttccttctcattctctcacctctttcttccttcctacactgctcacttaagtactctttaccagtctgaccactatcttttatctgtatattataggcaaaataaagtcttgattttttagaagggaaagtttacttgtacttttctacctcttgtatgtccaagacctagaaaatttataaagattgaaaatgcagtacaaccacctaaatattctataccagtgtcttatttgcctgactgctggtctgcctttctcatgagactagacagctcccgatagcgggatttaacattagtcctctgtgttttcactttctagaatcagaatcaaaacatgttaaagctggaagagcccttgcaaataactgaatctctacattcttagatgatgaaattgagattcagagaaacgaaattacctgcttaagaaaacaaacagcctccacatcatttcttggtttgctactacttgatctttgctttcctcccacggctttgtttttttgagtttggttctttactgtcgctctcacagtatatgttttggatcttggctctttatctggatttggactcttacactaccaatgtcagtttgttaaccccatgacttatgatgtcattcaggttatgttcctgggcttctcatctgcttcaagctggtataatctagattcttgtctgagccctgggttttgtcatccaactattacatacagatcttattttctctgtctcttttttcttttgagacagagtttcactcttgttgcccaggcaacagtgcaatggcatggtcttggctcactgcaacctgtgcctcccgggttcaagtgattctcctgcctcagcctcccaagtagctgggattacaggcatgcaccaccatgcccggctaatttctgtatttttagtagagacagggtttcaccaagttggtcaggctggtctcaaactcctaacttcaggtgatccacccgactcggcctcccaaagtgttgggattacaggtgtgagctacgacgcccagcctttttttctctatcattccctaatcagttagttcagtgacacagacttctagaaaacagagtttaaaaaatgacttctttcactttaaggcaattatgtctaaagaggtgaatatggcttcatcagcataggaaacaaaggcagaaatgttctctgtttggtgaaaatcagtgaagtgtaaaatggtttatgttcaaaccatataaacactgcctctaaacatttcatattaccatccatccaggaaccttaaacattgacatctgagtgaatgtgacatggcctcctccacatctaaaatgtccactgggcctatgggatgacgaaaaggaattactgaaactcacaaagatattgacaatgaaaaaatattttaaatgcagcactattttaattctaggttagacagaaaaaaaaaacaggtagaaagagttttgcaatattgcagagatagatgttacctgctgcctagttaggtgtaaaaaaccaaaactgcattgccaaacatttttcattttatgaacatgtattggaaaagcatcctccctaatcttattcacaaacagaaaatacattgctcgcacttaaagaaaatgaaatcaaacaggataaaacatgagcagagaggtttcagacatgtcccccaggcataccagctctcagacttgtgagaagagcagtcctctagctagacagagattcttccctcaactgggcagatgggcttgggaaacgcataagcaattagcttttctgctgaagcagaaagaagactaagaggaaaagaaatgtgtcccacatcagtatgatcccaaataaatcttatcttgccctgtaatcatagaaatgcagtgatatttttagaatttgggcttgagttttaacaagtgtggaagttatatggaagaaaggaagagcacaacaattatatttacagaaactatctgactttgcctattaataaggcataaaactcagttttccataatttgtttttattttgaaaactgaaataaaataaaaatattgaaatagattagaaaagataaagtgaaaaggcaagacacagactgagacaagatattttcaatgtatataactaaggatcaatatctgtaatatataaagaattcctatgagtcgattagaaaaataaaaactgctccaaagaaaatcaagaaaaggacaaagtgatgcaattaaaagaggaagagactccaatgtccaatactgaaaagatactcaatcccacctgttacgcaaggcagtacaaattaaaaccaccacacccattagactgaaagaaaataataactctgttaacaccaagtgacgtgttggtgatgatatgggaaaaaagtgttctctctctgtctctccctctctctctatatatacacatacacataaacacacatatatacacacatatacatatatgtatatgcatatatacacacacatatatatggatatacggaaatgaatacaattactttggaaggccatctggaatatctaatgtatttgaagataaaaaccgaattccacttccaggtatctatcccaaagaaactcccatttgtgtttatcaggaaataggcataaggaagttcattgaagccctgtttgtgtggttaaaaaaaagataatttgaatgtctctcagcagaggaaatagataatctgcggtttattcatacaatggaatattacacaggaacaaattatctagatctgcctttatcgacctgaaaaaaatctcaaaaacaaagctgtttgaaaaaatctatttgtaaaacatgtaaaatatttatgcaaattttaggagtaaaaagagttttagtaatttatagttatgggtacttacatatatagtaacattatactatacatgcaaggaatgatacaaactatatcgactttaggagagcagttaactctgggaaggaaagaaggaagtgaagttttacctaggtcttttaaattttctacctttgaaaagaaagagtgctatgaagcaaatgtggccaaatgttaatatgagtttaatattggttgtgtgcacataaatgccatattttctgcactgttcttgtatgtttaaaatgtttcatacagaaaaagtgtatgtgtgcgtgtgtgtgtttagaaaagactagggaaagaaaatggaatactcagtgtacaaaagggtgatgaaaagtccctgattaaacagaagtgtcatcattagctctgttcttctgatgaaaatgtttattagctagtcataaaagttactatattaagatgagggaaattaacgaagcattatctttacagtatttttttctaagtgaagtacatcaatggtcatttaggcatgaaccaaaaaaaagttattttaaatcgtctggtccctgtccttcagatgcaatcagcttcagttcattttgttaagtgattggaccttatctctttggtacatcacaaatgaaggagatcctgctgcttttagttttgcttatagtaaatccttgatggcttcacagctgagtgacaggagtggatagggcacaggattggatccttgagaattcaacctccggcaatgacttcttataagttggacatgtggcttgacttctctggacctctgttctttcgtctttcaaatgacgataataatattgaccaccaaatattatttgcacgtattttaagcaggatctgattaacctaacactacttttaaaatatacttcttttcttagatgcccaccattagataaattcaaggtgctacacaataagcttataataatgatgtcattggaacttataacatgagattctcttatgggcaaaaaccacttatataagttcttttgatacacccatcaactaaagtctcttgggagaggctcaagactgatctgcttcataatgaaaattctgaaagcataatataattttaaagtattgattatattttaagattgatcatcacctagcttggagcattagctattcaatttgcaatgagacttagtaataaacatggcagaaacattgggaaaaattcaatcatttatttcactttgagaatgactgctcaggtatctgagtacaaattatgggtacatattgtgttagatggttaattttagaaacagctcaagactaaccccttgagagcacatttacagataaatgcacaaaaaaataaagagaggaggctgcttatgcatagtttagaagctacatgaatctgcaaatgtacatagcacaacatctctgaaatgccttatgttccaaaaagctgctgatctgttttcgttaggttaatcagatcctgcttaaaatatgtgctaatcagtactcaactgcctagttggccaccttaggtgaagctctaggtgctcattactaatgaaagtttgccaaagaaaagcttaaaaatacccacatatataaatatatcattttataatatacattataattttacttagacattaatatgttacagcaaagttaatatgccattttacttttacatttcagttcaatttctctagcagaacaggaatgaagttagaacatgatttgctgtgcttatttcaaggtgatttacacttttctgttgatcaaaataggcacatagttgccatggaaaagatatttctatgcctaaaattaccttcagaaagtttgtacttgagggctcagaagagtaaaaccttgtcatgtaactcgatactttttactaaaacaacaggcaacaaaaatagtcagaaaacagtactctctaaacattaccttcagttgggtggaaaaagtgttttctcccccatgcctttctccttcagtggaaaacacacacacttagataaacacatcatcttttgtccttttggttaaagaaaggcaaaacagggagcaaatggatcagcaatagaatttaaactaaacctaaacccagctacaatacttagggagcttggattctgtaaatgaaagcaaggactcctgcaaaggcaaaaagatttcctcggcatgcaacatgtgttccctgttattaggaaaaagtggacaaaacaaggcgcagaggagtaccaatcatgcacaattgcttctgtactattcctggtaacctggggtttctcaaaagctctgcatgcacagcttagtttgtgacccatcttggctagcaggtgagtgttgtggctgcctctttctgtgaatgattaaaaaaaaaaaaaaaaaaggaatggacttggagataatttgatagacatggaatcagcataccacctactggtccttttacctgtggtcaatgttcactatgtctttatcacctcagatgctctcaaaccactgtccacttactaaacaggaaggcatgtgatgccagcatcatcttaacagaaatagaggcccctcctggggattatacgaattctggaagatctctaaacgaagactacaggacacattaagaacatgttgagtaactttgtctctcatgcataatcaccgtaggttggctttttttgtggtttttcaatagcaagttatgtttgtaattgaatggttggcctctagaaagtcgaattgattccctagaaatattccaaagtttgcagcatttaatctcatacttatagtgttaccaggactgggtataggcaaaatcatgacaagtctttcccttcattttcccttagttttctatgtctcttctggtatttcttcctcatcaccccttgggatttctgtgctctcagtctactgcctagaactccatattaccatggcccaatacctagtgtaccttctgatacaaagtatatgctcaataaatatttctgaaatgagtaaatgaacaaatgaaaaacccctgaagactgacagaattcctcagggctctgctaaatgacaggagaaatcagatgaattcctgtgcttgaaacaatcaaagtcaatatgcgcatgtcacccacctttactcacaagcagcaggttcctttgctgatgctctatttatgaaaaggaaaccaagctggaagttgaatgacaattccactgggccttagcttaggatgccacaagaaaacaccacagactgggtggcttaaataacagacatttactttctcaccgtttttgaggctggaagtctgacatcagggtaccaacatgatcaagttttttgtgtggggtctcttctggcatgcagatagccacctttttactgcgtattcacagggtggagagggagggagcaagctctctggtgtccctttttatagggatacgaattccatcatgagggccataccatcatgacctcatctaaacctaatgacttcccaaacaccccatctccaaataccatcacatgaagggttaggacttcaacatatgagttttgggagggacataatttagtccatagcatactggtttcatttttaagctaattaccaaggatttctagcccaaaggtcagagtacaaggggactatattcctctgcattgaactgtacagaagtccttgacattataccgttagtcattccattcatggtcccttagatcaaatgatgcgatttcctacatcatcctacctcttctctcaaatctcaggtcctttcatcaagcatgaacaaacccgcagtgatgaacgccttaaatgtactttctgctgtcattcagagtatcatttttgccttgtccgagcttgaatgcaagctgtaaaaagcgatcatgtactgggtatttttattggcacatcacccatgtttgaattagataatcaacagtgcacctgtaataaaaaattaaacttgttctctttaagcactgtttctttcaaaatgagatcctgtcattcaagatgcattattttccactttttcaaacccatgtcaacttcattaacctcctgagcagctttgccaagcattctgctcatctagagccacttgttgttactgctatttgcaatagcttcagtacttgagagtttacagaatgtgctgcttgccactctattcagagcctagaagtatattaactacagctgattcccgttgcctccccccctccctactcctttcaccagatcactcatttaagagatctgttcctcacctcaggaatcctccttagtggttctttagccagtttgaacaatgcatggagttgttcatttatgagtagaattaatacatttattcttcacgtatttcataaaatactgcaacagtccattgggaggaaatgcagagttttagcaccttttctttcccaggaaaattgctgttgttttaaaggaggggtccaaacttgtttgtgttcttcttcataaccccacagaattcctgatgcagatttcagctgggcttcactacctcttaaagagtatcatttggtgcttgtagttccattaactgaggggcctactttctttagtgttttcttcattttgtgtagtttaactgcgttgaggttttatattttatgttcctttcctccttctatgccgtaggaatgcaaggaacagatgcattcaatgattcattatcattaacagccagggtgaaatcaagaacttcatctacttctcggcttccttgttttgttcacaggggagccacattatgcatgagtggctcctctcaccctcctctctagatgcacactttatgtaagagactcatctttttctacttcagtgctgtgtggaatcgttagttagatacaggcaaagccactcctttagtgctttctctagagttgatggcactagatcttttttagccaagtagaaagcaattttcaagggcataaaaataagtgttttcctatttatagcacacaaactattgttaccttgtattccagtttatcatttccaatgtatttaattaatcaattccagaatctattgccaggcaaatagacacataatagacccaagtcattctcaagttcttataaatgcatgggctacagtctagagagctacatttgatccctaagaggaagttccccttccgtaacactgcctttggtgctcccagcagtagtctcttggtcttgatggactgtgtggttgacgggggtggtaatcatggtggaggggaaggggtgatcatatttttgtgctatgttttgagtgcttccagtagaagattatgtacattgatagctaatgataggtaaggcttttaaccacaggcccttccacagaactaatatttcatgttgagaaataatatgtcactgattgtggaaactcggcaaacatgaataaaagttgcactgaaggtaaaatatgctattcacctggttccctgaaaaagactgtcaactggtgttgtatttttagggacgtaccttcagttaagttgatgcagatggtatttattttaatatatttacatttcattctgtctccctgtcactcctgaccccctactgtttctcaaaatgaggtccatggaccacctacatcagaatcacttgtgaagcttgttaaaactacagattcatagacctatcacaggccatgtaatatacaatttctggggctgtggcctagagatttgtatgtataagaagcaccccaggtgactagtagggccattattactggagaatcactgcatccttggaggagatggggtaaaaacaaaagaaacacatttaattattctaaaatttaaaaattacatattctctaattttcaaaacacttagattaattttggacttgaggttctaaaaaagtaatgctatgccaaataaataaaaggtaattccctttcagtctttcacacttttaactaagacacatatccagcacagtgccagcattttttctagactgctgcttctcaaattttaatgtgcacacaaatcacctgggactcttgttaaaatcccgactttgattcagtaagtcttcagtgggccctagattttgtatttctaacaaggtctcagatgatacagatgctgctagtctgtggaccatcctttgagtaacaagatcatgtagcatgtaaggggactctttgggcttttaggttgtgtaaatttgcagaaactctgcaatatgtaatgtgtagtaacattattttctgcaaacaaaaagctgcattaaggtcctgtattccgagcatcagataagtcccttggttttgtctttctctaacacaagtaacctagagagacgtacattgccttgaatgccctgagtgattaaggattacaaaatatatataggaccttagagcaaagcaaggaaaatacaccaggacttacctccctcccactttttaagataaggtagggaaattacagggtgtgatggggcatgtacggaagcgggtagggtagatatcctagagaaaagtctggcaggctgggagggttatgggtgagtggatagggtgggggtcagggagaagagaggagagtacaatgttccaggcaccaggaacaggttatacaaaggcttagaagtaataaaagctttgcgtgaatatgcacctggccaaattgtagccttcatagagaatatatttaatttattcagatccagaggggaggctactatggaatttcaggcttcgtggcagtagtacaaatatttcttcttagggggagtggggtagttggaaggaggttaggaagagatatgccccacatcatgctaggtataagccttgcccatgatacaacgcagggaaaaaagtaacctttagtacttttgtcctgctaggaaattgctgacctgcttttctttgattgggaagaaaaacgacatcggtgggtgtcaagcagcaggtggtgaccactgtttctttaaagacaacatatgaaacactgaaaatttatttcccaataaacttgactttctgagctgaaccgcaaaaaaactgccatataataaaaggataaggaacaaggatatttccaattgccattaaatataatccaagtgaagtgattcaccgtggctcaggtgcaggttccccatcaatacaatttataagggttcagcttccaaaactacacttccatttgacagtaatttccttttttattttgttttgttttaagttgactacaattttcaatcacagttatcagttcatcacctggatgaaggtgacccagcagtccttctttatctaattcctgagatgtccttagattatctttcacaagcaaaattaacaatgataacaggaaaaataaattaattcaaagatgaagctttatcaaatgccatcttctgagggctgcattttttttcattaaacatgattcaaataatcttttgaaaaaagagatctggttatccagaattatcttcttccccactgcatgactaattccacaatcttaataagtttttaatgatgagttttataaataaagctgccatcagtttgccagccaagtgtattctttcaatatttttgagatacatgtgtatttttaagaggaattaaaattttcatcaaattaattaaaaggaacgatataacattagcacggtaaacactgaaataagtattttacagctaagtaatgctaatgctaggaatgatatctcttaaatttacatttctttatgtgtggaaatgtcagtgagagttttaagagaaaagagttctcaatacaaataaatttggagaactttgtgttgaacatatctgtacaggtttctttattaaaggacttctcagagcctttaaatatgctagtatgtactctcagtcaccaagagtgggctgtggtaatcagcacttcctgaatatatgggctattttgctttggagtctagtacaaaactagggcttcactataacatattttgggaaattataacatatttgaaataataatttacttctaaacgtaagaaataatataaatcttgtttaatcattccctttaaaaattgcttgtgtacaaaataccttcgaatctttcaaaacactactgatgttctataatcagcaactttcagcagtggcagtgtagtgtgtctgtaacttctgtattggacatgcaattcagggtgattaaaccaattggtctaagccaagattaccactttacatgatcgatccataaattgtagacataattaattgaatgtgtgtgtgtgtgtgcaaaacagaaagcatggagtaaggtctatcttcttgttgtcttcctctcatgtattctcattcaaaagagaataaataaatgggagtactcagaatatatctgtcagaaattggataaaactgagtatttctgcagcatttgtaattactttcagaagactggacaagaaatgcaagtctccacaaatcacaatggttaggattgagccttaagattctgagtaggctttgtaatcagcaaattgaagaatctccatgcagctccagcagtggcattctacaaaatatcctttggcattattatatattatcaagacaattgtatttctttggcaggggtatgaatggtgacttattttatgacagctatcagcgggctttttagtaatctgatagataacctagtttacagacctattttacttgttttaaggggtctctaatcatgtaatcacaggtgctttggaaatggctttgaagaaggactcttagagctgttgagttaataacacgcattatcaacattccctgctatatttttatacttctaaaatgttcactctctaaatgagctattctcattctctctttcttcctccctccccacacatgcaggtatgtgtgcataatgtgggctaaatctgaatgactactctaatttatacatctcttgatatcatacagccttggaagtagtttccaaattttttagtgtatctaaattttctgtggtcagccaaatggatactgcccctgtcaatagtttccagggatctttcactcctactcatccccatctgcaacgacctctattgcacctcctatcacgttcctaagagtaacacattgctgattttggaaaagaccttaatgtggacaaaaatgagactcttgaataaacactgttgctaggattgtaaatgtatctggtctttttggaggacattttaccagtatttaaatatcagatagcttccattgttttcctgtcaaaaattaaatgtgtataccctttgacccatcaattccatttctagggaatctattactgcaggataattcccacaggtacataaatatgtacatacatagaattcattgtagtgttgctcataaaagtaaaaaatgggaaatctcctaattgctcacacatagtaaaaaaaaatcaagcaacagaggcagatctatctatactgtcatagatattcaagaaacattgtttaaaaaagaataaagcaagttacagaacgcacatataacatgatctcatttatgttttaaaaatattacagaagaataagtatcaaactatcatccttgagcacctctggataggggaaggggtaaaggtaaggaggaggtgcagaataaattactttttcattttatattgttgtatggtttaatttttcttgttttacaaaaagaatataatcatgtgttacttacgtaattaatatttttaaagtaaaattatccttcaataatctccaaaatattagtttcaagagtcatagattcaggaaaaagaaacatgaggtatttgcatgttgaattaggcatgttaaactattatcaagggatactacccattatttctcttaagacttaggccagtgaattgtctattatttctttgagtattgtggcacaaagaccctaagatggccaccatatttatgccattttataatcccctcccttttagtttgagtacaacctgtaacttcattataatcaatagaatacagcaaaggtggtgggatatcactctcacaattatattaccatatacatataggactcattttactagtatgtagtaaaattctgcctctctctttctttttttctctctctctctctctctgttgctggcttagacaaagctgccatgctgtgagtagacctatggaaagggccacgtgacaaaaactggagaacagtctctagtagttgagagtgacccctggctgacagccaacaagaaaatagaaacttcagtcctataatcaagggaactgaattctgccaagaagagcatcatcagatgagacctcagtcccagctggcatcatgatttcagtccagtgagaccctgagcagaggacccagtagatgtgtccagacttctgattcatagcaactgtgagataataaattgctgttttaagtccttaagtttgtgataattttttacacggcagtgaaaaactaatacaagtaccttgttctaatattctgtctgatgtcatactaaccagtggaagataagagaaagcactcaatcagctattttgtttactactttctgatactaaactaccaccaaatgcagacacctgaactctataaatcactttctatatgttaggcatcatcctatacatttacagttcttactcacacaacttatcctcacactactcctgtgaagtggccatagattaggatattgtggctttaagagggtacaaaatttgcccaaggtggcaaggctggtagtcagctataccaggatttatacccaaagcctgtgtttaatgggataaaaaagactgaaaaagaaacaatccaatattttaaatcccacttccctttcagaaaatacttcaaaaatatagtagatctaattctacctcttttcccccaaatctgttacattttccagccctcattttcagtgacttaaaataaaaacccagttcagagttattatgctagagcctcactacaatgtggctcattatcacacagctttatatattctgccattcacataatttcctttttgatttatacctgaataaggtagtggctggaaacccatgttataggtagttctgttccttaatatgagaagattggtgactttttaagttcatacaggctttctattaaggaagtaaactctacaaaactaaaaagccaggagcacagagccgcacactaggatatggcactatcaatgtaatcatcaataggcaggttgagataaacatcatactgacaggatatgtgctgaagaaggccagaggaggaatgactcgattttatttttcccatgggcaaaggcagaaacggtgtcatgatgaacaaattaaagtcctaccacaaagcatttgtacaatgtgccatgccagaaagcaaagggcaaaccactaatctcagcggataataattagaaaaaacacaatagaagaaaaaaaaacaagaatactaggatgaatggatgttaggaaatatcactatcaattgtgatgactcttctagaatatgcattttgaccgattttatagagtgtgatttttctaaccacaggcatttagaattggcattcaaacactatgagagccaagtttaattaacttaaacttctgaataaagagacagccagagagcaagaagaacttccaatgctatagctacaatttgctgcaatttgctgttcaaactgcagaatcatatgcactgctgtttttattgcctcttcactttatcagccaaaaattgttgacacatcaacaaaacgatctctgtgatcaaagttttatcccatctatgactttctctcttcttttctgttttcctgtctgaatcagtacaatatctaatttggcccctgagatcagagactgaggtcaagaggaaaatcttgacctttataaatcactctctgtatgttgggcactgccctatgcatttacatcccttatctcagtccttatttacagggctccaggagaagtcctttgaatgatataggataatacaagagtataaatcagattattcttgaggaattagaaaactttcagtttagacttggtaattttaggataagaatgggtagaaaagaaaagtatctaaggggcatgtatgtgcatatgcatataaatacacaacacaatagcaaacttatgacatttaggaaatccacaatcaagctcaaatctccctgtcccaatgtccatctcactattctacttgagctatcttttcatattggctcagagcataatcctcaagtgaaatactgggtccttgcttcttgacttatccaaaaaccatttaaccttgagagctgcttcctctgtgcagccttccctgatgatccaaccccatgaagtaatcctgattgcttccatttctccattcacagtccatttctatcatatgatcatcatatcataccttgcactatttactcttttaagtaagtgtgctatctccttagctagactatcttaattacttgagggctgggagctcacagttcagtgaaaagataaacatgccaacaaagtttttgaaacacaatgtaaatatgtttttttcatagagataaacgatacagaatgctctaaggtaaaaaaccaaggtgacttaccttgtgagatttagagatctacagaggagctgctatctgaactggctattgaatagtgcttagaagtttgccagatacaaaggaaagaaattgacattctgggtaaaagaagctgtcggtctggagttgagaaagtgtgtggtgtagttggagaaaaatgaataaagttacctgtagagttttaagatgttggaaaggtaggttgaagctaggctttatggagtaaaaagtttatctgagagtacaaaggatagtcgttgagtttcaagaggggacaagtatggaaagatttgcattggctaaggtatttatggtgacagtataaaagcttgattggatttgggcaggactgaaggtagaaaaaaaatcaggtaactattattatatcacatgtgaaaaattatgagggctggaggtaaggcagaggtgaagaagatggagaaaaaggaatatgttagaaatggaattaggaagtagagttattagaatttggaacagaattggaggcaggggagaagaagaagcctagaataaataaaaaaatgtatatatcttgagagactgagtagatgttgatgccattaactaaaacaaggcattcaggaagaagagagggtactgaattaatgctggttgtgttgagtttgaaaaacatacaagccatctagtagatatccaatatgcagttagaaacgttctggaaaaaagtagggactagaaatctagactgggaagccactggcagtgtttaaaaaacatagatacggatgatacttctcagaaaaagagtgcaaggaagaaaaggtccgaggacagatatctggtgaacactgatacctttcaagggtggaatgaagagaaaacatcagtgaaggagtctaaaaagactggatagcccagataaatcatttttcttaagggaacaattgtacaattacacaaacttctactaaaagtaggatgagacctaaaatgaggactggatttagccataatctcaacgatgatctttaggactgtaatagcctggtggaaatagaagtcaaattacatttaatttattcaacaaatactcattttgttcctgctatgtgtcaaacttcgttttagttgataagaattcaggcaaaatccttgccctatggagtttatattctattggagaaggcagataattaataagaaaaataagtcaaagcatgttagatattgacaagggctaaagagaaagttaaagcaagaaaagagaaaaggaagtaattgtgtggatacagtatctgaagctgtgattttaaataatgtgatcatggaaggcctcacagagtacgtcatatttgggcaaagggccggaaaaaaattagtagcaacccatgaaaactgaggactaaatggtaaatgaggaagtatttatgagggaatagagagattaataatgcaagcgagaaggcattgaaagtgtaagctccagaggaggtggggagtgtatgggatcaaaaacacagaatgagagttgacaatgaaaaggggaaaggacatttcttactgtgaaacatgtggtaagactaagtataaatagaggtatatttagtgtagggtggcagggaatagaggggacttcatgattgatggcctttatttttctatgaggtagaaagcaacattttctgctgtctgcgaaggtgtgcgtggagtaaatatttcagagacaatatcattagtgcagtaagaatggggaactagaatgggaactgacttaagaacaaaaatcgagacagctgggcagttttaagggcttggctgaagttggatattatgaatttgcactggcaccagtcaatcaggtatgtgattttctttggcagaagcagtataatgaaagaaagaagaagaaggaaaaatgaaagaaaacatcaaggaaagctgattaatggttgaggattggcaagatggtgcaactacaagagtgtcaatgagttcacggttgaaatagggtaagagagagagcctgaaaaggtttacgaaatagataggtagctagggaggtatgagggccttgatgagaccagaagtgattcagtgagagtgaaggagggggagaagaggaaatgaattgtggaaatggagtgaaggcaatgattattggccagagagaggtcaagaaactatgaagttagggtttcagatgagctgcctgtcagaaaatagaggcagataaaatggaaagaaataatggtatttgcaacaacttggatggagttggagaccattattctaagtgaagtaactcaggaatggaaaaccaaatatagtatgttctcacttataggtgggagctaagctatgaggattgaaaggcataagaatgatataatggactttggggactcaggggaaagggtaggaggtgggtgaaggataaaagacattgggtacagggtacactgctcaggtgacaggtgcaccaaaatctcagaaatcaccgctgaagaacttatccatgtaaccaaacaccacgtgttccctcaaaactactgaaattaaaaagaaagaaaatggaggcagattatttcagacagatatttttcctaacagaaaagtagatttatcagtccaaaccaaaaataaggatgagtataagtctagcacatatagtatcattcttttggcttaagaaacattaaaataccaattataaaaagtttactgcaacaggacaacagaaaatatatttcataaatactatctgggaaagaaatttcaaaatcttaagacataacttcaagtaaacacaatactctaaactgttgtttggaaaaatagtggaaaacatttaagtttaagtaaagattttcaaaatagaaaaatgcacttactccaggcaagtaggaaaaacttattcaataaacatgagttcaactgtactgcattaaactctgcctggtaggataatagaaaaatgtaaaattgaattggattaaaaattatctttttcgcaaatggacatgtaataaatattttatacttggagactgaatggtagccaacatcctctaaagaaaacaaaatcatttattcaagtccagtttatagtcttattacctatataattttcattattgttattttgagatgttctggcttaattaaagttattagtgcccgtgaataagtgcaagtgtatttggcatttcataggtctgtgatactttcatatgtttcgcatttgacaacagggatctaagcttttatgtatttactttcataagtcataattcttaattgaaataaggataagccttcactatagaagtatattctacacttttatttataatttttctgtcttttctcttttcttacctgatttgggaattatctatttacaaagtatatacacaaaaccaattttctgagccattattgggcatgacttaagtgtactactttgtgtgaaattctccacccacggcattaataatcccacacaaaaaagaccaaaatgaagtgcttgattgagcttttatgattaaccaggctggaaacatagacttaaaaaagaatagcatttgaataaataaaatagagatgtgtaacaagaaaggttctactactttcactttcttcctttttagggttccttgaatccttcattgtgtgtggttattgcttgatcttcattttgcaatctacaattaagttctctgaaagtgcagggtaacaggtaaagaggaaagaagcaaagttgaagtttctgcccgtctctataattcagtttggtgtttcctgtcaattgtacatcttggattcttctggaaatgacagccacaagtacaaaagagacaggaagattgtggaagtggaaaaataaagaaaagaggaaaggaagatttgtgtatagaaggtaggaagatactttggaggagttttcccaacttgtatgtgtttgtggagaagtgtgggaagagaaaaaggaagaaagtcagcaatgaagtcaccataggaagagaataagagtacccttctatttaggagttatgaaggagtgttgggtacggtggtgggagtttcagtttgtttttttttaataggtcaccaacacatgtaatattatcatattgtgtcctatagacacattttattcactggcatttcaattccgactgccaattttccttccttctagaatataagctgttaaagccaaatttagagaagtgagtcatatgagaaatgagtctgaactgtctttcatgttattctatcactctccatgggaatattttgcttatacttccttgggacttgtcattctagagaaatcatgtcaccttaaggcatcctttaaaatacagagggaaaggtccatttaagttatatacattagattaaaagaccttaaactattagatgaaaacattagatcaaaaaacttaaacattatattaaaatgccctaaattccttataatgccttatatttaagtggtacattttacattcctagtacaaaagaaatgttatgagtcataataggaaagttaattcccaagagaagggaataatattcatagcacagttactcttactgttctgaaggtaatgaactataccagtaattattcttttgcttctaaaggtcagtaggttaagaatggaggtgtcaacataggggctttttattattcaccaacatttgatgggtatcaaccaataaaataaaataccattctttagtcattgcctcagaaagatgagatgaatatttctggacacagaatgtgttctggtctctctcctataacagaacttcagatttgaaatctgaagtttacaaaatttcagatagtgacgtggtagtgggttgtgaaatcaatgtatgggtcatgtaatgtacatttaaaacaatagactataatatgacagggtagattggatagggtagaatagaacagaaaaggttaggatagactagaataggataggctatcacagtgcactgcatatagtaagcataaacactgttttgtgaaacttttgtttaatacatacacataaattatgtatgtactgggttgtgatgaaaaatgtatttcttatgagccctggccataaaaggtcggaagtcactgtcttatgagctgcctctacatctcacagatagtagagaaaaatttttcttaggaccacagatatgatcagattattttcatctgagggaaaaccacatttatcatattctcagtagaacatataattatcagcggggaaaaataatttttatccaagatgataaaaaaattgacaagatggaacattagaaaattaaaagaaaacaaatagaacactctctgtgaaatcagaagggcaaaagtggaaacaatccaaatgtccatcaactggtgaatgaacaaacaaatgtgatatctccacgcaatgagccattatctggcaattaaaaggaatttaactgatgtgttatgacatagacaaattttgaaaacatgcaaagcgataaaagccagacacaaattgacaaatattatatgatttaatttgtatgacatctccagaataggaaaatctgtagagacaaaatgtagattagtgctacttacagttgggggataaaggagtaggaagatgacagctgagtgtaaagggtttttgtgaggtgatgaagatgttctaaaattgattgtggtgatagttgcaccactctgtaaatataataaaaaccatttaattttacattttaaatgagtgaattgtatgatgtgtgaaatctatctcaataaagctgttaaaaaaaaaacccaaaaccagaagcaatcaaatatttaccttttcctagtcactcacaaatgaaagggtagtaactgatatacatactaatgcatgtgcatgtgtgtatacacatgcacaaatatagaagaaaataaagaaaaagacaaaatattcatatccatacttcaagataaaattcaaatattacattctctgtgaaatcctcctagatttctccagcttattttctttgtgcttctaatgcatgcattttacatacacctattacaaggcttactacattgcactataattatctatttatatgtctactcccttactctgcccactgattatgaacttctcaaggtcaaggaaaatgtctaattatttatttctggattcttagtcctttgacaaatgtttgtacaataaaaaattgtagttttgaaacaaattctaatacatgctaacagatgttttcactttaaattttagaaagcatttttttcgactttatatcttccagacccttcaaatgactttactcactgaatcaattctggacatgaataacgacttgaagaaatcatctgatgagcttgctcttatagaactcttccaccacttggcacttgctcactacctaactggcatttggtttctctcagtgtggtttatttcagtaatcttacctaatgaattggattgaccatgccatgatccaatcaaagccatggtgattggctgtcttgacaactgggaaaaaatattgatcttattctggtcaattggctgagttatatagagataggttaataatgtcatcagaattactcttatcagtatcattaagtccaagtaagcaagctgctaagctgtgagcacatctgtaatccttacattccccttatcttcccactgtctctctcctataaaagtgccttgttcacagaaggaatttttaaatgtttaataacctaaaaggtctcacaaaatggtaatgatatttcatacgatatctgaagcaaagcaaattcaaatatttcagttagttatttttaagtcatcaaatgattctttttttttttaacacactggcatatgaaacatgctgcacatttatacagggaaatcttgtcataatggcttgttctatagatgattaagactgcaacatttatatttaatagtcccaatcatatatttatgatgaattttgctattttagaaaatgttttccagaagaaattccttcctcttctgagtcagtggaactaagtttaaccgaatttcttagaaaaattcctcttttttgtaaatatgttaatcatttccaatttaatgtttttatcctttggctagaggtacctggtaatttaaatatttttggagtctagatgagcaattaaacattttaaggcttggatttgatatggggaagagtatgtagggaaacatttattgctatttagtatgtacactattctcaaaatgtgttaaaaatgtttgaggttggccaggcgcggtggctcaagcctgtaatcccagcactttgggaggccgaggcaggtggatcatgaggtcaggagttcaagaccagcctggccaagatggtgaaaccccatctctactaaaaactacaaaaattagccaggcacggtggcaggcgcctgtaatcccagctactcaggaggctgaggtaggagaatcacttgaacctgggtggcagaggttgcggtgagccaagatagtgccactgcactccagcctgggtgacagggtgagaccctgtctcaaaaaaaaaaaaaaaacaaaaagaaagtttgagtttatttctttattatcctgatgataactgtggaagtgtaatgacaatataataacattttaggttttgcaaaatacacgggatacatataaccagtaatttaagtcatattcataatgcagttccttgagaaaggatcctgcctggagcaagtgtttatggttttcttatgtccatatccctcttgggttaattaaaagtgctattttatcatatccaagttggaaaatgtgacatttaacatgaccaatttatttaacagaaaaagatgaacaaattgctgacctaatatttgtgagtcatatttcacatatttgtattacacacctatcacatggaataagagttgtttgatgaaacaaaaaccacaggaaattaggaaagaaataatgctaaatatttttccttcagtaaacacaaattccccctttcctataaatgaagtaagctttaactgaataagagagagagtccaccttaaataaacccaacaagcaaaaatctcgagttatgaaaatcgtgaaatttaggggcagggtaattattcacattataatgtgacaagattttctaaaagactcctctacatagtgacctcacacattaggtaaagctataaaattatttgcgtacaggactttaggaacataccccatgtatgtaatgagagacagctgaatctcaactgagcacttaacccacattcttataccagctggcaagttctcaaatgtacaatggaagagagtagtgctacggcattaaagttacaagacctgtaaccatattattggagagtgcttttctggagcaaaacaaaaattgaactggcataaagaaggagagagccagaacactgaagaacatgcagcagtcttttctcatccatatcaggatggtgtaataaattactctcttctctctcatgctgtcaggagaaaacgatgtttagattaaacctcgctaaggactaaaaggataatttgtcagtattttccagtttactaccaatgcagtattgatttgctagggtccttcttcctatgttatttacactaattcaatctggaacaactgaaacccaagttgttggaaagcaagatatttctttaaatctcccagacccaaggtataaagtacaaaaaaattattatttctagttcttgtgggtaaagaccaaccgcttcgttggaggcaagttattagagaaaaccacttttctcctgagatttaccttgggctaatttctttttataaaattatgattcttgggagaacgtgataaaaaaaaattctgaatgcctgcccaatttagcagactcgtgactctagttctaggcagctgcttagaaacgagaagtaaaacagaaacatcttgataaaccttcttgtggctgaagctgataaaaatgacagtattagtttgatatacaaatgacagagcttagggacaaaactacactgaggcacaagataaaattacttcccaaatccttacttctccctatgcaagttatacaaatgagcaaacagtatcctataacatccagaaataaaacaaaagcaactaaaggttaaaataatttatgtattgagggcgagtaaaaatatatatcaagtacttaatccatggagctagcattgtctgtctaccttccttatctttctgttttttggttgtttttgttttgttctgttatgttttgtttttgcttcctggggtacctaaatgtcagctgtggcattgttttgactgcaaataaatatgggaggactggtaaaaatgtcatgagtttatgggtttatgattcttttaaggctgaagtgctgaacttccatttgccacacttttcaacctctacagatatttcctcaaactccgacatgattcaggattagtaaaatctcactttaacaccttattctttcttattctagtcttactttaggtgtgactaccctatagatccacatttattaaaaactttgatgggattgattgatcattctaattggaatgctttctaaaaaatcaattgatgcattattggataaaatatgattatatcttcataaactaaaatttcaatagtttttactggaattactagggaatttagtcagatgacatattaatttaggcaatgtcttatatgaatcgacctatttgacaattttgatcaacttgcttattttcataaatcactcaaaacaatacatgcatgtgcttatttatttatttatttatggacattcaatcaattggtatttgctatttccttgtcttaaaatgaactatgctgagtataaagttcttctacaacactcatttgactaattgtgattgaatgtggttgtgtctacatgcattgatttggcatatcaattgcaactatttctccatgcacaagttagcttgaatatattaccataagggccagtatagtcatcataaactgaaacggaacaaatccaggaaaccagaaaataggtttcactgattcaactattaagagtttaaaaactactgacttcatcgagctgattgaccaagtctttcagaaaccaaactggcttacacatataaacaaagcctttaaaaatcaattgtgcaagaaatagggggaggatgtggaggaagcagaatagaaagttccacccattgccccgcaaaaggcaccaacttaacagctatctatgtagaaaaaacaccataagaaccaaaaatcaggtgagcactcatagtacctggttttaacttcatattgctgaaagcggcactgaagagatagaaaaaacagtcctgaattaccaatacccccctccccccattgcccgtggcagcagctgtgtggtgtagagagtatctctgggcgctgggggagggagaacacagcaattatgagacactgaactcagtgctgaactgtttgttagagcaaaaaggataaccggaccaaactcagcagacaaccacccatagagggagcatttaaaccagccctagccagggagggaatcactgatctcagaggtccaaacttgagtgggtacaaacctcaccactgagggctacagcattctgtgcctccaagtaaacctgaatgacaatctaggccataaggactgcaactcttagttgagtcctagtgctgaagtaggcctagagacagtggactgggaggggcatgtaacatacttgagacaccagctggggcagccaagggagtgttggcagcaaaactcccctaaccccaggctgcacagatcacagctccaaaagagaccccttccttctgcttgaggagaggagaggcaataatgaagaggcctttgtcttgcatcttgtataccagctcagccaaggcaggatagggctctggtcagagtcatgaggcccctgttccaggccctagcttccagatgacattactggacaaaccctgggccagaagggaacctgctgccttcaaggaaagcacccagtcctgccaacagtcatcacctgctaattgaagagcctttggaccccaaataaacagcaatgatacccatcaaaagccttgagtgagcctctgagacttgctggtttcaggtgagactcagcacatgatcagctgtggtggcaatggggcaaaacttctgcttgagaaaagcagagggaaaagcaaaggggacattttcttgcaccttatataccagtatggtgaagtggggctagaacaccaagcgggctcttggggtccccagttccaggatttgactattgaacagcatttctggacctgccctgggccagagaggagcccactgctctaaaggttgagttccaagccaggcagtattcacaaaaagctgatttaaaagaccctctgccttaaatgaacatcagcagtagtctggcagtactccctgtggcctggggtggcggtaactaccaggcgaggttcctctgtcttttgaaaggggaaagaagagtgggaaggactgtctctcgtgttctgagtaccagctcagctacaatacaatagaacgccaggtattcttcaaaggcttttttttacctctagtccctgactcctggacaacacttctggaccttgctgacctgaagggaaggacacagagctggctggcttagacaccagccaattgtagagcccccaggccttgagcaaacataggcagtagccagggaatggttaaagccagccttgggtaaaaccagtgttgtgctggcattaggtctgaaacagcacagtcatagtggtggtggccacagaggtgcctgtgtcactccattcccagctttatgtggttcagaacagagagatagactctgtttctttgagagaaagtaagggaacagaacaagaatctctgcgtgataatccagagaactctcccatatcttgtccaagaccatcaaagtggtacctctacgagtctgcaagaaccacagtattactgggcttagaatgccccctaaagcatatatcacaacacacaagtctttttaaatgtctggaaagccttcccaagaaggttggctacaaataaacccagacagtgaagactacaataaacacctaactcttcaatgcccagacaacgaagaatattgattagcatcaacactatctaggaaaacacggcctcaccaaatgaactacataaggtaccagagaccaatcttggagaaacacagatctgtgacctttcagacagaggatccaaaatagctgtgttgaggaaactcaaagaaattcaagataacaaaaagaaggaattcagaaatctatcagataaatttaacaaagagattggaataattcaatagagtcaagcagaaattctggagctgaaaaatgcaactgaaatactgaagaatgtatcagaatctaacagcagaacggatcaagcaaagaaagaactggtgaggttgaagacagtcttcttgaaaatacatagtcagaggaggcaaaaataacaagaacaaaaacaagaacaataaagcatgactacaggatctagaaaataaccttaaaggggcaaatctaagagttattggccttaaagaggaggtagagaaggacaaaggggtagaaagtttattcaaaggaataataacagagaacttcccaaacctagagaaacatatcaataatgaagtacaagaagattatagaacaccaagcagatttaaatcaaagaagactatttcaaggcatttattaataatacaactctcaaaggtcaagggaaaaaaaggatcctaaaagagaaaagagaaaagaaacatacaacatataatgaaactccaatatgtctggcagcagagttttcagtggaaattgtacaggtcaggagagaatggcatgacatgtttaaagtgctaaaggaaaaaaaagtttaccatagaatagtatattcagtaaaaatatccttcaagcacgaaggagaaacaaaggcttccccagactaacaaaacctgagggatttaatcaataccagacctgttctacaagaaatgctaaagggagtacttcaatcagaaagaagaggacattaatgagcaataatgacctgaaggcacaaatctcactggtaatagtaagtatacagaaaaacacaaaatatcgtaacactgtaactgtggtgtgtaaactactcttattctaagtagaaagactaaataatgaaccaataaaaagaataactacaacaactttttaagacatagtaagtacaataagatataaatagaaacaacaaaaagttaaaaagcagaggaacaagattaatgtgtagagtttttattatttttcattttgcttgtgtgtttatgcaaatagtgttgattgttatcaggttaaaataatgggttataaggtagtatttgcaagcctcatagtaacctcaaaccaaaaacatacaatgaatacacaaaaaatgaaaagcaagatagtaactcatatcaccagagaatatcatcttcactagaagaagacagaaaggaaagaagaaagagaagaccacttaacaactaaaagacaaataacaaaatggcaggagtaagtccttacttatcaataataactgaatgtaaatggactaaactctccaatcaaaagacacagactggctgaatgggtgaaaaaaatattgatctgttgcctacaataaaaacacctcacctgtaaagcacacatagactgaaaataaaggaatggaaaaagatattacatgccaatgaaaaccaaaaaaaagagcaggatttgcgatacttatatcagacaaaatagatttcaagacaaaaactataagaagagaaaagaaggtcactgtttaatgataaaggggtcaactcagcaggaggacataattttgaatacatatatgcagccaacactggagcacccagatatataaaacagatattgttggagctaaagagagagataggccccaatacaataatagctgcagacttcaacaccccactttcagcattggacagatcttccagacagaaaatcaacaaagaaacatcagacttaatctgcactatagaccacatggatgtaatagatatttacagaacatttcatccaagagctgcagaatacacattattttcctcagcacatggatcattctcaaggataggccatattttagttcacaaaacaagtcttcaaaacattcaaaaagttgaaataatatcaagcatcttctctaccacaatgggataaaactagaaattaataacaagaggaattttggaaactataaaaatacatagaaattaaacaatatgttcctgaatgaccagtgggtcaatggagaaattaataaagaaattaaaacatttcttgaaacaaataatgatggaaacacaacataccaaaacctatgggacacagcaaaagtagtactaagaaggaggtttatagctataatgcctacatcaaaaaagaggagaaacttcaaattaacaatctaaccatgcattttaaggaattagaaaagcaagagcaagccaaacccaaaatcagtagaagaaaagaaataataaagatcagagcatacatttcatttaatttcaatgaaactgaaatgaaaaacaatacaaaagattaatgaaacaaaagtttttttaagttaaacaagattgacagacaaagaaaaaaagagagacgatccaaataaataaaatcagaaatgaaaaaggacacgttacaacttatgctgcagaaaatcaaagtatcattagtgtaatatctgcaactatatgctaataaatcaaaaaaatctagaagaaatggacaaattcctagatacatataacctaccaagattgaactaggaaaaaatccaaaacctaaacagaccaataatgaataacaaaatggatgctgtaataaaaaatctcccagaaaagaaaagcctggtggtttcactgctgaattctaccaaacatttaaagaagaactaatatgaatcctactcaaactattccaaaaaatacaggaggagacaatacctccaaactcattctataggtccaatattaccctgataccaaaaccagataaagacatatcaaaaaaagaaaactataggccaatatttctgatgaatattgatgcaaaaatcttcaacaaaataatagcaaactgaattcaacagtatattataaagatcattcatcatgaccagagggatttatccctgagatgcaaggatggctcaccatacacaaatcaatcaatgtgatacatcatacaaacagaatgaagaataaaaaccatgtgatcatttcaattgatgctgaaaaagcatttgataaaattcaacaccacttcatgataaaaaccctgagaacactggggatagaagaaagatatcccaacattataaaagtcgtatttggcagacctgcagctggcatcatactaaatgcggaaaaactcaaagcctttcctttaagacctggaacgtgacaaatatgtccactgttaccactgttattcaacatagtattggaagtcctagctagagtaatcatataagagaatgatataaaggacacctaaattggaaaggacgaagtgaaattatcattgtttgcagatgatgtaatcttatttggaaaaacataaagactccacaagaaaactatcagaactgataaacaaattcagtaaagttgcaggatacaaaatcaacataaaaaatcagtagcacttctatatgccaacagtgaacattcctaaatagaaatcacaaagtaatcccatttacaatagccacacagaaaataaaatacccaggaattaatcaaagaagtgaaagatctctataatgaaaaactataaaacactgatgaaagaaattgaagaggacaccaaaaaatggaaaaatattccatgttcatggactggaggaaacaatattgttaaaatgaccatactatccaaagcaatctacagatttgatgcaatccctattaaaatcccaatgacattcttcacagaaacagaaaaaaaatcctaaaatttatatggaacgataaaagagccagaatagctaaagctatctaagcaaaaagaacaaaactggaggaataacattacctgacttcaaattatactacagagctatagtaaccaaaacagcatggcactggcataaaaacagacagatagacagtggaacagaatagagaacccagaaacaaatccacacacctacagtaaactcatttttgacaagggtgccagtaacatacactggggaaaggacaggcacgtcaataaatggtgctgggaaaactggatatccatatgcagaagaatgaaactagacccctatatcttgccatatacaaaaatgaaatcaaaatgaactaaagacttaaatctaagacctcagcctacgaaactactacaagaaaacattggggaaactctccaggatattactctgggcaaaaaatttcttaagcaatactccacaagcacaggcaaccacagcaaaaatgggaaaatgggatcacatcaagttaaaaagcttctgtacggtaaaagatacaatcaacaaagtgaagagacaacccacagaataggagaaaatatctgcaaactactaatctcccacaggattaataaccagaatatataagaagctcaaacaactctataagaaaaaacctaataatcctatcaaaacatgggcaaaagatttgaatagacatttctcaaacccagacatacaaatggcaagcaggcatatgaaaaggctcagtatcattaatcatcagagaaatgcaaattaaaactatagtaagatgtgatctcacccggctgggcgtggtggctcacgcctgtaatcccagcactttgggaggccgaggcaggtggatcacttgacgtcaggagctcgagaccagcctggccaacatggtgaaataccgtctctaccaaaaaaaaaaaaaaaaaaaaattagccaggcatggtgatgtgcacctgtaatcccaactactctagaagctgaggcataagaattgcttgaacctgggaggcggaggttgcagtgagccgagatcatgccactgcactccagcctgggccacagagcgagaccctgtttcaaggaaaaaaaaaaagatgattttaccctagcaaaaatggcttttatccaaaagagagacaataacaaatgctggtgagaatgtgcagaaaagggaatacttgcacactgtttgtgagaatgtaaaatagcacaaccactatggagaacagtttggagattcttcaaaaacctaaaaattgagctaccatatgatccagcaatcccactgatgggtatatattgtatagtatatagtagcagtatacccaaaataaaggaaatcattatatagaagagatagctgcatgcctgtgtttgttgcagcagtgtttacaataggtaaaattttgaagcaacctaagcgtctatcaactggtgaatgaataaataaaatgtggtaatatacaccatggagtactgttcagccataaaaaagaatgagatccagtcatttgcgacaacatggatggaactggagatcattatgttaagtgaaataagccagtcacagaaagacaagcattgcaacttctcacttgtttgtaggatctaaaaatcaaaataattgaactcgcagacacagagagtagatgaatggttatcagaagctgagaagggtagtagggggctgtggggggaggtgggggtggttaatgtatacaaaaaatagaaagaacaaatgagacctactatacgacagcacaacagggtgactatagtcaataataacttaattctacatgttaaaatagcttaagagtgtaattggagtgtttgtaactcaaaggataaatgcttgaggggatggataccccattctccatgatggacttatttcacattgcgtgcctgtatcaaaaaatctcatgtaccctctaaatatacacacctactatgtacccacaaaaattaaaaatactaattgtgcaagaaataatagttcatatcaatcaaaaccagttattcagttctgtgtaaagacatagacataaatcatataccaaaagttacattctatattcattctttcaaaagtacttgttgaacacctgctaagtcctagaaactattctagggcctttaaggacttcagtgaacaaaacacacaaggatcctagtcctcagaatttacaattaatgtagatggaaacagacaataaacaataagcatagtatataagtaaattatatagaggttcatacatgctatggaaataaagacaaggtagagcagggtaaaggtattaagagttcagggattatggtgcaaactgcagtagtgtgtagaatgggtcaaagtagacctcactgagaagcagacatttaagcaaaagcttgatggaggtgtaagagtgaaaacatgcaatacttggaggaagaagattccaagtagaggagtcagccacagtgaagtacctaaggcagaagtgtgcctcaagtattttttttttttggagattgacaaagatgtcagtaacaatgctgcagagttaagaaaaaatgtagaaggaggtgaggtaacaaggagctagatcatggagggtattttagatcactgtaaatattctactctgagtgaaatgagaagccatttgcaatatttttagcagagtcgactcatatattttgtctactcttttattatttttaaataattgacacattataattgcatgtttatggggtagtgtgatgtttcaatacatgcatattttatataatgatcaaatcaggatagttggcatgttcataatctcaaatctttatcttttttttgtggtgatatcttgcaagatcctctattctatttatcttgaaatatgcaatacatttttcttaaccagctatggtccctctactgtgcaagagaacaccagaatttatgtttcctatttaattgtaactttgtacccactgaccatcttctcccttttcccccttcctcctcccctgtttggtctttggtaaccactattccactttctacttctatgataccaatctgaaagaaaaggatgctaacctgtaataagaaaatattttaaaaagatcactctgagaagcatagagacctgttacaaggctgtatgatttaacccagatgagagatgatggtggcttggacaagggtggtagctgtggagctggaggtacagtgaacagagtttgctaatacagtggatgtaaggtattgcaaggaagagagctttcaggatgactccaaggtttttgacttgagcaagtggtaggatggagcttccgtcaactgaaatgggaagtctgcaagttttgggtaggagggaaagatcaggagtttagttttgggcaagttgagtttaagatatctattaaacatccaaatgaaattaccaaataagtaattgaaaatggatgtcagaagagaagtcttggctgagaaataaatttgagagtcattagtgtattagatggtttaagcctcaggactataagaggtcactgagtgggtataaatggtgaagacttgaagacaaaagctgagcactggtgtacaccaaattaaaaggttagagagtcaggcctgtaatcccagcactttgggaggctgaggcaggcgaatcatgatgtcaggaaatcgagaccatcctggccaccatggtgaaaccccgtctctactaaaaatacaaaaattagctgggtgtggtagtgtgtgcctgtaatcccagctactggggaggctgaggcaggagaatcgcttgaacccaggaggccgaggttgcagtgagcagagatcgtgccactgcactccagcctggcgacagagcgagactctgtctcaaaaaaaaaaaaaaaaaaaatagaaggaaggaaaagaatcagcaaataagacagagaagtgaccactgagataagaagaaaactgagagagcatgatatcctgtaagccaggtgaaaacagtgtagagaactcagaatttcttcatggaatgggatatgaccttagttttatactaattttgttttggtccatgtttagcactagtaacctgggattataaaacatgtggtataaggaaaattcttggattatttcacaaggctacaaattttcgcatggtaaaatggatcaaacaattacacagcatttttgtgcaggctacacaatctctccaacttcagaagaattatttcagcaaatataaactttgaaggaacaatgaaaatacgggacaattttttaccaacaaactaacttttcacttacaaacatcaaaataaatgaaaattatttaagcagaaatttccaattgaaaacaaaacgttaaaagtatcaactttggtgaataaggaaactctatttaaaatcaaccatttagcataatagtcatttgttcagggaaacacaatgatgtgtacactgctgaaattgttaaatgaaaaatacatgtttttggtttcaaaggaaaatagcatggtatatattaatatgaaaagtttgaaatttgcagctgtgttcttgttttacagctgctaattttggcaaacaattttgaaacataaaactgcttgtccactagataacaatacttccatgccttgcttcctctgtaagacagaaacttgatctccaaacatagttctttcaagcaaacaagaaagtatatcccctctatacatggggctgtaatttcattaggacaatcaatatgagcaggtgacataatagtaatgtaaagagcaaaatattatttgcagtataatagatttgtttcccactttattttcagaaggaatatacacatacaaagctacgttaaagaaattttaaatttctatttatgttaaatttaaaatttaaaacattggaaggagccctttaagcagcaagtattggctattttaaaaagtggccaagaaagcaggtgaattggattcattaatctatgacatcattttccttttattttgaaaaattatgttaaattaaaaaatttaatagcacattatcaaagtacaaacgggacaaaagagcatgcaggaaaaaaaaatctccctccaatccctgtcccacagccacttacttcctctccacaaatgcaatcaaaattattcatttattgtgaatattttcagagaaattctatgataatgtaagcatgcaagcatatagcttcattaaaaatcacacataaagtgtagcacagtggacatcatcattttcaaacttcaggttgtgatctattagttataaaatgaatttactggatcacaattaacattacatagatatgaaatggaatcgaatagaagagaaaatgtcagagcatgttgtttcatagtaagggtagatatcgtcttatgaaatttttgtttttgttctttatttatggattcattgtgaactgggttagaatgtaaaatatatttcttcaactgggtcatagacaagaaaatccactactatcgacaacgattcaaaccctgtggcttttgtttaatgatgcatcttgaagactgttcaacttcaataaatacagagttgtctcattttgtttgtgctagatttattttaaaaatttcagacacccataaaagggtataaagagcaatattataatcaccatgtaccccattactgagcttaagaaataaaatatcataaataaatacatatacaaatagtgtcaatggagttaaaaccccctgtgcaattccgcttgagccacccaacttttcttcctacttatatgtcttattctctttaaggctgcagagtattccactgcataaattactcaaattattataccataaattattcaagtggcttcctattgataaacatcttgattgatatcactgattttttgatatttcaaacagtgctaagtgaatatcttcatacataccactgcatgctcattcaatatctgtaggataaatttcaagaagagaaactgctggatcaaagaagataatttgtctttgctagatattgtcaaatatcttttcatatcgactgtatctatttttacttccataatcaatatttcatacacattttccaaaaatgtatgttataaaattttaattattgccaatattataggtgataaatgataaaatttagttcagttttaatatgcatttctcttaggagtgagtttaaacattttttttcatatgtccaagaaccattctcatttcctttactatggcatatatcaatttttttctattacattatttggatttttttcttattgattataagcactctttatataggaggaaattgactgtctctgtatgctacacatattttaatatacatatatatacatatgtatataattttgtgtagtcaaatttgacagcagttttatttatggcttctagttttttgggctatatctagaaaaggttttcctactttaaggttggaagaaattctcccatattgctttatagtacttattttcacatttaattttgggtcacctagaatttattctggtgtagggagtgaggtacggagggaagcaactttattgttttctgcatggctacataattgtctcaacacttttcataaacaatttatgccttccagacttatttgaaaggtcatctttatcatatactgtactcctgtttgtatttggaaccatttccagtcttcttccatcctaacactttgtttattcatataatagcaccccgctaatttatttacaatgaacttaaatatattttaatatctggcaaatctatcatcattatattatgtttttccccatatattttcaaagtattcttatgtttgtttttcccagttgaatattagagctggtatgttaggctttttataagaccaattgatattttgttattgaaggcatgttaaaatgatagattaaggggaatttttatggttctgagacttatttaagaaaaaagtatggctttctacttatttatgttcttttctatattcctcaatagcattatgatttttgtgtgtgtgtgttgtactttttgcttgtttattctcaggcattttgattgctgttgttgctactgtaatcatttattcaactatattttctaagtaagtattgtttgtatggaaggaaactattaatttggtgtgctaattttatacccaactagcttactaaattctcttatttcttgtattagtttcatgtttggtcttagattttttttttttagatatacaattatataacctaaaaataataaaattatacctcatttttctaattttattcctcttctattttctaatgtggacagttgctacttcataagtttaaagtagttaattagagcggatatccttgttttgttcttgtctctaatagaaatccttctagagccaggtgtggtggctcacaactgtaatcccagcactttgggaggccaaggtgggagaatggcttgagctcaggagctcaccagcctggtcaacaaaggggacatccattctctacaaaatttttttttaaacagccatggcatggtggcatacacctttagcctcagctactccggaggctaaagtgggaggatcacttgagcttaggaggtcaaagctgcagtgagccatgatctcatgactgtactccaacctgagaaactgagtgagactgtctcaaaaaaaaaaaaaaaaaaaatccttctagtgcttcctcacttcaaataaaactggattttgtgattttacatgatcttattctaagaaattatatatatatatatacgtttgtatgtatgtctatcaaaaattgatgcatgacagacagtataatatcatgggtaaatgcaaggattgaactgcctggtgtaaatactgactttaccacttaccagccaaatcattttatgtatccttattgtgccttagttttctcatcgtaaatgggaatatcatttgtacctcagttatggagcggttatgaatattaaactcaatatttgtaaaatacttagagcaatgtttggcacagaataaacacatttgttaaataaaatgttggtttttatcaaaacccttttgaaaatctccgccgtttttaaatttggtttatctacattgatgtactcatatggtatgttagagtaacagagtttttaatattgaataatccttgcattcttagtatgaactgcacttacttgtagtgtattatttttctgttatattgctggaccttgtgggctagtattttatttaagaattttgcttcggtattcagaagtaaaattgatttgaagatttatttcgtactttccttttttaacttttagatatcaattttttttgcttccaaaaaaatctttaaaagatttggaagctttcatttaattatgctgttaaaacatttaagtagcattgaaataatgtgttccttaaagatgtagcaaattttgcctgtgacactgcctaattacgctacttcttttggtttaagtagttctttggaagttttatttctattttacaaatcagatttctttctctactgagaaaattttctctcccttctgagaccagttttagtcatttgtattttttctatgagattatccattccaacatggttttcaagggtaccttaaaagaggtgcacaaattggtctcttatgaatcattcaatatcctctgtctctttagttatttcgacatactcacgtcttattttctcttcttttcctgattctgctattttactgcttatgcctataagaattggttcttgaatttattagttagttctcagattttatcatagtttccttaaaaaatcattccagttcaaacgaaaatttaaagtcattataaaaattgttaaattccagaatcaataaaggacatccagttaaaaaattataattatttattttgaaataggtgatcatacagaggaaaaaattccaaattatacaatatagcattcagagaaagaatatttgttcaattaacgcactgcagatcttcagatttccactttcctccacagaggtgaccatgttacccattcatagagacaaagtattaattgcagtggcagttgattttcatttgtaattttttggctgcagttggtaagtaatgatattctgctcttttaactttcaacccctgacttgaaagaggttaatcattttccattggttcctaacagtgcttatttttccaaaacaaaataaactctctctagaatataagttgtgacttctgaaagtgactggtacctcaaagcttggcccacatactcattcaaggaatttaagataatttgggggtatttggaggtagtcatggactactttataatctaatgaaggacatggatccttgccagaggactgcatatctatcagagtgcattcaatattacatgcaatttgaggcattcacagactctctgaaacccattcatagaacttcttggaactgatttatttataggtttattagtacagctgacgcttgagcagtgcaggggttagagatgccgactaccacacagtcagaaatccatgcataatttttgactccccaaaaacataactactagtggtctgctgttgagtggaagacttgccaataacaaacaattgattaacacatattttgtatgttatatgtattatatacttaattcttacaataaagtaagctagaaaaaagaaaatgttatcaagaaaatcataaggaagataaaatatatttactattaattaagtggaagtgaatcatcataaaggtcttcatcttcatcttcatgttgagtatgctgaggagaaagaggaggaactgatcttgctgtctcagggatggccaaggcagaagaaaatgtatgtataagtggacccctgtgcagttcaaaactttgttgttcaagggccaactatatgttcatgcttcacacatttaatgagtttttaccttgggccaaaatttctttacatacatctgtgatcagcttgttttatttcaatctagttgggggatacttacaattaaagcccagtgtgatgcagctatgacgaggctagtccagagaaccacagaactatagaggaggaacaatctcatccagaggtctgagggtggggatccagagtcaaactggagaactgatcatatagttttgcatatttgtcccctccaaatctcatgttaaaatgtgatccccagtgttggaggtggtgcctatagggaggtatttgggttatgagagtggatctctcacgaatggcttggtgccctcccggtggtcatgagttcacatgagatctggttattttaatgagccaggcatccctctcttactctcttctggcatgtgacactctagctccccttccactttgccatgactaaaagcttcctgaggcctcatgagaagccaagcagatgcagatgccatgcatgtacagcctgaagaaccatatgtcaaataaacctcttttctttgtaaattacccagcctcaggtatctttatagcaacaaaaacagacacacagacaaatataactgatttagatggggctagtgtcctaggtgcctaaccctacaagttgtcatcccctcatggccaaggatgagctgcagagtgaaggctggctcacggaagaccagaaacaactaaacaatctaagcctttctgtcctcttaaagtgttcctcaaggctgccaggcttgattaatatttttatagcttctgaattttcttctggatgacatttatttttttaaatgtttttattgagaaataaaattttcatatttatgggatacatgtgatatgttgttacatgcatagaatgtgcagtgatccaatcagtgtatttgggggtatccatcatgttgagtatttatcatttctatgtgttgggaacatttcaagtcctctcttccaggtattttgaaatatacaatacattgctgttaactgtaatcatcctactctgctattgaacattagaaatttttccttctatctaacagtatctttgtaaccgttaataaacctttcttgatctttccccatatctccttcccatcctctggtatctatcattctaaactccatctccatgagatcaacttttaaacctccacatatgggtgagaacatatatcattttttattctgtgtctggcttatttcacttagcataatgatgtccagttccatgttgctgcagatgacaggattttattctttttatggctgaataatattccatcatatatatgtaccacattttctttatccactcatccactgatggacacttaggttgattccacatcttggctattgtgaatagtgctgcaataatcatgggagtgcaggtgtccctttgatataccgatttcttttcctgtggataaatgcccaagagtgggaatgctggatcctatagtagttctatttttagtttgttgagaaatctccatattgctttcaatagtggttatactaattaacattcccaccaacagtgtgtaagagttcccttttctcctcgaccttgtcagcatctgctattttttgtctttttaataacagctgtgataagtgggataagattatatttcattttgatttgtatctacctgatgatatgtggatttatgtctgggttctctattcttttcaattggtctatgtgtctgtttttataccaataccatgctgttttggttactatggtcttgtaataaattttgaagtcaggaagtgtgatgcttccagctttgttctttttgctcaaacttgctttggctactcaggctttttttggttacttaagaattttaggattttttctatttctgtgaaaaatgacagtggcattttcataaggattgcattgaatctgtagattgtgttgggcactatattaattcttcctattcatgagcatcggatgtctttccacctgtttgtgtcctcttcaatttctttcatcagtgatttggtagttttcttggtagtggtctttcagtgccttggttcaatttatttctaggtacttatttttttggagctattgcaaatgaaattgttttcttgatttttcctcagctagttcattactgatgtataacaatgctactaatttttgcaaactgattctgtatcctgcaactttactgaatttatcaaatctaagagttttttgttgacgtcttaaggattttctaagtataagataatatcatctgcaaagacagaacatttgactacttctttttcaaattagatgccttttatttctttctcttgcctgattgttctggctaggacttccagtactatgataaacaggagtggtgaaactgggtatctttgtcttcttccagttcttaaagaaaaggctttcagcttttccctattcagtatgatgtcagctgtgggtctgtcatatataacctttattatgttgaggtgtgttccttctatgccttgttttttgagaggtttttaattttttatcatgaggggaatgttgaattttatcaaatgcttttctacatctattgagatgtccatatggtttttgtccttcattctgttgatgtgatgtattatgtttattgatttgcatatattgaaccatctttgcacctctgggataaatcccactgaatcatggtatattatgttttgatgtggtattagacttgttttgttgatgttttcttgatgatttttgcatgtatattcatcagggatattggcctatagctttctttttaaattgtgactttcgtggttttagtatcagggtaatgctggccttgtaggatgagttagggagaattccaccttcttcaactttttgaaatagtttgaggagaattggtgttagttcttagaaggttcggtaaaaattgtcagtgaaaccattctgtcctgaacttttctctgttgggaaacattttattactgattcaatctcattactcatttttgatctgttcaggttttctatattttcctgattcaatcttggtagggtgtatgtggccaggaatttatccatttcctcaacgttatccagtttgttagtgtatagttgttcatgacagtctctgatgaccttttgcatttctatgatatcagtttttgttatgtctcttttttcacttctggttttatttacttgggtctactctctttttttttggttaatggtttattgattttgtttatctgctgaacctacttttcatttgttgttcctttgtattactttttatagtccatatttcatttagttctgttctgatctttattattgtgttctttctactaatttggggtttagtatgttcttgcttttctaattctttggggtgcctgattaggttgtttgacatctttctacttttttgatgtgcgcatttttttcccataaacttccttcttaacactgcttttgctgtatcccatagtttttgttgttgttgttgttgttgttgttttgttttgttttttttttttagacagagttttgttctgtcacttaggctggagtgcaatggctcaatcttggctcattgcaacctctgcctcccaggttcaagcagttattctgcctcagtctctggagtagctgggattacaggcacctgccaccatgcccggctaatttttgtatttttagcagagacagggtttcactgtgtcggccaggctggcctcaaactccggacctcaggtgacccgcccacttcggcctcccgaagtgctgggattacaggtgtgaaccaccaagcccagcaaccccttaggttttgctatattgtgttttagttttcatttgtgtgaagagattttttaaaatttcctccttaatttcttgtttgactcaatggtcattaaggaggatatttaatttccatatatttgtacaatttccaaagttccttttgttactgatttctagtttaattccactgtagtataagaagatacttgatatgatgttgatttttaaaaacttgttgagtcgtgttttgtgtcctaacatgtggtctatcctggagaatgttacatgtgctgataagaagaatgtgtattctgtatctgttggatgaaatgttctgtagatgtctgttaggcctatttggtgtaaagggaagtttaagtcccatgtttctttgttaattttctctctagatgatctgtctaatgctgagagtggggtgtctaagtcaactattaacatatgtagtctatcaactattaatctatgtagtctatctcccttcttaggtctaataatatttgctttatacatctgagtgctttggtattggcggcatatatgtttagaattgttacataattctcgctaaagtgattgctttatcattatatgatgacatttttgtctatttttagtatttttgacataaatctattttctctgatatgagtaatgtgatgcctccagcttcattaggattgctttggctactctggctcttttttggttccatataaattttggcatagtttttttcctaattctgtgaaacatgtcattggtagtttgacaggaacagcactgaatctgtaaaactgctttgggcagtatggccattttaacaatattgattcttcctatccatgagcatggaacatttttccatttgtttgtgtcatctctgatttctttcagcagtgtttttaattctcattgtagagatctttcacctccttgtttagctgtattcctgggtttttaatttaatttaattttttgtctcactgaatttaatatcattattttcccaggatttcataaattattttttcattagaatctgttgatagataattattgtgttcttttgaggtatcatattttcttgctttttaatgtttcttttgtccttaacattgatatttgtgcatcaggtataacagttgctccttctaatttttttgtatttgctttggtaggggaggactttttcctgaacacatacctatatgttggttgggtagaaaatttttgctttgcttctgggtgccgtgccgtagtgtcatctctgtgtgactcctttagctgtaaacaacatcagtagtgtctatgatgtcctcagtggcttagtgtgcagtttttagtgaaggctaaagcaaagttttgctgcagatgaggatgccagctgggcccctccttgagctgcagtggtggcagtggcaggccaagtgtgcctgttcttgggcccattcaaggcagtgcatgctggcaccagtcttagtgggtccaggcaggttgatcattgggtttccagaaagcttgctcaagtgctggcaattgcagcagtggaccaagtgagtgggtgggcccttgggctgctggccagcaggtgtggcatggacagtagcagtagcagtgacaagacaaccttctattttccaagtgatctgtgcttgtgttggcagtggctgtggcaggttggacaggccaattcccaggtctgtaggtggtgcatgctgacgggtacaagctttggtggtatcaactggttgtgttggcccaacttgaggcttctgggaggagtgctcagttgtcaacactggtggactgagcaggcaatcctcactctcctggacaatgagcttggacactggtagtggtggtgctgggccaggcagatctgtattaagggcctcctcttgtggtgcatgcaggtgctgactgtggtcggcaggggtagggtgatcccagacctctggtggaatgcttgggtaggggtatcagtggctgcactgtgtccctgatatcagggagccacaggttgttttcagtggcagcagcaattgtcaggcaggtagggagtgtgcacttttgccctgggtagtagctacagcagggtagcctgtcattagggtgcttgcaaatgcaagaggctccactgctgggggcagtggggttgcttccaatggctcatactttgaccctggtagcagcagccagctgcggtggtggctgtaggcagaggatgttcattgtactccagggatgtgtagaggcagaggatgttgacccccagggcaggatgctgtctattggagaccgagctctcaaaatggtgtcatgctgtagctgtttaggatttgggggtgggtggggggtgagacccaatgtgacatctctctctggagcaatgccgtcacataatctccaggcatattccctatgttagtctcagggcccacatggatcaagggttctccatagctaggactgcaggagttcacagtgagactgctggggtctctcacttatcctttcatcatattggggatcttttccaggtccccagcccattccagctgagcaggctgccttgcttccctctttttccttgccttaggtacttcctgtcacttctttgctgaattctagcattctcccatagatgatgtatttgaagtgtgattactagctattttggttcttctttgtggaggaggtaagtaccagatgcctctagtcagctagcttcctttctctctctaatgacatgtaattttaaacaacatacagtcatgcatttcttaacgacacggatacaatttgagaaatgtgtcgttaggggattttgtcattgtgcaaacatcacagattgtacttacacaaacctggatggtatagcctactacacacctaggccataggtgtagcctattgttgctaggctacaaacctgtaagcatgttattaatacttcaccgaatattgtaggcaattataacacaatgctaagtatttatgcatctaaatatatctaaatgtagaaaaggtacagtaaaaatatggtattattatattatgggaccattctcatatatatggtctgtcattgaccaaaacactcttatacagcacatgactgtagttatatttttcacatttcaaattggtgaaaaatattttaaagtaaattatctagtatcagtgagggtacactaaaatggccactatcatgctttactaatgggggagtatgaatcttgatataatttgataatatatatcttgaactttaatgaaaatattttagaacccagtaattttatttgtagaactctactaataatgaatagatcagaaagagacctatctttgattacaaagatgtctattttagtctttttgctctagtgaaatactggaaatgttaatattcaaaaatagtgtatagttaattatgttacatctacctaattaatatatttaaaataacatttaattaagacttagtaatattggaaattgctcacattttaatttaagtgaaatatcaggttgtatggatcctgataaggacacatgatgcacggaaagaaaaaggtaagatgctaattcatgagagaatatgactaatattttattttggagagaaccttaaggattttttcctgtttttcagtaatttcccaattttctttaataatctatttattaaaaaatattacttttataacaaaaaaactactgaaaagatagtcaacttgcctctgaagtagccaagatgattccccttttctctaaagatattatttcaattatttcaaaaaatgatcaactaggatatatgaaaacaaattcaactgcacacattcaaattgtgagctattctgcattccactttaaatacctacccaaaaaattaactctgaccagcaatctcatgaatatctatcaaaagtgaaaagatggacagtgcaaggtaacacgaatgacttaacatgagcccattcccaaaccagaaaagaacaaccaaaagcataagtcctaactatggcaattgaaacattattttcaaattcagatgacaatgttgtcattttatttctggtgaatataggctcagccatatttttttccttcattttctaagctcttttttaaaactctgttgataagagcactttaactcattttggcttctttcacagtaatatactaaagaagtaagagagtaaataatatatcaagatcaactccaaagactaacttctaaaatactaattaattttaatagctacgttatttgtactgtatttaacttctacattcaagtttgctttcatgtaaatatatccatatgtatgtattatatattacacatatgcataccatacattcacatttattatttatgtgtagatatttatattctgtttttaaattaaatttttaagcaatttatttttcaaattgtggaaattatagtactgctagcaaaaacatatacatatatatatatatatatatatatatagagagagagagagagagagagagagagagagatccaccagctataaagtacaaatagttgacttttaccacttaaaaatgtaaatcttatcatatacacacacacacaacacacacacaatgcacctacttaaaaagacaaatatcacactaggaaaaatgcataatatgtagtgaaggtttttttttttttttttttttacccttaatataggaagtactctagagaactaataagaaaatataaaaattcatatgggaaagtgggcaaagtatgtcaacaggaaattgagagaagagatggaaatgggccattaacattaaaaagatgaccaaggtcacccataaatagaacaaataatagcaagaagaaatactgtatttcatattgcagattgggtattagaaatctttctcatcattgccagtgttgataagtatatgggaaaacaggcacttttatatagctttagtaggtaaataaattggtaggtcttttttaagggggaaatttggtaatatctaaacaaacattaaatgcatatattttcaacccatcatttctacttctaataaattatacaagaggtgtgtaaaagatgtgtacaaggatattaagtgcagcactgtttttaatatcaaaacactggaaatctagatgtccatcaacaagggactggctaaaaaaaataacacatatataaacagaatcctatgcagtcattaaaaatgacgaggcagatttgtactacaaatatggggaaatatccaagataatatgaactggaaaaaattatgagactttttgtagtatgtgatcccatttgtacatgcgtggaaaatttggggaattatatataatacattattaacctgactgtgtctcaagagtgaaacctgaaggatggagagggagggggatgatacactttattcactttaaacctgtttttactattaatttttaaatcactggccaatattactttaacataaagataatagtagctaaaattacctactgaaaaagaaaatatgagcttgttatatctaccttgataatggcttgaaattcagtatcatcaaagtggtttttaattttgaatatcacagtcaccacagaagtgtctcacccacacataaagtaatcccaatcacttccacacttcctctgatagtgtaacatctccaaaggagctgttacagagtcaactgcactgtctcacacacgcctaatgggtccaacagagccattaggatgtcagttatatggcagggctcctgctgaagctattaccaagtcattgcattgtttcatacacttcctttagcaatcagatggtttctgaggaattgttatcactgctatgtaagggtcctatataacttacactaccaggggaaaacaaaaaaaaagcaaaggaaagaaatggaaaacaaacaaacaaattccctccatcaaatgtacatggtcaaatatcagaagaaataactcatcatttgggtataactattacatgtcattcaagaaacccaggcattaggctagccatttttttcacaactccagcggtttccttgaatgaatttagggtctgagaacagcatatgcatggctatgatggtatgtttattggtagcacataccgcactacttaggttctgtggtatgcagtacagaagcaacagggagcagtactaatggatttcttggctgttatgagattgtatcagatattcccttacctgtaaagttgctgaacagaacaacatagggagctcagccgcccaacagtcaaggaaatcaacaggacttctgagtactaattaaaatcccacctctcccttaaagggttactacaatgacaacgggaaatacaacagcacaagttaacctgcagccaggtctgaagtgcctcagggaacttcctctcacagtcttctaagtttagcagaacaaggttgttgcctattaataaaatgttgtattatttaaaataagacaagtgcaaggatttttacctactttaaaatgagcagaaagtaggctgggttctgctaggctaaagagttccctgggatattaggtgtttcagaagctatgctgcctctttgtctaatacgtgataacaggtaccttacctgatagcatctgtcccataatacgtgcataataaattaatagtgataaacaacaaccacaactgacatttatagagcatttcattttaacagacacactgtaaagtgctatatatccattttctcatttaatcctcaccacaaaaactcccaagactttgcagtcaccatttgacagataaagaaactaagacttggagatctttagttacctgtccaaggacatatagcaggtaaatggcagaactagtgcaaaaacctaggtctgtcttacatcgtggttattcttaaccacttactatacagaaaacgttgtttatttatattgtattaatattaccacttttacgttactaaatggtttcacatcccttgtgctctcagagcaagctaccgtatctttatcatggtattaactaaagtgtattaaaattagctttcaatcctctctagtagacctctttgggtatacatatccatttgacactgacagccctgcattgggaattgcttcgagaatcaattgggtaggcttccagaaagcaacatttgtattactgaccttacccctcattgtagctgatgagaccagtggtagacagctgactcaagttgagaaaattattctgtctccttggaatttagaaatggcactaaaaaaaatctggttaatcttagcttctttcctgaatagaagaaatatgaactaaggttttatggggtatggggtttttatacctgtcctgtagatggaaacttagagaaactcaacctgcagagacagtgttgaaggagatgggtttcaaaacaaaaagcaaggtcttaacaattcttctgagaattgttaagggactgcaacaagtcccttcttgtggtatagccacactcttgccctgagtccaatggagcattctcacgtactttatttttttaaattgtatttcttgtgggtacctagtaggtatatatatttatggggtacatgagatgttttgatataggcctgcaatgcatattaatcacatcatataaaatgaggtatccatcctctcaagcatttatcctttgtattacaactgatcatatttcactattttagttatattaaaatgtacaatcagactattactgactacagtcaccttgtattcttatgtacttttaatacaattgttttcagtttaagctagctcaagttgattcctgttacccataataggcgatcttaactaatagggcatcaatctctcccagtagacggtaaattccttgacattggggaatgtgtgttattcatctttcatatattcccaatctctagtacacagtttggcaaagagaaggtgcttaataaatatttcttgaacagaaatatcattatcatcaaggctataactataaataatttatttgcaatttatattttattaaagattacaatactttttcactacctagaaaatgtgtttccatttagcttcttgataaacaatttttattttcacattttatagttcaactgttccattcaggccacatgtgaaaaacacattcttggaaattgattattcaaatttagctgttgatactgttttttcctccagttcaatgtgtagccaaatgtaactgctgaggggtaccctaatcactgaggttgatacttaagtaggactgtcaaagtcttctaagaaatgcttattagaaagtaaagatgggagaaaatatttgcaaactacccatctgacaagggattaataccagaatgtataagaagctcaaacaactcaataggaaacaaaaattaaataatctgattttaaaatgggcaaaagaatagacatttctcagaagaagacacatgaatggccaacaggtatatgacaaaatgctcaacatcattaaccatcagagacctgcaaatcaaaactacaatgagatagcatctcaccccagttacaatggcttttacccaaaagacaggcaataacaaatgctggcaaggatgtggagaaatgggaacacttatatactgtcggtgggaatgtaatttagtacagtcaccatgaagagcagtatggaggtaccctaaaaaaaactaaaaatagaactaccatatgctctagcaatcccactactatgtatacatgcaaaagaaaggaaacatatcatagcactatttacaatagccaagacatggaagcaacctaaatgtccatcaacagatgaatagataaagaaaacgtagtacatatacataatataatattattcagccattaaaagaatgaaatcttgtcatttgcaacaacatgaatggaattggaagatattatgtcaagtgaaataagtcaggcacagaaagacaaacgtcatcttcttactgatttgtgggaactaaaaatcaaaacaattgtacttacggagatagagagtagaaggatggttaccaggggctgaaaagggtagagggaagtgggggaaaaggtggggaaggttaataggtgcaaaaatatagtaagatagaatgaataagatctagcatttgatagcacaacagggtgactgtagtcaatgttaacatcatatattttaaaataactaaaatattggaataggaatgttcctaacaaagaaatgataaatgcttgaggtgatggataccctaattaccctgattacacattgtatgcctgtatcaaaacatcacatgttgtaaccccagcactttgggaggccgaggcaggcagatcacgaggtcaagagattgagaccatcctggccaacgtggtgaaaccttgtctaaactaaaaatacgaaagttagctggatgtggtggtgtgcacctgtagtcccagttacttgggaggctgaggcaggagaatcatttgaacccaggaggcagaggttgcagtgagccacgatcgcaccactgcactccagcctggctacagagcaagactctgtcaaaaaaaaaaaaaaatcacatgtacccataaatatgtacacctattatgtacccataactaaagataaaaaaattaaatgaccattagatcacctgtcagagacagagttgtatattagatgaccagaggtctgacacactgtagcacttttatccttatgagagtcacacaagacaagatcaacaaaaaatatattttacccttagaacaatgcatatttttcatttatttagtgcctactgtgctctaggtccccttgctaagtactgaagctacaaaagtgaataaattagaccctttcttcaagtagcttccagtctagtgcttattaacaatgattgttaggatataaaatacacaactctagtattagtctatgaagagtagtaatgttgttagtaaggtgaaatgggaataaaaatgacatagaataaagcatgatggttgatatcaaagtatcacctaggtattgactgttcacaggtcccagaatgaagctaacttgaatgaatctgcatctttcttgacagacaattcagcatcaacagatgatgaagggtttacttaggacaaatttgagagaatggaaacataatgcattagtgctctgatacccctgtgaaaggctccagatccccttctgtcacctgatgatttcccttccagtacttcaggcctttaagttcaagtgttttagtgttgaaattaagggttatttcttataatccttcatgagttataaaatgtcagagacataaattcaattaagggcaaccaaacagagttaaggaaatgaggaaaaaaattctgaaaggcttggccaattaatgaaataaaagaaacaagtccttataaacatgattttggaaatgtaagtagaaaaccaaagtaatattctcctaggatgaatagaatagtaagcatctttgaaattacttctcagaatatttctcagttggacaattcacctaaattaacaatttcctccatcttcactttttctaacattcagagcaagtgaggctcaaatgttcctaagctgatccatgatatcatgcccactgcctcatcgataatctaaaattcagaaagtatatgaagacagaaacaaaacaaaatgtcattaacattaattgagccacagggatgggctggcatggagtctgaggtagcaaaacatatacataaaaaatattctaagtagttttactttttcagatataacatgtataaactcaaattaataaaatagatgccttgataagcatgctttcatgaatggataaagtcaatgggaaataaatagcaacatttccacacaaacaccaagttcattcattggaaataacttgtttcctcaaattaacatgcttttggaaaagccatttacactcttatcttaactcaaaccaactcctcaaggatctatggaaatgctgaaggcaggccaggcatggttgtcatcaattaaaatctgtggaatccacattggtaaaatcttaccataggtgataaataaggacccaaattatatactccttattgaaaatattagtaggagtcaaagtaagacatacagaacagagcagggaaaagttgttcaagtttacatattgcatacacacatgatccaaaggagaaagcaaagcatacttggaaaataatccattgcattcaactagattgtttctgaattgctgttttaatacttcctcatatgtaaaatggaaataatagaatttgtttcacagagtggtcataaggatgaaatgggataaagatatgaaaagtgtgtttggaaattttgaaatgctaatccaataataacagtgaacattcatattcttcctacatgttaaaaacactgttctaaatccttatatactagtttcatcccatttttgagtcactgccctgtggtgggatgcttggaccctaccacgaggtgttagagaagggcccagcacaggcccagttgtgaaaaccatttataaatgttactttcagtagtatccctctccaaaggggcaaaacccaatgaacacaatgaaggcaaaagtaaaaatatacaccaatgcccccttactaaggaatgacacagtgtaaatataggtttacagaagagaatgaacatttttttttcatttgaaagtgttatttatgattgatgacatggataaagtgtgatgctaaagccaagcatgaacacctggaggaagagaccaaggccaactgctaggcaacatctgaaagttatgacaatacctaaactatactgagttaattatgagagccatgtaaaacatggtagatttgtagaaagtcatgaagccaaatccaacccaacctgatttcagtctctcctcccaggttaaataaatgttttctcatcctacctggaatcctgttttatccttctccctagctcccccttcacctcctcttcaccaccaacattttcacatgaaattttcaagaagaaaacaaacaaataagctgccactgtattctctgacaggttcattgagcaggcttgtatgttgtttgtcagagaagcagggttccattttgtgggggtagggtgccagggatggggtgaagtaaaaataatttgtgatcaaatatttgaaaacacttgccttgagtagacccagcttgagcctccatgtcacaacaaacaggagagaatttgaaacctgtaacagtaaacatttcactagttaagccttgtccaagtcatctgcaattcctcaaacttcaacccttacccttcatctagtggtgcttaaaaaaaacccagctttattgcaatataattcacatatgtaatattcatccttttaaagcatacaattcagtggtttttagtatttttgcagagttgcacaaccatcacatctatctaagtctagaatattttcatcaccccaaaagatacctcataacaagagacttgcaaaggtagaagaatagcagagcccagtggggaaacttctttcattttaatgtttcaacccagtgaatatgtccagagtgagatgaaggagaagatgtcttgccaatataagagatcacctaccaccccatttcatataattttgatcattgtttttcccaactgaaagacgaaacccagaaaactgtagtgaccagtcaaaggtctcctaacttctatcctaatgcctttcacttacatgaatatgctacatatgtcaaatatgttcccctctcatttccgtacgttacttcctatactcttggccaaagtcaacaatgcatacatgaacacatacatatatgaaaataatctaaaaaaaatcaagaccccaaggatacttggtgatattgtaaagtgttatggtctactatttaggacgtgatattctaactagtaggcaacctctaattcctgattatatggccagtatcacctttggattaaaggaggcagaagaggacaaaatagaaaaaacaaactgcaggtacagggcagctggctatctctctgccacctgaaaaagtactaattaccactgttaacagagtaagccttgtggtcatggtaatggggacttataaaatgtacacaaacagaatgatggagagactaatgtgtttaataagcagtaatgtgctttttatgaaaagattttgttctctggtaggagcaaaagaacagaaataaaataaattaacccctttccaacaaatcaaaaagacaaaattttccttttataaaagttgcaagaaaatcatatatgattatgacataatgatactgctgctagtccttattgtcaagcaaatggatgatgttcattcaccttctggttttttaaaccacttcagtccaacctggttaatttgcgtttgtacattcaacaggttaatctgaatccaaatagtaagcacatacagaatatgcttgctacacaactgttcatctcactgttcatttattgatataaagccaaaatacatgaaatttggacattctataataaattctactagtattgccgtggaaaataaagatgaaaataaaaggtgagtaataaacaaaacatgcacgatattatggattacatgagattatttcccttgggggctcaccgaaaatgaaaagtattttgtctgttattataaataaatgtctatttgccagatacttaggtgcatgccttgtccatgagtccctgctaacttgtatttccattctgcatattaaatgaaagaagggcagatatagggaaggagaacaaagcaaaggctaaaaactgcattctttctgtgttttacttaaacaattcaagtagtttattaccattttccccatcagacttcctttcatggtcagtgtcagtcaaggataatgcagagttggcccggctggacaaacaggaactatgctctgatttcattccccttatccacattcttagtgcatggtcaggtgaggcagcaccttctgtctctgtgtccacatcagatcccatctctagctggtagccatgccgagaaacgctgtgcatgtctgtttggtagccagagcacagagtgtgagaggtttcacagaattccatctctgagaagaaacaaagttcagagaaaacgtttagaagtatgaagaaatcccccagaaaattctactttttgttctcattcccctctcccccattggtagtaattacgtgtttttgcaagttagaattctggccttttattcatggtagctaggactctgtgcttattttgcacttctgtagcttaaaattatgctcctgttgattcttacaaggttctggaaaaagcgcgcccaaaatagttctatagctacaattttaggtttcacaaaatgtaatgaaataagtgagtgcagaggagtataaagtgtagagaggtgtcctttaaaagatatttcttttctaggaagaatatatatgatctgcagagtgtacctatgcttaaaatattaaaatgatttgcttttctaagtattccatacacattggatttaagaataaataattcaatgtgaaaactctgagaaaaaagcattaagttcaaatgcacttttctaaagtatttttcctaaaacatgttaatttaaactctaaatcatcagtacctaatatcattattttccattgattttaacggagttcaaggctgactttatgctaattattctatgtaattcatttttttccaataaatacacacaaaaatttagtcatatattgtaccttggcagtggttcatggattggatttcctctcctttccccctagatcttagagttataaaattttcagaaccttaaagatgatgcaacgaattccttctttttatagttgaggaaaataaactccagaggatagatattattttttcatagctcacatcagatagcaacagagccctttttcctaaaacacccatgtaggcatggtttctggtatacaacaacgatgccccatcaacttactgcatgaatatcaggcattcagtcttacagtcaattttacattcagttatagcaaggtgtcaaaaaggggaaaagatgatttaacaattgctaataagttaatgaaaaatgaccacatgccaagacatatcatctgaaatgtccatgtaatacttagataaggtaatccggagatgtagtacaccatacaggattttctcagactgacatcagagacaggatatgtcatttggctgggaaggagcttaactgagtgcatctaatccttagcacatatcaataaaatgcaaactctaacatgaatttaattctctgaatacagaaagtactggattttagaccatacactagaggaaagcaagcagaatatgaatatatttttaaaataactatttttggggcatataattaccaaataagggtttaacaaaaaattcttattgtttacttaataccactaggtgcatagcactgtgctttgtgaaacatatagtaggcaaataaagctactataatgtattagaaatattcaattaaaaattaactctttcagggttataagtcactgctgagtatgttaccttttgatttccatgatgaatgtatttaagagtaattccctttttctacaaaaacttggctaaattccaaaggagtagtattcaaaaaatagtcgtggtttccacttgtcaaacataacattttatgaaaccatgcttcttcctgccataaggctaaaagtaaaaatccattttgcccaatataaattttagcaatctagaatattgggatcagctaatattcatgcctcttaatttcacaatgtttcattatccaatcctactgtgcagttgttgctacagcaacctggtaataaacctttcagcttgaagctgcaagaaatgaattttatataggtctgtaacaacttacttcactcccctagaacagtggctctcaaacttggctgcttcagaatcacctagaaggcttgttaaaacatagattgctgcaccccactcccatccgtgccttccaatttaagtttctgattcagcaggtgtggagtagggccaaagaatctgcatttcgaatgacttccctggtgagacccatgctgttggtccagggatcatactttgaaatcgactgccctagagatttacttgaagtggatgggatccagggaatgggtagtagtgagggtgcaaacttatcatggcattaccacagattttgctgcatcatctttaattctgtttaaagatacaagaaagggagtttttgctctgaattgctgtgaagtgtctccatttatttcccctggattcagggcactaactagaaaatttacttccaagagcacagacttgcatttagtttcactcatacaacggcatatgagatgtggctttccaaagattttaatatgagcatctgagtcatggcattcgttggaaaaggttgagcaaataaaaataaatgtaggtccaatttgtcattccagattaataaaacaccagataaagttttttaaaaagcactgacagatgtaagcagatttcttttttattaaagagatatttttcccattcaaaaggaaattagaacatggatttgctcccttctaagaaaatgctgtgtaatctgattaaaaattacatagaataaacaatttattttctattgtaactatatcctgctttgcctacaaagactgactcataaattctctaattaaatacagtcagataaaagtacactttcttgtcaatctataattagaaaaagtaacaatccaaattagctatcagttgctcttcttttttaagtggtaaagcataaaaaaagaaaagagaaaaagtttcacttacttatagtaaccgatgtttattgaaatgcctcatttccttttcttgaaatcaatgtcaccattgtaaaatattttcctaaatacacaaacgtcttggtggtgctcaaaattcccaaaagatgcattatctataaagcacttacaacgcaccacaagtagttgttttctagccttgtacatataaccttgttacctaaagtactacatattctctagagaagataaagttcagcagcgtgatcagggctcactgcagccctgacttctgggctcaggtgattctcccacctctgcctcctgagtagctgggattacaggcacatgccatcacacctggctaatttttcatattttttatagagatagggtttcttcatgttgcccaggttggtctcgaactcctggactcaagcgatcttcctgccttggcctttcaaaatgctgggattacaggtgtgagccaccacacctagtctgtaccacattttctttatccaatctgtcattgatgggcatttaggttgattccatgtctttgctattatgaatagtgctgcaatgaacatctgagtgcatacgtctttatggtagaatgatttatattcctctgagtatataaccagtaatgggattgctgggtcgaatggtagttctgcttctagctctttaaggtattgccctactgctttccgcaatggttgaaattcaattttttaagtgggcaaaaagtttaaagagacacttcacaacaaacaatagaggtggccaataagcaaatgaaaagatgctcaacatcactgttaccatgaaaatgcaaactaaagccacaatgagataccactacatacccactactatggctaaaaaaaattctgcccacaagaagtgttgagaaagaatgtggagcaattgcaattctcatacactggtggtgagaaagtaaaactgtgcaaccacataagaaaaaagtgtggcagttttctgaaaagttaaagccatacttaccaaaagagcaattggactcttggacatttatcacaaagaaatgaaaacttctgtccaaaactgtacaaagttgttcataccagctttattcaaaaatagctaaaaagtacaaatgtcccaagtatctatgaacacatgaatggataatccacctgtggtatatttacataatggaatattactcagtcctaaaaaggaatggactattgatgcataacaatgttatggacttcaaaatgactctgctaagtgaaagaagacagacaaaaatctacatatggtatgcttccatttatataaaattctagaaaattcagactaatctactgtgacataaagccaatacgtggttgcctggggaaaagggtggagggagagatggataacaagggacacaaaaaaactttggggtgatctaaatgtccgttaccttgattgtggtgatagtttcacaggtgtatacatgccaaagtttatcatattgcacaccttaagtatacgtagtaagtgtagtttattatacttcaattatacccctacaaagatttttagttgattgtacaccaccagatattaaaacaacaaggagacttttgaatcaattttcacagctagaaggaggtcttgctcttttctctctagtggaataaagtaaatgtaacacgaacaaaaaggtagtcaaaatgtcatcttgcttatatctaagccaagaggccatgaagactaactgatgcatgatttattttttctttctttcttcttcttcttcttttttttttttttcttgagattgagttttgctcttgttgttcaggctggagcacaatggtgtggtctcggctcactgcaacctccacttcccgggttcaagtgattctcctgcctcaccctcccaagtagctgggattacaggtgcctgccaccatgcccagctaatttttgtatttttagtagagacggggtttcaccatgttggccaggctggtctcgaactcctgacctcaggcgatccatctgcttcagcctcccaaagtactgggattacaggcatgagccactatgcccgactgatgcatgatttctcagtgatcttctagggtgtacttttgtcctagacacataagagttgaacatcaaatttaggagggaaactaaggatgaaactcatcactgctaagctttcagcagctagggaaacatttatggttgaggatcatgagattgagtagagctggtctggcacataggaccaccttagacatctactaatgctaacaaattaataatttttttttaaatgctatgaagcactgaaaaaaaaataaatgactctactttctgaatctaggggttgatcatcaggtgttcagcctaaagaagccatttatcaaaacttgagaaggaaagttatagctatctgtatcagtgtttttctagaaatgccatttctgtgttttgttttgtttgtttgagacagggtttcactctgtcactcaggctggagtgcagtggcacgatcttggctcactgcagcctcgacctcccaggttcaggtgatcctcctcccacctcagcctcttgagtagctgggactacaggcatgcaccaccacacacagataattttaaaattatttgtagagaagagctccccccagtgttgcccaggctggtcttgaactcctggactcaagcattacaagtattagccaccatacccggccaatttctgtgtttctgataagctcaagactattttttctaaaattctacctccccatgcttcctctaaaaagtgagctttaaggcattatgctccaaataagtaattggaagtcaagaagtgtgattaattttaaccatgacctgagaaatttgggatataacttttaaagagtatagcccatttccaaaataaaggagaggggggaggggatagaattattagtttaattactgtgactcataacaacccttatagattacatgcagaagcaagtgttattaattatccatttggtttttggataagtcacttaacattttgggggctagttttctcatttgtaagatgtatggatccaactagaaataaatctctacgtaactgccttgttctaaaattctataattataacccgaacctgttatccaacatatgtaatggtcaatgtgttcaaatgggaaaagagttagtagtttcatgaatcaaggagccatttatacttctttgtgaaggatatagtacatattagttaaataagatcttgtgccataattataattcctgctatattaaagtattgatacagcctatgtacctactatgaattgcaagattattgatagagaaacagagaatctacaacttaaaatgtaaaaagcaactgagtaaattgttactcatcaaatataaaagtatccatttacaacatggctattggaaacataatgaataaaattcacacaattaaaaatattactgacccactaataattcattactggctccagggaaaaatgcaatggattattacaatcttaagcaagaaatacagagacaaagaagtaagtaacaccagataagaggcaaataattttcactactgggtaccattttctatttctcagtttgagggctttaaaaagaaaacggtatcaaattgtcaaccaaatcagttcaagtaaatttacttaaacacagcttcactgaacacccactcaatttaaagtaaagaaatcaaaacaaaatagtctcctctgatttctcttagtcttagaaaattagttcaatttaatttcctcctttcttcatgaaaatgttttatcaaatgtacagtgctatactaggcagtgagcagagtgagttaacaggaccttgtcatgtcctttgggaagttccacacagagcctttttaagcccctaatgataacaaggtaataaaggcacattgtctaaacctgacttttatttttctgctgagggctcatcagctttttctggggcacaggagtgagagatggaatgctcccatgtgcaagactggagcctgtggttataagatgacttaaataaaataactaagcttcctggagcctaatctccccttgacagttccaaatgcacccattatctcggcactcaggacctactaattatgccttatttaattttcaagatttctccatctgtcagtatacggaaaagcatggcaacaaatctgggcagagttaaaagcctgaagtagaaacattcatgctttgtgaccaatattagctaactggagacatcccagaatgcagttaaaaggctatgttaatatcaaaaaaaggatgctctcaggagtacaatgaattaaaaatctgtaaaaatggctcaaatcagaggacacagaattgtatcaggactcaaaaggaaagaagacgaggtagaaacctggaagaaatcaaaacaactccaatcatatttagagagagattaaaatatccttcagcaatctaagaagaggaagaaaatttgatgtgggaataagcaaatgctaactatttccttaaactaattttcaccttagtgaacggctccatttagactgtattcacataagatgggagcacttgttttgaagctaactcagcagttaccactacaatgacaaaaattggatgcttgctctacaatatttgtaataagagtctggaaaaagaatcagggactagaaaagatggtgggaggtcctggacttcaacagaaatttagatcaatgagaacctgtgcatgttccctttatttcaacattttgaatgagacagagacttcctggcctaaatgagaaattttcagggctactgaacactgaaaatgcatggtgctcaatggccctaaaaatttctcatttcttacatgtgctggcccaattttctggctggtcataactcgttggaacctgaatccttgttgcccattgtggtcttccaggtatacttgtgtatttccattatgttcactaagtatgtgcagctttttggtcaatgggtgcgtgtgtgtgtgcgtgtgtgtgtgtgtctgaaattttaaactacatcaatctgctgcacaattctatctagagaagtgagatcaatgagctagagttaaataaccattaaaaacacttgtgagtgcttcaaatacatactcatagaggcaagcaatattatttctgtaacattctatacttctctgtaagcatttactttgtgatgaatgagtaaagatgccaagatagaatggtacaacagagtcagcgtccatcatcaactacagaataaattacattctaaggtggtattgccatcccctcagaacttagactacttctaggcaaagagtgaccctaaacaccaaagtttaaaaattagtagttaacatggaaccactcttgaaagggttaacaacttgaacccaattctgacacatttgaggtggtttagcttaacataaaacaatgcctaccaatgcaaattgaaaaattgttattttggtaaattagctgtctgtttcaaataacagatgttccacaaatttggcaagaggagaaagacagcagcccactggctgtgaattcaggaaaatacaatttataatattagactaatggagaacaagtactcagtatcatcttctgactgaaatagtcacacaaaggaagctttctacactatactttttggcataatgaactgggaaataattgcctgttaaaattcttcagaaatgtactctagggtgtagaactggggaaattttactgaaactagtcacaaagccttggtaaaagaccatctttaagctggcttgaatagaaacttcttttgtcattctcatcaaccagtttcatgccatatcccagatagaatttatcatctcagtaagtttgtagaatgccctggagtgggtatgtagctcttctgacagcctgttttcaggaactcagagaatgttactaaaaaaaataagtcagggatagaaaaaagaaattctggctggatgtgggtggctcttgactataatcccaccactttgggaagccaaggtgggaggattgcttgagccaggagtttgaaaccaggctgagtaacaaagtgagactctgtctcaattaaaaaaaaaattagccaggtgtggtggcatgtgcttgtagtcccagctacttgagagactgggaggatcacttgagcccctgagtttgaggctgcaccactgttactcaagcctaggtgacagtgtgagacctcatcataaataaataaataaatgaatgaatgaatgaataaattttctaagttgggaaagattgagaaaataactttttggacactcatcaggaacttgcaaatttgaattccattcagaggaaaacattaaattctggagaagacttccacttgcaaacaagatggagtgacagcaaccaaatttattctcctgccttaaatgacaacaacgaaagccacacaaaatgtatgaaacaacagttttcaggcattggacaacagataatgaaggacaacaatccctgagatatgagaaacaaattaggtaaaccctgtaagagtttccaggcctcaggacaaggagggggatcacaggtagagcctggtagtctctttgagttgagaagactaagctggtagtgcgggaaggccaagatagctagagtttgcagtacggagtaccagagaggagagaactgcacagaaaaagaattccatagatcttcagagggtcccccctgcatattcacctgcactctggacagcacatgcgtgcaagaaaaccatctgagaatggagaaagagccatcagaaaggaataaaagaaacaacttctgaatctgaaacagggctggaaatagtcactgtttccaacatccacagtggaaaacctcataattcatgggcattgaatagaatactcaaaacagattttgaattcatagatagatgttcctcgacttacaatggggtaacattctgataaacccattgtaacctgaaaatattgtaagtcaaaaatgcctttaatacacctaatccactgaacatcataacttagtctagcctaccttaaatgtgctcagaacacttacattagcttacagatgagcaaaagcatctaacacagaggctatctttataataaagtgctgactatctcatgtaatttatagaatgctataccaaaaatgaaaaacagaatggttgtatgggtactcaaagtattttttctgctgaatgtgtattgcttttaaaccatcataaagtaaaaaaaaattaagttgaatcattataagttgaaccattgtaagttggggactgtctgtatatatttgcgtataaagctttgttctagtgtgtgcttaaattacttggcaacatttttatccttttgggtcttgctattaagctttgttaggtgggtgcagagcaatgttggccctagatatcttcatgtcttataaagttatatgtacacttaccatatgatctaactattccaaccctcaatatttaccaaagataaataaaatcacatgtccttacaaagatttgtacacaaatgctcatagaagctttatttgtaagagccaaagctggaaataaagaacatcaataggcaaatgaatgcaaactctggtacatccatacaatggaatactactgagacataaaaaggaatgatctattaatataaataatataacgacataaacaaatatcaagataattatgctgagttaaagaggccaaataaaaagtctacatactgtgtgcttccaggtatgtaagtatccagaaaatgcaaactaatatatagtgagggaaagcagatcagtagttgcctggactggggtgtgtggggagtggaggatataggcattataaagcagtgaaaggaaacttttaggggtggtaggtaggttcactgtgatgattgtggtgatgttttcatggatatatacatatgtaaaatttaccaactcgtatactctatatatagtttattgtatgtcaattttacctcaataaagatgtttctagaaaatacagggggaagacaagaatgtactctgcttgcctaatttaaatggccaagaagaacactgggaacaatgaaacaaagcagcaaggctgataaaacagaaaaaccaatctgtgttcacacactgtcatcaatgagggaaatggacagatcaatttctctcaacttgtctgccattttacttttactccaggggaatccgaagggcttaaattctggataccaaaatcctgaatggctagattggtacagactaatgcaaacatgaccaacaaatgaggtttattcctaatctggcaggaaagattcatgggccaatctgggctcaatgataaagtaccatgacagattaggtagactcaatgatatcggtgacacatttgccatttccaccttaacagtctagttgcctttgttttgtcccatagctacaaatttctctcataatcctggctattcattctggttgaatgcatgtcatttatttccaagaactagatgagaggatatggttaactcagcgcaaatgaagccctattatttaaaaaaccctcagaatctacttctcaacaataagaggttgataatgtaccctttgtttaccattaatttctacaaagactctttagtggcatagcatatatagtcaatggcagaatgggttattatatgcaaacactaacatagtagtcatatactcttataatcagggtcagtcaacctcattctgaagtatagtagatctgaaccaacacaattatttttgagagtggtatttacattacagtcctatcattacaaacttttatttagaaagaaaggccattctctattagctgtggaagttggaaaactaacttatctcagttatcagaaaattcacttgcaactgactaagcacaagatttttaatttaaccacttctaggtagttctgatttcaaagcacgcattccctagtcctggggcagaaatgaatggaggtcaagctagcaaaaagcatgcagttttacatatcaaaaaaagaagaaagtaaatccaaacatgaatttagcatcttcttttttaaattttattttactttaagttcatgtgccaaatgtgcaggtttgttacataggtatacatgtgccatggtggtttgctgcacctatcaacccgtcacctaggttttaagccctgcatgcattaggtatttgccctaatgctctccctcctctagccccctacctcctgacaggccccagtgtatgacgttcccctccctgtgtccatgtgttctcattgttcaactcccacttatgagtgagaacacacagtgtttggttttctgttcctgtgttagtttgccaaggatgatggtttccagcctcatccatgtccctgcaaaggacatgaactcatccttttttatggctacatagtattccatgatatatatgtaccacattttcgttatccagtgcccatcactgatgggcatttgggttggttccaagtctttcctattgtacatagtgttgcaataaacatacgtgtgcatgttctcagaacttaaagtaaatttttttaaaaaagaagatgctaaattaatgtttggatttactttcttcttcctcttttttaatatgtaaaactgcatgttccttggtagcttgacctccatgaatttagcattttctatgtaccaagccctgaaacatatattatttcatttaatcctcagagtagccctgagagaaaggttgttattattccaatttttttttttttttagatggagtctcgctcttgtctcccaggctggagtgcagtgatgcgatcttggctcactgcaacctccacctcccgggttcaagtgagtctcctgcctcaggctcctgagtagctgagattataggcacccgccaccatgcttggctaatttttgtacttttagtagagacgtggtttcgccatattggccaggctggtctcgaactcctgacctcaggtgatatgcccgcctcggcctcccaaagtgctgggattacaggcttgagccactgtgcccagcttattagtcctgtttttcaaataaagcaaccaacattcaatgacagattaaataaattgtccaaagtcacacagataccaactggcaatgctaacttggaaccattttaacaccatcctaatgacctcatgcagcatattataagcagcacattcaaattcacagcttagtcctcatttgtgcaatgtgaatgtggcggatgctagaacttcctgcttcttgtctcccaggtttcattcagttcactgctgtctccatctggatttccacagccagccgccaaaatactttgagggatatagcagccaggagacaatgggcacttcttttgtcactgacaatataaaaatagacccttaaactatgcatatatcattaatagcttattgttctatatgagtttaatgcatttttgtacctccttttgaagtattattccactctgtactaattcttatggattcactttacccgcaacttgtcactttgactcattgaaaacaacaatgatattttagagcatattctgtgcttccagacaacacaaacaacatctgtgtctgcaggcggacaaataaaagaaaacattggcctctcttgtgtttagctccctagcacagagcagctgccttgaggagagttttgaaattatttaacaacattaacaaagatgagaggaataatattcactgagaaatgtgtgttggggtattacttcagcatgttatcacccaactagaggaagcaatcagatcaaattttgggggcagttcctgtttacaaggtagtattatcatctcatgctaaatagactaagcctatatctgtgatctacattcagagttttacacgtatcacagtacacagagaaaggctttgagttgaaaatattctacagtttatggtaaaatgtttaggaacatttttctttatttgaaatttatcaaggaggtatgaaattagataaaggcatgcttctctttacctccacactatcatttagtgctaacactgcaggcaattcttgcaaaatgcattttccaaaacctctcaaagctagaaagcaaatgcaaacagcaacaatgacattagtgcttttgaactggaaacttatattatccaaatccttattatcattgccccaaacacttaatctgaacaatcaaattaatgtttcaggcatttaaaaaacaatggacaatctatatacatgaatgcatgttccttttacacattttggaaggatgtgcaggtaaaacaatctatgaggattgcccaaggacattaatgatatacaggatagatgtaatatgagtctacatgatgcctggaacagttgactccatttggtccccaaatcatcaccttggggggaaaaagcacaaagagccaaatagtgatttgatagtatattgacaaaacacatgcttggctaaatgttcacttttgacatagttacttggctttgtcactggttccaaggtttctcctaggcacaatttaaggtagatctgttccttttgtccatccactgtctgtcaccctctccctccccatattcagcatcaattactttggccgttttcacttccttttccagaattctagctccatttgttttttccccctttcttgttcaaatgttctcatttcttggccagttgcctaacagcacagcagtatgttagcgaatctgaaaaagttaagctaggtttggtatactttctcttccctgactaatgccaaattatatattataattttttttttttttgagacagggtcttgctctgtcacccaggctttggagtgcagtggtgcgatcacagctcactgcagctttgacctcgtgggcttaagccatccttctgcctcagtctcccaagtagctgggactacaggtgtgtgccaccacacccggctaattttttaattttttatacagatggggccttactatgttgcccaggctgttgtcgaactcctgagctcaggtgatcttcctgcctccacctcccaaagtgctgggattacacacataagctacggcacttggcctataatttttaatagagcacttcaacccttagttttcatgccctcagtccatatgttattcaataagcactcacggagcacctatggtgtgacagacactgtggtaggatccaggcagattagagagaaggaaaaagatacgtcctcttccctcgaagggctgacaatctattgcagacatggaaatgatgataggacaaggaggtaagtaagtgccgtgatagatctatacataaagggctgtggagtctaagcaaagtgagggactcactctgcctgaaagactgagacaggctccagagaagtgatactttgagtttcatcttaaaggatgaatgcacttctggtaggttaaaaagtggataagagcatttctagcacagagaagtgtgtgttcaagggcaaagacaagtgtaagggaataatgaaattaaagaacagcaaacaattttctgcatctgtactataagtgtaggggtagaagaaccagtaaagtgggatggagccagtttgtaaagggccttatataccatactaaggaattgggccttgtttgccttagattatatctcatgctgcttactattcctgtgtgctagggctccagaatcattaatctgaacacaaataaccgagtttacaatttttttgcatacatctacaaagcagcctggaaattcgctagctgtgagttttaatccagaatgtaagaaaattcatttaactagaaaatatttattaaccacctaacgtagcaagcattgttccaggtatcagagataaagcaatgaacaaaacaggcaaaaatccctgccgtcatggaactcatattctagcggaaataaatttgtaataactgtgctcagtcaaaatttagtatcagaatcacacagattttcatctgtatattaatctatatgttattgtctgtgcatttcatctcggtattaactcaggttcctccagagggtcagcaaaattgagtatatgaaagcagtgacaagtaggaatttagcttcttccatcgaactgaaatctactaggtgaaaaccatgtcaatggcttctctgtacagtatcctccatttgagggaagttgaggaccctgggagactatgctgagatatgccacatttgtccctgttctgtgtgttcacttttcttcccaaaatatttttggctaaatacttggaaactcaatatcctgagagaggggataaggagagagggagcaagaaagagggatggagaaagggttggggagagagttttattttgttggggggaagagctcttctagtcaacccagagcccacctgcaacaccataatcaccatgcacttcagagatggggagctggggtggggttgggggaagaaaaattgaattactctacagtgtagctataaaattataagtgtaacactgttcacttcatgacgtataatcaataaataaaagtccagtcttgaaagggtgtgctatataaatgccaaatagtatttgctctgaaaattccaaatctgggtagggttatttaaaaacagtccacttgcgaacagtttgattttagcattgggctaaaattataaaaagacaactttcattcatctaggaaatcagttttatttcttaaactacataaaattcaaatgggccttaggagaggtgtgaaaagaaagctaactggaaaggccattttgaattataattattcatatataaaactaaaatatatatcatctactggtatattaaaaatatcactagattccaagggtacctttcaataagaacctctttccattaagaattagtaaaaaaatataaaattggatgcactggaatgtaaaagttggaaaaacattgatcataatttttttcttactaataccattgacttaaaagagatactggatttttataaatagaactagcaatttatatctactatacatttatatacgttcccatagtgattccataaataaatattttacaaatataaagaaaaaaacgaacttccacaccctctccccaagctcttcatattaaaaaagaaatatcctagttctcctagtaaggtgacagaaaactacttactgctcagacatgcattagtgtgtggagactagggtaccattaaagcaactggaggaggtaatttagtaaaagcaccccctactagtttgaagagttaatgtgtttctctcctgttaagtgggtgatttctttttgcttgccagcaacataatgaccaatatatggtacacactgtgagcaatgggccttcttgataaaaatgattaataggtatataggtctatacatatatacacatgtgcacacaattctcacattgtgaatttagccataccttaatttatgctttatgtaacacaagagactggctccagtggaatattctataaaaccagaggccaacctccagccaaaaataaagacaacaaaattatgactgctttctgaagtagagaataatggaaaatcttactatactataaagtatggagaaacaggcatatgcttataccaatttttgtattcactaacttgtcacctcaccatagccactgcttgtcatatgtaattatggtattttttgatctccacaaaagtaataatagtcataacagcaacaacaaataatggttattctagtgcttgtcctgtggcaaacactgtgctatacactttacatacattctgcatttaatactgaacaatagcttcctgaggcatgtattattatcttgtattgataagcaaggaaactgactctgaagggttaaaatacttgaccatggtcaccattcctagtaagaggtgaagtcaaaattcaaatccaattttgtttgtatttaacaccttttgcttctaatattgctttagtggcagaaaggctatgcattcacttcgttacaggtaaaatgatctcttactacatgtatatctgctggtggtaaggaggtataatgtaatctaatatggatctctaatttcaacaaacttaatgtctggtaatggaaacaacatatatccccatatatattgtagagtatataactggaacctaatgattggttcaggcaataaacactaggagagggcacagaggagaggaagaatagaatgagaaaaatgggtcagtgactcttgtggagttggtagattaagctaggatttgatgaatgggtaaggcttgaatgaaagagggtagagtttagactccagtactgttgtccaggttgtatatccaactattcatttgtcatatagatatttaaaagacgccttacatttttaaaaatgtccacagctaactttattatcactgccttcaaattgatcctcctttaccattgcctttttgtgaatataagtatcatccattcatttgcacaggccagaaacataggcatcccccataccatcatttttatcttctaattatatcttgagccaatacagttttttccattttcacattcaataatctctggcctagatgactgcaatgacctaactggtacccttccatccaatcttgttaccctctaatctattgtttgcaatgctaccagacagaatgctaaaaactaatcacatcacctcccttcagtatattcccattacatttaggataaatatcaaaatctttaacatgctttacaaagtcttatgttatttggttccctgtctacttctctggccactcactctcttgcttctgcaacatgtacttcttccagtttctcaaatacgccatcctacttttcacctcatgacatttgtgcatgttgttcctcttctccttcctgcccctttccatctcttcatttggttaattctttcttatatttgatttcatctcacttccttgaccctccagaccagattaggtccttctttctctggagtacttatcacagtcatcacatcataattttaggatcagttttataattacataaaaactctctactcctactaaaatgtaaattctcggctggatgtggtggctcacgcctgtaatcctaacactttggaaggctgaggcaggcggatcacctgaggttaggagtttgagaccagcctggccaacatggtgaaaccctgtctctactaaagttacaaaaattagccaggcatagtggtgcatgcccgtaatcccagctacccgggaggctgaggcaggagaatcgctggaacccaggaggcagaggctgtagtgagccgatatcgcaccactgcactctagcctatgtgacagagtgagactttgtctcaaaaagaaaaaaagtaaattctctgagggcagggaccatgtctgtcttgttcatcattgtataaccagtatccaaaaaactttgcacacatagaagcataaataaatatttggtgaatatagcagtgtatctcaaaagcattctaagcaaggatgatagtagaaacacaccataaagaatgatgattccatatctggaggactgatgattgcatgagtgtagcttcacacggagtgctttgctcagtaaatattcaagtctggctggtttaaagggttcatacagatggaaaaaagggagaaaatactggaaaaaagattttgaaggtcttaataagcatctcaggatttattctacaggcaatagagaacaaccaaaggcttgaggtggttcagaactgcctgtcaaaaatctgctgctatcccaactgcacatgtattctccattttagcctggtgcttccaaatacatgtccctactttcagcatctctagaccattcatgtttggagagactcctacccaacagaactgccacatggtggaatgtttggcttacagtgattcccccagtgaccatctacatactgcaatctcacctctttgaaaaaaaaccattgttttacccccattttagacttgtgatctgaaaagctcctacctttgtattgcagtctttgccacaattataattgtttaaggggtggacacctgatccagtctgggccaatcatatttcccacctgctatggtttgaatgttttccccctccaaaactcatactgaatttttttttctttttgagatctggtcttgtcctgtcactcaggctgtagtgcagtagcatcatcatagctcactgtaacctcgacctcctgggttcaagtgattctcccaactcagtcttccttgtagctgggaccacaggtgtacatcactatgcccaactaaattttttaaaagatttttgtagagatgggggtctcactttgttttccaggctggtctcaaactcctggattaaagtaatcttcctgcctgggcctcccaaagtgctgtgattataggcagttctcatgttgaaatttaattgtcattataacagtattaaaaagtaggacctttaaaacacgattgggtcatgatgagggcttcaccctcatgactggattaatgccattattgtgggaatgggtttgttaatttgttaccacaggaataggctcattataaaatggcgagttcaccccctttctctctctctctctctctctctctctttctacctttccactcctcatctttgcccttctgccatgtgatgacacaaaaagacatctttagccactggactccccagccttcagaaccgtgagccaataaatttctgttcattataaattatccagtctatggtattcttttggagcagcataaaacaaaccaagaatggaccaagacacctcctccctgtccccactgattagtccagatattgatatgggaaataagctagtccaatccaggttcattttcaggttttcttaattttttaaatgtttactgaaagcaggcagaagaggatctctttccttttagttagctaggctgtaaggttgacagcccggagcagtcagcagtagccagctgtccatcttgtacataataaagctggcctgcagagagaggtaggaatacaagggagtcttgacagttttccagtccatgactccaacctgtgttccagtttttgctaagaccatgttccaccttgttgtttggttacttgagccaaaaaaactttttttttctcttaagctagttggagttgggctaccaccattcactgtcggagttctgactaatacaaatatcagaagtggtggcctagagatgaattagcaaagtatcttcaggatcaggtctctgctaatgaatgtttgtagctcattccttaaccccacatagacttcctgcttctcattttttgacttggattttaaactgtccttcactatatcacctccacaaccacaggaccaaagaaagcctggtgcacaatcagtgcttgataattatctattgaactgaattgagttgtgataaattctcctatagatttttaatcttctcatctcttcaactacaatatgccttgtttatgtgcttgctctgctagctggtcattcccttttttgctgcctcctgatataatttgactctgaacacccctgtctaattcattcattttctgtgcaaatttctgctccttactagtatattcactgggttatgtgcttttctcaactttatcaaatgaaataaagccacttgactattatttgctcatcactcttccatgatagccaggtaatctataggcttagaattctctacgctctgacatcagctttgtccctagaaatgaaatagaaagggaacatctagctcataagatgtggactcaatttgaagctctgtttttgatgctggtttcttagctcaggttaaacaaacagaaaccttctctacattcttcctttttctacccagactccctggcctgagcttcatatcctagcttgggctatttctggagtacaggaattgatatttgcaagtaggaattagagggagacaacacaaagaagatactgaatttttttttttttttgagttggtgtctggctctgtcacccaggctagagtgcagtggcatgatctcgactcattgcaatctccgcctcccaggttcaagcgattctccagcttcagcctccagagtagctgggactacaggcgcgtgccaccacgtctggctaatttttgtatttttaatagggatggggtttcaccatgctggccaggctggtactgaactcctgacctcaggtgatccacctgccttggcctcccatagtgttgggattacaggcttgagccatcgcgcccagccgaggctgaaaatttgagccagatagtaaccagttttctaacagaagcaaaggaatgtcatggtgaggctctgagcctgaagagaaattacaaaaaaaaaaaaaaaaatactattcattgccctacccattcaattccttgagaaacaaaagtgaaagaggccttattcaagtcaatgttaaataagagaagggaactgacattaagaaagtgcctactttgtgccagacactgtgcgaagacctatccatatatttcgcacttaaagatacagtcatcacaatgactcagagaggtaggcattattcactttacagatgagagaacaaggtcaagtcaagtaacctgccatgttaagtaatattggcaattttttaaaaaatggagctaggatttgattacagatctgttcccatttagactgggtaagccagaccttcaggtacctacactccagccacatctatgctaaacattgtctgaacattgtcctatgttcccattttgcagctccagtgattctttgcatagaaagccatacttccccatatctacctcttgaaagttgtaacagtttttcaaggcttacttcaaattatctcttttctaagcctcgctttagccaaagttaacctggccctctccatagtctcacagtgccctattcaaacttttatttgatactcattgaatgccttatagtggtactctgatttgtctatttatttcgctacaacactgaacagacagatcacaatggccatgtaggttcttggcagattgtgatatctgtgatatttcgatcaattgaaagctgtgccatgatagtctacaaaaaagactacaggataaataaattatggttcagtcacacaatggaatattatataaccttgaaaataaatgagctatgtacattaacatggatgcatgtcagtaatgtaacattgagcacaaaaagcaattcatagaaacacaatatgattatatttaagaaatttgtaaacatatgaaactgaaaaacatatttttagggatgcatacatacatggcaaaactataaggaaaagcaagggaatgataaacacatttcaggatgacggtcatctagtagggaagtgagggaagagggctgggatctgaaaagatcacacagcagaggcaaaaaggtaattagtaatgctctatttcttaagctacatggtgaatacataaaactttaattattgaaactcaaaccaaaaatttcaaccaaatgacttttttccctctagctttctactgtaagaaaataaaagtgaatgaaaagcaaacacatcatttcagggatttaatcaatgagggtagctaccaggggcttttctgtactgaaaagaacttggcatcagagaactgggtttgaatcctggctctataaatgtagcaattgtcattattattagggcttcaggcaaaaagaaccgatactcaaaataatgaacataagtcactaaagatgatcagtcatagaatgaaggttcaaaaatgcttcctcgatgtcacactggggtagaaaaggagtcattttagaaagattttcaacaattaaagatgggaatttaaaaatatatgattaattctgaatcaacaaaaaaaatacggattaatgaaaattcctcattccctaaacatcatgctgactgaaaggttactatactttcattgtttttatttattgtttgaaaaatgcagaaaacacataaatacataaacacataagcataaacacttttttgtgtttttacaagactgagataatgttatatgtaatgttttgcaattttcctctcaatagtatgtcatggatatctttcctgtgttagaacacgtagatctacttaactttttttcatatttgcaaggaatttctttgtctgaggctactataatttatttgaccagaaccacacatttagcttatttccaagtatttactattataagcaatgttcaatggccatccttgcatatacacctttctgcactcttgctttattctttctgtaagataaattcctgaaagtctgattgctgggtcacaatgcatgtgctttttgaattttattagattctcataaaaaattgttctagttcatatttccccccacagttccagcttcctcatacccttacagtaaatatttgaatcattttctttttccttttgccaaattaggtgaaaaagttacttcatttttatttatatatatttatacttactttctattaatttgaacatcatttcatatatttattggtattgtgtaattctttcatttttatatggaatgtgctatccatatacattgcattttgtatgtaccagatattatctcccaacctattgttttcccatccccccttactgttgtttatgggcattcaatttttacattatcaaatctgtcatttttttttcctttatgggttctgggtttcatgcttcacttaggaagtccctttatataacaagacttttttttttttttttttaaagaccttacctctagtttcccctaaatctcacgcccctcttttaatgaccaaataatgctatcaactcaggctttgtctgactttatgaacagaggtcaagtcccttccacacatcaagagctattgctgcttatttctctttatcattcttatttatactgtataagatgttttagaaattacccccccaaattctcattattacaattaaaataatacagttgttcataaagacaaaattaataaataactccctatctaacttctccaatcttgtcacaaggcaactgatactcattgtagagtgaaggtctttccatacctttctctagacccataaaaatatatacaaacagacacattaaaaaactttccatttatttttatgaaaattgggtattttatgtattatactatacttgtttgttttatataacaatataacatgcatgtttccttaagatagaatatgcttctaactcattgtttcaaaatctggaaatattaaatgttatatgttataaatgtaccattaattatttaactaatgccctattgctggacatccaagttgcttccttttgttgtcattgttaaccctacaatgtcacttttataatccttctcacttctcttcctaaccccatgagatcttctggatcttgttagtcctcccttcttctcactcccactcctgtgttttgttgggatagtttagtatatttatttagacgcttgtgctgtccatatggtagccactagccacatgtgactattgtacacttgaaatgtggctagtctgaactgagatctactgcaagtacaaaatacatgtgggatttttaagacttagcacaaaagaagaatgcaaagtatttcattaatactttttatattgattacacgttgaaatgatactattttagatatttaagtcaatctgcctttccatttagatttaattacttttccagagagccaggttcattgcccatcattgtttcttctctcatcttgaagtctccattccgattcatttattatttagtttgagttttttctcaaatattttttcactggtgtatgagagtgatatactttttgaattcttacatgtcctcaaacatctttctctgacccaagtggatgaatgataccttgactggatggtaagttacttggtttgcagtctttttctcttagaaatttctagatgctattccactgtcttctagcttccacgatatagatgagaaaaccatttttttctttgtagatgattcagtttttctgccaaaaagcctgaaagattttctctttatccttgagatttaggaagtatatcagtgtatttttcagtgtagaacaaagtatgcctcttttatacatattttcgcagaccagcttttggctttgttaattgcacattgaaattttgtaattattttagcttatatttttattacttttgtacagatacttttatgtgaaatatatatctatatattctttttctgttcctgagttgaaagatttttttcaatatttctttaaattcagttaatgctataaggaaaatttatagcgttaaatgaatttaaagaaataataaattttaatttaaatgtatattttgtgcaaagtcttgaaaatcccacatatattttttacttgcagctctcatgtttttagccacattcctagattatttaggaagtaatataatttttgttcatttttaaataattttaaaattttcttttgattttctctttgatccaaaaattacttacataaagtattttatggttcttctaagttttttcctgtttaccttttctggtctttgaattgttgatttctagctttacagaattcttgtcagaggatgttacctgccagttttccacttgagaatttattaaggttttccttgtggcaaagtacatgataaattttgtaaatggtccaggggcataaaatacaaatgtggttttgtttttggcattagagtatctaattctatttatttgacaaaatattaggtcaagcttcataattattcaaatccttggtattattttttgcctacttttcaaattctgagaaatctgtatttcacaactgtaactgcagttttatcaaatgcttcacatatcattccatacagttacatctaataaatatttgtttatggaatgaatccctctaggttctattttaatgcttttggccttaaattccacttaatctgatattgacatccttgccctatcctctccttattgaaaattccctggcatatcttcatctgttcctttattttgaaacagtttcatcattttgtttaatgtttgtcacttatatatgtacttagctaaaatgcgtaaatctgagtggttttgtctgggaataaaatttgtcaacccatttccattattgtaacaaacacaatgtcttaatcatagtataacaatgtatgtttattatctttgtggtaggcagaataatgcctaaagacatccatattctaatacccacaacatacaaatatgttaggttacatggcaaagggaaatgaaggttgcagatgaaattaaagttaataatccgttgacattaagatagggagactattctggattatctaagtatacccaacgtactcacaagggtccttaaaagtagacgagtgaggcagaagtatcaaagaatgtatgacggggaagatggatcaaatagacatgaaatcgctggctttgaagatggaggaagagatcatgagccaaagaatatgagcagcctctagaagctggaaaatgcaagaaaaacaggttttctcctagagctttcagaaaggaatagagccttgctgatatcttgattttagcctggtgagactcatttcatacttctgactatccagaactgtaagataacacatttgtgttgttttaagccactaagtttatggtaagttgttatagtggcaatagaaaactaatgcaatattataaaatgtaaataacagtttgtttccaaattactgtggacagtggatggataacggggaaaagtcaattcaaaaattaaatgaattaatattcttacattgtttattcttctttccatttccttgtttaattttcgaattgactttttgtcccttatcaaaccccttcttagaaatctgcaaatttactggtacttttattttataatacatttcaatctaaactaacaaatctttcagttataatgccccatttctcaagcattcatactatctgaagtctaactgtcttttaaatttataagcaacagataacatgaggattggacctaggaagagggtggcaggaactatgtcaaatttaaccttatttcactttcaccttctcttttctaacgtttctttcctttatctctaacaccctgcccccaaccaagtatgtactgttcaaggctctctaccacagagctttgtgctaggcatgaccttcctggcaaatatcttatatttagaccaaactttcctatttccgtccttaagagttacctgctctgcgttacctgttctcccagggaccatgacattttgttatgcaaaccaatgaacaatttcatagtgttaatgaagccaacactatttatatgtgggacaatggcttaacctttttgaagtggttttgttttccggacagggatgaaaatttaaccaaagaaatgactatttgaggctggaaatttcaggcattgtggcaggctatacaggaagacatttgtggctggacgaggaaggagtcttcatgccatacttcactgtgcactatcgaagtgggctcctactccacctgcatgaaatcaaacatgtactaacagtgtatgaaccaccgaacaagctagatatcctggccatagaggctattgtgcctcagggccgctctagggcaaccacaagaacagataattgggcctgtgagctgacaaatcaacttgtacccacaccattaagcaactgtaattcactctgagtctagcagagatcccattgtttactgctataaaataaactctataaaacttataaatatggagacagaatttaacataatgctgcatagggtaccttatatcacagaatactaataaaaacttttatattatagaaatacattttaataatgttgtgcttaagaataattatactttgaatgattttcatgagaggcatctttccctatattcacttcaatattatgactgggttttctcttctaacctatattaggttaataaattacttggattttaaaggctatggtgaattatagacttaactaaaacatggacttctaaactggcttgcatgattccacattggcagaatttaactgccattatgaattacttgttaattatgctatttacagtttatatgcatgcttgagaattttaacatgtttagcatgtttcacttttttctgcataaagactaaaaatatataggtttgtgtgtgctgcactgaatcatattttaaaatagaaaaagtaaagaaattaatgtgcaattttggctattgtttgcatggttgttaaaccataaaagataaacaaagtggagaagaaatgaaagaaaaaaactcatttaagtataactaagttgtcaaaggaatagttacaaggcttataactgagcccgaatgttcagcattgaatcaaaactttggaactggaagagggtttttcatgtatttgttctagtgggtcacaaattcaaatatttacatgggccaggtaaataacataaatgaatgaagtggctcagctatgacaacatggattagtagtggctgtggaaacccagagagtgcatgctctgtctcagagggatcatgctgctcagcttcagctggtttctgccctatgggagcacaggcccaattttgctggacttttcaatactttgagacaagctggaaaccaatacttctatatgcagctttttacttttaaatgctaataactaattcaatttttaaagtgttagtatctgtggaacatatagggtacatgggatgtcagattaaatctctgatgaagcccaacagaaaggaattgtacagaaaagaatatggaaacatatactaagtcacttacgtgctggccacatgtagtagaaagaacatgggatttgaactcaggcagatgcaagttgcaattctaactctgtcacataaccactaggtaatgttaggcaagttttaaaaactctctgagcctcaatttccctctccttaaaatgaagataacaatacctgttgcataggatgcttgtgaagatttataaataaaagtaacgtgtgggaagtgcctatggtagatcttggcacctatgaaacatccactctttttacccttttccaccagtctatgtgcctaccctgttttattatttttttcaatagcaattctatagacttggaattatattatgctccacttcctactagaatgtaagtttacatgatggtaagcaatgtgtctatttcttttcactgctgtattcccaacactaaaaatactgcctgacccataataggtgttcaattaatgtacgttggatagatagattaatgattttaacaaattttagtacactgactccttccctttaatgaataaacacacacaagtacatatacatatatgttatccaagctcataaaccaagttaatgctgtactggaacttgaattcacatcaagttatttcgctatgattattttcattgcactattaaagtctgtcaaaattatgcaatgttctacatggacatactcatctcttgggattatagaaaatacaatctttgaggtatttgaatagctttgcaaaggaagtcttcctcacacttccactgactttggtggttaaaggcacttgcagtgctctgtggattattctaggtttttcattctgacaaaaagactattaactgcctttgtaaatcataacgacaacaattttacatatatctggcatattatacttaaaaatactgtaaaatgaactcataactacaaatgtcagttgaatctcacatcaatcttttggggtagatgggactggaactattttcctcattttaaagagatatcagagacacccagtgataaacaccttacctaaagtcacagtatggataactaaaaaatctggcaataaaccatagttctaaggtgatattttatattcacaggacctattgaagacttcccactatagccaagacttctgtattttacaatctggattttttcttcccctccccacttacataaaaactagcctgtcctgggccctatttctaatcctgctacctcttatacttgtacttggtattaatacaacaaactttactggccagagcccactgagtgatagaaaaataaacaaaccaaggacctgccctcaagagctttctatcatcagtgtaacacaaatatttagtctggctaaaatatatgtcccttgtaagaagtgttatgccttaagggactatatgaggggggaagagagaaagatgctggtgctaatctaatacagtgcttctcaactcggcatacctattagaatcccccgaggagctctggaaaataccaaagcttggatcaatctagggtggagtctgggcagtggactttttgaaagttcccatagggatcctaaggtacagccagtgttgaaccaccaccagtctaaatggaataaattgcactgtagggaaataaccgaggaaagcaaaagacaaatacctaaagacaaacttgaccttcttttcccttgtaatgccatttaattaaacagatcttaataccaattatatttacaagattttcattgaggctgtagctttcctgagacttaatctccaatgattttaagaaaaatattttcctccctcaaatctgacaaccagtgtcatttgatgatgatgtaaatatgatcaattttatactaacttacaaagtttggcaggtgaaaacctaagtgtatacacaagcaaatgaatcaaaactgaaataactgtcttaatttttatgcataattcaagtgaaacttggtttatgtcctgatttctctgcattgcccattttcttactttagtttgtttttatttgggatggcacttgtttacccttctattttcagctacaacctaggtttgggttcatccatctaagttattttggtttgcttatttttacctcttacttacacatatttcttttctttttcttaaaaaacctccatatttttcatacattccaagtttcctagaatagtcatttccaacatactacatcaaacttagatggaaaaatttgtgagctcggtctaataaaaaggaatggcaattccttaaagaacatctgtacagattgaagctaattagagacacagagattttatccaatgatgtaagtgcatatagtcccttcagccttggaaactgactcaaacaataggttttcatatttatgtgtgagatgtgcctctttcaaaccttgttacaactttggcacattacccatctgatgtgaacttagatctttttaacacttttatgtttaacataaaaaacaacgggaatctaggattttgttgggaatggcctgaatgacttccttgaagggtgaaattgaagttaaatatgtgcttatccaatagctatagtaatatttgtatacctttctctaccctctccaacctgtccagtaaatcagtaccatattaattgtgctaaaatgccccttaaatgaccatgctatgctcccacctttcatcatcacacgtctcccatttcttaatgtattgtattcaaaacatttgacttggttttcaaagtactttgatactctggcccgacctaacttattttctattgatttcaaacatcttccatgtcaatcaagctggtctcctgttgtactatataaataccagggtgtttttgttttgttttgttatgttttgtttgttttttgccttcctctgaattgttctcaatgtgcatagatttccttccttttctcactcttactctttaaattcgacctgtcttatgcgttataggatgagttccaattcttttctgaagactctcccaatctagtgctctaactgatctctcctttttctaacatcctaaaatactcaccctccctcgaatgtggcatttgattaaatatagccttgtcactattttagttactttaagtatgtcagccctgtaaagagtctgaggggattgtttatgcctgttctaatatatcctccttgcttctaacttggttctaggcatatggttaaggcataataaatatttgctgactgctaactgatgctggtgttgcctagtagcctgggcctatacacactgtcagttctgtcaacagaggctgcgaaaattctaccagagattatgtctgcacaaaaataagcctctggcataaattgcgatagctgccactagagaattcacctgcaggaaagggacctcaggcatattacctggtgctcccagagactcttatgccaggttttccactgtcaaaatacagctaaaccatgtgctaatgtagtgatgtgagtctctccaataatttactgtaaatttatacttgcttagttttctgacatggctttagcatcctaatttcccataagctatgcctcagaattactatggattacaaatttgtggaaaaattgggcatactctgagagtcaaaaattagcattttaaagaagcactttattttctgtaaaaaccctattttcaaagttaaatattctattttattctgaatgagcaaaataagcctaaggtttcagagaaaaatatattcagaaggtaaaggatttaattccaagatctggaactgtgaatcctttctttgaacacagcctctcttttcttttactcctttccccactttaattgctgtcacctcataccgtaacctctatttcccagactctgccgtactctccaagtctctttatcttgcttcttcttccccgctgccaccccataccccgcacagacatgcacagacacacgcgacaagcatacggcccacccacctccctagccaaatttcaacccatggtcatacaattgacactttaagaatgtatttctttacagtctatattgtcttgctccctagttcttccattctttttacattgacacaaagtaaaaattcaattgaataaacagtagcagttactattattttcatataacactatcagaataccaacttttctgcacggtgcattgccttactgaagtccctgaggacactcatgatgaaagcccttaagctcacaccattcactcctctgaggctctcactatatctttccaactgtgattacacattcattttatgccccctttgtgtaccgaattgatactcatgttgcacctatacatctgacatcttcaacatgtacccaaatcttttatatatgtgcactttttctccctcacttcatcctaaaggacaggtaacttgattccttaagtgttaaaatggtatgcttgcttcttttgtaccttaccatgggaccactgtaagggtcctgcacactgtgggggcttgataaatgttatattgagagtcaaatacatgcctgaaagaatccttttaaagctaaccctcaaatacctataaaatgcccaagggagccccacagaggaataggtgagacagagcacagcagagcttattaaaaacgatctgggcttgcaatacaatttcttttagactggatttttccttaggcttaagacacgtgctaattctctcagctgctttaatcatgtagatattaaacaatgagggggcatcaaacagtcttttagagttatgagaagtgcatgctatgaatagacacgagggaagatgaaagccaagcatgtggcgactggcagtcccagcagcaggtgtcttgactgaggacagaccccaagatctactggaaaatgcaaaatggagaaacccaacgctgtcagagaagaaggcttcaaaactcaatccaaatcaaagagggctgcagacttttatggaggcttttaaaaggaaagtgttaagtttgtctgaattgtaaacagaatccatctgaagatgcattttcccttaaaaagtcatcccaaaacacaaaagcaaaaaaaaaaaaaaatcaacaatcacaacaataacatttcaaaagattctaaaaggagggagggttgacagccaaacctttttttaaagtaatggtagccaggaaagaagacgatgggttgtaagaattcaccacctggaaaagagagttacctggggagtgacagctgccataggaaaagtagaacaaacacacctgctgtcaggcacacctgttcttttcagggagaggaaccatgaggctgaaacagcagaaaacgcccaagaaaagggtaggatgactcttgcaacccttaaatattttcccttactcctctggagttatttcctcggcaggaatggatgcagagtaaccacataagatttcacctaagtctttcaattttcatagtctctcaaattcctcttctagctgatagaaagaaattccttaaaggccccaagagagaagggaggcaaacattttctgtggcctacgctggagaaagaagatacactattatgtgctatattaaaatgtgacttaaaggtgttgaatctgaggtggcatgaagcctactgggactggtaaggtagacagagattgtaaggggagggaggacgccaagcgcacgcacacacacacacacacacacacacacgtacacgcacacacacctgccaaaaggccttacttccccatagtaattgtttcgcctttaactgtggatgctcacttaagaacatgccatcatttctggttccacaaagcggctacctggtcattgatgcttgcaaaagtcgaattctgggcttccacagtagcccagagaatatttaaggccaatgagaataaatcagaccaaaagggcaagatagctctgtagcagattagctatactagctttgtaaacgttcacaatgccctacaggaaagcctgctgccagcagataagccaaactagagttcaatatcagtggcaatattttgtcctgccttgtaaaaaaaatgatctagcaagggatgcaactaattgaggcagtggcaatagtgagatagaaggaattttaaatgtaattcatgcatagtccataaatggactaaaaagtacagtatttttgagtacctactaggaactctatgttaggtattgcaaggaattcaaaagacctctataccaatacaattaaaagtatttgcaatccttaaggaacttaacatttcactggggagacaatctttacaaccagtgcttaagccagtaaatagtcaactgcaaagctgtgaatgtcagacaataaaaactggagttcacagaaggcagtgagcaatatatgtggaagtcagaagttgtgaaggaagactttatcaaagaggcgagacttgagttaggccctgaggatgaataggatttggaaatgctagaaagaatccagaaagaatgtatgaaactaagatgcaaaggaaatatgagattccaaacatgaccttcagcatgagtctcagttactatatttacccttgtgtgtaagaatcagtgtattcttattaatgtggaaatgtaagtccctagggattcaagtgaaataaattaccaccaatttacatggggtttttctaaccttgcacataattcaaacggaaaaataaatttttaaatttttaccttaattaaatttcaggcatctctgcatacttaggtttaagatcacaatcagtactggaataaaaaatcccaagagttgcctctgaaagggttccacagtcaagtcactacacttggtgagttcatattcaaatcaatcataaattctattttaaaataatcccaggagtaatcttaaaaccaaatcctccaactctatagctccaacttttgattattcatgtggttgtagtagagaaaattaacctctgcttttcatgaagccctacttccagatttttatgctggggtagcagtattaaccagtttgtatttcacctttttcagctctccacactgccaagaaggtgttaatgagcagtgaaaaggccaaaaggccagcagccaaaggaagaaaggcacacaaaatacaattgggaaagccctgttccaacaacccaactttgtgagcatttgattcaccagtcaaatagaatatgtccatgagttcaaagagtataaataaatccaaagatttatcaagagtgattagaacagtcttgagtcatttctcaacttacagacaatttttaatgcagtatttcaaagtgcactttaaaaggagggactagaaattatccattgttaattttagaaagacgtttaaagtcctcgttaatgttctacaaatccagaatttgttaaaatttcgacaggctttgttagaaatttactattagtgaaaaatgtgcataaaacaaattaatttcaaaattaaaatttggagaggaaaagcttaagcttcttaaaataagcttttaaaaagcactttaaaggcatacatttacattccaataactggtaatcattcttatctgttcattaaagcaggagtcaaaggatctctatttggccacactttatttacccagtttaaattccattgcattttaggaccatttttgcatattctactctataatttttatagagctatataatattacttgtactattttgcacaatttattttccacctagacattttcacattttatctcatgtttttattacaaagaagaatactttgtaatacacacattatatctttttatgtgcatatacctttatatatgtgtatcaaatgaaatgtgtgcatatttgtgtatacatgtatgtggattacatattttcaatgaaatttgggagcttttgatgcagactgttctatacttggttaattttgtttaacaatataatgtattggagatatatctgtctacatctttctcaatggctgcatagatggaagaatttattttttaaccagtcaccacagatggagatttaaagcatttccattttgtttttgtcagatattactacaagtgtcctccaaacagactgcattacatgacagtgcctgactccatgcattttagaataatgaaaatgcaattcttactaacatattcaaacattcagatgagcttattctcaactggtctaaattagctaggtcctactatacaatactttgcttttggagacactgctgctattgtcatggcatactctgccctctttgctaaagatttcagctcctttatattgtgtatttggcatttcagggacagaagggaaaggaaaatggattatgttctctccttttgtattcttcttgactactgcctgtatggcttgtgaggaactgcatttcttagcgtgttagaaacaacggtggcagaacaggtaggaaaccagtggtgcagcagatcagagtgttagtccggcagaagataggagcagtagaaacaaaagggctataagataaccaaatataattgaattttgagtaatcaactctttcatctttctcccaaaaccccattggtttgcccagtggaagaaaatggagccctataaatggtttaggaataaagagaatgtgactatgaacattcttttgaaagattatattttaaatatctccctgtatgttacacaaagctgtttaattgtataggtatcacttattgaaagatcgtttcacattgttcactgtgaattaagtggaaaataataactgaggagagttgagaacaacaaaatctctctggaaataaaatatcctcttgtaacaggtgggcaatttgaaggattaaattaatgctttggggcaccatttagacagtggattgacagtaaacttacaatatttgaaaacaaaaaagttatagtagaattattgatgatttggacagttcacttctccctgagtccaattccctttctgtaaagctaagtggctatactagatgatttctaacagctctttcatttcgatgattctgatattatggacatatttaataataattgtaataggcataaaatattctgtggccagaaatattaagatgctcacttttgtatttttcttaaatccactattggtacaatttttcctaacacagccttttgctcctctgtgcctggctagattttacttttgaacttaactcagatgtcatatcttccaggaaactttccccgacccttctaaccccttatttgagttagatgttcctcctactgttattatcacactgtgttttaaattatctgcttttttttcagtctccttatttgattataataaactcctttttggcagcaactatgcctttgcattcccagtgcctagcacaatacctgcgacatagcagagacccaacaaatgtttaccaaatcaattaaagcatgacattcaaacactcatgtcaataattttttacagcagaaatatctgaaattgctacatcattggctggtaaatgcaactgcctatttatattcttagatgtctcatgagtatctaaaaatgaaaatatttaaaacagaattcttgatttctaacctgaaacctattcctttctcagttttccggacattagtttcctccaccagaaccctgactgattcctgattcttccctcttcctgtccactcaaatacagccctgaacataaggtcctttaggttatatctcaagaatatatctcaaattagtccacttgcctctagcttcacctcttgcatggacttctgcagtaacttgataactgatttctcttgttcctttttgtattccccatccattatccaaacaactgccaaagtactcttttatatatgtgaaccccactgctgcccctgattaaaaccaatcaatatagtcccattaccttaggagaaagtctaaaatctttggcatagttttcaaagcccttaggtcttgtctccacctgactccccaacttcatcatgtagtacattttctctccctttctgcaacataatcacattggtttccttacagtcattaaaacacaccaaactctttcgtgccttatagtctttggacatgctgtttccccttgcttggaatgctcagtccctggctcttcacatgctccgctcttccttatccttcttatctcagcttaaagattacttccctggacacactaagtagatccctagcctcaccctgttatcttctaagaatacactctgttggtcaccatagcacctcatagcactatttggtatccctaagtagtttatcagctcaatgaagacggggtatatatttgtttcattcaccactgtactcagtgcttagtactttgtctggcacacaatagatgttctctatttcttgatgtaacactaagcaaatgcaaaataaatactaagagtgcaatgacaatgctgtactgttttggtgcaaaatcaagcctggttaatcacagaggtacaatcttgatgaacagatattcagtgcctattcacaattcttaaaaagtagtataactaggccgggcatggtggttcacacctgtaatcccagcactttgggaggccgacgtgggcagatcacctgagatcaggagtttgagaccagcttgaccaacatggtgaaacctcatctctactaaaaatacaaaattaactgggcgtggtggcacatgcttgtaatcccagctacttgggaggctgaggaaggagaattgcttgacccagggaggcggaggttgcagtgaaccacgatcacgccattgcactccagcctgggcaacaagagtgaaactctgcctcaaaaaagaaaaaaaaaaaaaaagtagtgtaactattaagcacttatccacgatctttcagccgtaaataaatactggcaaaaaccactaaagatattcacccatttatttactcatttattcaacaaatgatataataatagaaaatcaataatgactataactatatagagatacactgttatcataaatgaatggattcgattacaaacaacatggaacaatcagctaatttcaattttttgaatagttatatttaagtgcctttaaacttccccaaaggcatatgtttatttctcctgtctagactctatacatagaggatagggtccataaattgtatgtttcctgctccaatagtgcttattgcaatgctcagcaaataaatagatgatgctcatctaagtgcttctccctgtatctgtaccaacatagaccctgagcttttccataacaaaactcatactaagatccaaaagaagatactccctgagaaaggaaagagaaaatacagataagaaaagaaaaccctaataagagctgaaaagtctgtcaatgatgatggacagaaaaacattagaagaagcactactacgcagcatcagatgcatatatttacatttaatttgagggtgataaacttagcaccatacaaacgatgtttgtttatgccttctagtagcttactatccaagatactgattatactgcaaggtacataaataatttaaagggctatttttcatcctgcctcatatagcaactcgatgggctatgtcattgcagtatattatttgttattgaatttcctcattttcatttgctgagctgatttttatcaatattattacagcttctttttatttatagcttctattaatcttgacatcatattgcttgcgttgaagattggtctgaagtgtttctattaaaattattaacatttttcactgaaatttagccaaaatattaaagaaaatacattgtaatataactccatatatgtttatgcaaagagcaacataattcaattcctgatgtaaaccccaacaacccagtctccttaatataataaaacacgaatacaatataaacctataaatgtctggacatgatgccatttctgaaataggatagcaattaggtaatatttggccagagaggaaaagcaagatttttggaaattatcctcctaaagctataaataacctgctaacaatttcaattgaagttcaaattataagggcaaactggccactcaaactgttttccgtgagaaaaaggaatttagaagtgccttcattgtttttctgcctgtgtgatgtcaaatatctgcttcatttaaacagttgaacttccacttggttgtttcaatatcacataaacattgcctaaaaatgatttttacaataagaaagcctgtgatatgtggagacgactactgcaattttaggtttcacaatagccacagtaaatgatttgcctctagcaaatccatctacttacatgccagtagaggaacatggtttaataaatctgaattggctctgaaatgggaattgcataaggatgacaatagtgagaaatatggtaaaatggaagaactatttttgaaatctcttttcttcatgcagaagactactgagagtttctagagttgctgaaaagggtagaaactacatgtgtggatttcttagtgaacataatctctccacagattcctggctaaatagtaaaactgcagcattctggtgagtaattgtatatacatcgatgctcaaatgaaggcactctgtagaagttgtatgcacaataaatcaccatctgtacttggcccttggagtctatttgaatgcccattcagtccaagctggctggctagatatgtcattgattttcttcttcagtgccatccctgggaaaaaagccaatgtttaataatggaaaagatcacaacttaaaaagggaggcggggagatagagtatttttgaaccccaatcagcaagtttttggaaactgggtacactaacaaggtatttatggacttaggttggatacaaataaatatataaaaacaagtattcatctgaataagaaaggacattacaacacctttgactaggaaatcttactccgccaatgatagcctatgcttatacctattggacttcctcatggccataaaacctacttttcaaccttgacaaagaccacaagattgataaccttcttttattttcccaatcagtccctctcctaacttctgctcttttctatggtggtctggaatccaggatcagctgttttaactagtctttcaacagcattacctctgccttctccctcatgtttctacttgacctatcttatcagtcgaacctccaagaagttttaccttggtttccactgtttctgcacctggactgataagaaaattaaaattactgtatttaatatccctttcccaggaacgtggccctcaattcgaatgattactataagaaaaggcacttgatttgactggataaatcctaatagccattccttacagtggcttcaaagtcctatgtgatctagctcctgctaacttctcccacctcatctcacattacccttctcttcactcactaagatccactcacagcggccctctttctgctaattaaatatcccaagcttatgtatcagtcagggcttttgcccttgttcttccctctgtctgaataatattcatccaaatcttcaaatagttggcttattcttgtgatccaggtgtcagctattcagacttccctgaccatcaaggctaaataaagtagaccctactgccagttactctttgttataatcctgttttaattttttaataaaatatatcaatagccaaaatatattgtttattatcaatctctccttactagagtataagctcttaaaagtagggaccatgtctatgtttttcacaactctatccccaacacctaaaacaagatctgaaacattgtcagaacacaaaaaattctcattgaatgatggactcaattgccacagtcatcagttcatgtgtgaacatctgacctaagctttgtcaatcaaagtacattctgcaggtcctacccctggccacaagtgattgatgcaggagtgggcaactgaacaaagcaaggctaatcaaagtccttgcttaggattctaggtcttggacccattaaatacactgcttctatatcagggtggtaagaagagatggtcaagagcctgtatgagccatgtttcacactttgtgtttactaagcctgtgtacatgaaagaaaatgaagtttaaattcaatgcccactagaaaaatataaatactatattgatcatatttgattcattagctccagttatttcctatgtcagtcatatccttgccctttctacagtttgctattctaaactttcttttgttccctgagccaataaattcataccactttttgcttaagctagtttgagttgactttctgtcaattacaaccgagattctaacttatatactaactttccctgcaaccctactaccactttccagatttttttctgtctcattgttcattctgctaatgtttcttactctactcacagccctctctccctgaatcttggcagacgacattgtctcctacttaacatagacagcagatgctacgagacatgacacattccctcaattatccctgctcctctcatgtttcagagaccaaaaattccatctgtattctggatcctttatttaggctttctccaggaccttgctccatcagatactacctctcttttctatcacttaatattttttcttcattagttcattttcccttgactataagtattcattcattcatacttcaaatatttattcattgccactgtgggaggggcaggactaggttaatgtacatgcttatgtttcttttccatccaaaaaaacaaattaatgagacaacaaaaaaattccttcctaaaacctgtgttctcttttagctattgcccctctctccttgaccatcccatcacttctcagccaagcatcttaaaagcctatacttgatgtctccacttccttttctttgcatttatttatcaacccactgaaatctttcttatttctctactactacactaaaaatctcttttttcaaagtcagcaataaactcctaaatgccaaaactggtaaatattgtagtctttacttaacgagacctttttttcatatacgatactgttccctctttctggattatttgttctttcttgtcttctataataccacttgtcttgaatttccattagtccacttctcagcaattttcctgggatccttttcctgtcagtcatttaaatgtttagtgtgctacatgattttgtcaattgcctcttccttttatgttttctactctgtacatgctcttccagtgtgatcacaccagtctcaaatatcagttatgtatcaacaatatccagatccattttctagccccagtactccaagtcttgtatatctaacttcaaattagatatttctatctggagaaactacagccctgtgaagtcacgttcaaaagagaatcattatttttccccctaaaactctgccttcttgcttccctaccttcctttgttgattgctagcaccatcctcctctttaatgacttgccaaagatagaaattgtattagttcattttcaagctgctgataaagacatacccaagactgggtaatttataaggaaaaagaggtttagtggactcacagttccacgtggctggggaggcctcacaatcatggtggaaggcaaaaggcatgtcttacatggcagcaggcaaaagagaatgagagccaagtgaaagggttttcctcttataaaaccaacagatctcttgagacttattcactgccatgagaatagtacgggagaaactgcccccatgattcaattttctctcactgggtccctctcatgacatgtagaaattatgggagctacaattcaagatgagatttgggtggggacacagccaaaccagtttttttcagaaatctttattattttctctctttcattgcttacaaccagttagcccctaagtcttgccaatttaaatttatctcctatgtatgtctcccttttagaaaatttggatatttaatgcctaagttaagctcctaatcatctctttctctagattattgcaacattttcctaactgatcactttcaacctgtctttcacgcttctaatatatccacctcattgcctacagaaacgacaaaagttttgaaatcctccccactggagaggaatgtgcttaaagcacactaaagttcaccttgaagattatgctttcccccccgccccgcagggctcactatgaatagttccaaaatgtacctttgaatttttcacaattattttgataagactacaattaaccaagtaaagtagaagtctattaacagtaacaggaagtcactgaatactggtcatagcattgggcagagaggtaaaaaacagcggagaaaaagaaatggtaatgtaatttagaggagaactaaattcttacctgcctttttgttacaatttgtctattgctagggttcaaacacttcttctgaaccatgtcttcatgtatatcatgctcaatattatattagcatataacttggaagtcatttctgttctttcgtatctcaacacaagcagataaagacatatcgccagttttattatttttatttcaaatagatgtcttgtcactttctaaggtctgttcttcaaatgaggaattataaagaagaatctcagaaacgagcatttcagttttaggagactaaggaggatcagacaggccagtgctgaaaaggaaaccatcacacagagatcttgttgattatcctagcaaatctctcttttcattttacttttcttctttggttcgaagattctctctagaggcagaagggagggctgtacatttcaaattatttttaggtctttgattaactgtgccaccagaccccaggtgactattaatatactagtaaaggcggttaaaagaagacctgaggtcattcagtgagtgaaagaagcaaaattgaaagcatgagttttgacccagtgatatgatctttctagtagaccacatagtagaggcaatccaaaagggggcaaatgggaataagggacactatctgcacaaaaggttagaagacaaagctactcagcatggaattcagaattaaaatgaaagaacttacctagtgaactttcaattcaaccatatctcaataaagctcaatcctattataacacagcacacgattataaggctacaaatgtactgcagagaaaatcctgtgtcttgaaaaataaaagctcagtaaaacaaaagccaaaataaaaaagctatcagttatgcttctcaacatgagttttataaagcggtgctgctgtattaaatttttgtctgtgaccaaaagaaaatttcttgaatagcaaatgctccataaatgcttgtccaattgaattatctaattggctaatgtcaactttttaatatttaaggatcactggggattatacattgattagctaacaagtacttcttatccagagaaaactggaagctcatgccatagcttactaggatttttgcaagaggagacaaacagtcataagattgctgttaattatgtttccacttctcatgaattgtttacttttattatttacctatgtcttgaatggtattgaagcaagccatgtaagtccctttgtcaactgccagaagtataattctctacaattaatcagtaaaaagagaattaagcattgcttctttagaattaggaaaaacctgctgctgataaattgaatgcattaagaaattaacataccagtaaatgattgatcattacaattatctgaatttgcatttctagaatttcactgaaagaactcaaaatcattcttttaagatatttttagctatgtttcccaactggatgaagtataaaagagatatcctgcttattattataatgataagttcaagagtcttttaaacatgttcacaactggacattaaataaattaatccaatatattttaaaataggaactcatacaagggtttagggtttaccagctaattttttttattatctaccctgatgtataaaagaaaaattcatctgtatgtcatgaatcacaaaggcttgtaagccacccaactactaagcatcctgattaaaaagctggagaagagcaggccacttaaataaaaattatttggcagatgcaaacatctctatacaggcagctcataaaaatattactgaggagtaaataaaatagggcaatatcatctaaaatataccattctcactcagagctgaaagtaatagcttttgtttgaggacaaacaacaacaacactaataataagtattgataacaataagcaatattgaaagataattatgtgccagacattattttagtattttgttggtttgctttacttaaataaatatttaccacctggttagtgtgtcctaggcagtgttcaaacactgggactcagcaaagaacaaaatacaaaattccttgctctcacagaacttaatctagtatgaaagacagaaaacaaatgaatacaataaaaatatactaataagtataaatgtatagttatacatatttgaacgtatagtacagtaaatatgtatatagaaatataaataaatatgtaaagcataaagagaaataagcaaaatagtatgtcagatggtgataaatagggtgaccataatgtctcagttttctcagatagtactggtttatatgtgtggtcttagtgtaattactcctagcacaccctttcactctaaaaaatgtcccagtttagacaataaatcatatggtcacctaaatgataagcactatggaaagaaaaaagcaggaaaacaaatgtgttggaggagggttgtaattttcaatagcgtagtcagggaatgcctctctgagaaggtcacatctgggtaagaacctgcatcaggcaagagaccgagccaggtccctatccaggtagatatcaagggaaagaacatttcaggcagagggaatagtgattgcctatatttttcagaatcacaacagaatggttgtaacagaatggttgagaaagagagtagcaggagatggagtcacacatggaaagggaagccacattatgtaggtctgtgtcctcagtgagatggcgagccatgccaggttttgagcagggaagtgataggctttgggctttaagagtatcactctgactattgtattttgagtaaattgtaggggtgtaagagcataaaaggagagaaatcagtcaaaagcctattgcaaaaatcaatatgagaactgatggtggcttggactagggtagtagcaaaagaggtgatgataattagtcagattttggatatattttgaagacagagatgacaaggtttgatggtaaaatggatgaggtcacgaatcatatcaaggtttttgatataaatatgtggacataagagttgccagaatctgagacagaaaaagtcggaggagcagattttgaagggagggtcaggagttctgttttgaatattgtctcagcttggttttcccaaaaagcagacagtgaaagaagggattgtgtgtaggaagtaaattttggaaagtgatccccaaaataagaatggaggatcagtaaaagtgaaataaagaagtgaggcaagtcaaagggtgagtttttgagctggtcacagctgagagcagctgaagcttgatcttacagggcaccctctgaagagcttgtaaaatgcttgggagaattgtctgctcaaatacaaaagagggaggcagtcatgaatgattctttctcttctagatcaagggatgtcccatgatgtgttaaccctctcacacttccaggcttgcacatgcctcagaatggctgagtgggttgctacaggcattccacatacaagtagcagaaaaggcaggaatgagagctatctgatgcagttgaaaaaaacgtgttgttagtgtatatctgcatgcagctagtaggcgcagcaatagctggaataaaaaggtggggtgaaaatgcgaggtgaatcagaggtgtccgatacagatatgttaagtttgagatacgtatcagacatgcaagtggaaataaaaaataaccagctggatatatgaatccgaatttcaagggagaggtcaaagctggtgatgtaagtgttttctgtatataaatgatattaaccgtatgaaagaggatgatctgaccaagggaataagtgtagcaaaggtaagagaagaggtctgaaggctggattctcaggctgtctgatgtttaatagttgggaggatgagaaggatccaataaaagagagttagaagaatggtcagtaggataagaggaggctcagaatatgatatcttgaaaaccaggtaaagaagaaacagtgaatgatcagcggtgtcaaatgctgctgaaaggtcaagatgaaaactaagaattgaccattgaatttagcaccatggagacctcggtgatcttgacaagagctaagtatttcaagaaactctaagaaaaatcattaacctaaatgttgcgtttcctgcaaatagtggtagggaatgaaataagaaagaccacgatgcaaaaatcaaacgctgaaaaatgtctgtaagtctgaagattgacaaaccaccttaatgaggtagaaggaaggagaaaacaatagtcagatggtatgaactttaaaagaagtgaagctgtaaaactgaaaaaaaaaaaaaaactaaaaagaagtcactctgagtagacttagttgtcaaataatccagtgaacaccttggagtaaattggttatcattgagtaaattatttttggctcagttaattcagctagttagttcatagtgttagaaagagagaggtcaataatttgatcttcaccctagacagctcatctggcaaaggaaagaacactgtcccttggccatggcatacacttcggtcttgcacagcaatcttgcaaattatattggcctaatgctaatcatagtggatccctgacattaagtgcagagggctcagggtataccattccctattaactaggaaaaccatgcagatatttctaattgtatgtaaagagcatcagctctcattatagacccatttgaacaccaatgactatattttatgaatgcctttctacatatacattacagtatattgattaagggcatgatacttagtgtccagtagacatatgttcaagtttcaactgggctgtttactataacctccttctccatgcctcaatttcataaattgtaaaatggggattagaaatgtggctaaatattacagggttattttaaaggttaaatgagatcatgcttaacacagtgtctgacacataattaaagatgagctattattgttctttaaaatgggtaagcacgaggatttacttgctgaagtataatggtttacaaggtcccatcctgctgtcgttgttattctagaagcatttttctgtaacagctttcaacttcattttaaacttgggaactcaccagagactgatttttgttttgtttcagctgttcagaagtcacctatgaagttaagcctcttatgtggattaagtcaatggcaatattgatttatactttttatgagctaccaattctagttatcctaacctttcaaggaagaaaaaaaatcccttggaagattagaaactctttcattctcactctgagtagacttagttgtaaaataatccagtaaatgcttagttaggaaggccatctgtatcataaagagcaatatttccatttattcaaactacaacatcaatagaatctgcctcccataatctagcaataaaggacactgtttggactaatttgttcaaaattttaacagttcctgaacttcacaataaaatgatccactagtatgtacagaatttttaataaatatggctatgtaatgatagtaactgaagtaatagttgttggtagtaattggatcataaaacctttcaaatgagtttgtggcatgaaggcaacagagaacgtgatgaagaacactatggggaaagactcatctgctgttgaagattcactaaaactccatttatggggtcaatgccatcaggatgtattagagggagcacaagatctactgctgagctattttgcataaagtttacataatctacagtgtacaaaagccatgatgctttaacaagttgtagtcaagcaagactcttctaaaccaactgattaatgtgcataaaaaagataaatgttaggaattttattttaatcaatactctttcagggtttaaaaattgtattatctgatgttaattgtgtatttttgttgttgttgttgttgttgtttttgagacagagtttcactcttgttgcccaggctgaagtgcagtggcacgatcttggctcactgcaacctccgcctcctggcttcaagcgattctccagcctcagcctcctgagtagctgggattacaggtgtctgccaccatgcccagctaattttttgtatttttaatagagatggtgtttcaccatattggccaggttggtctcgaactcctgacctcaggtgatccactcaccttggcctcctaaaatgctgggattacaggcgtcatttttatcagagacattctctagaagatttgaactgaaaacaattctccagtgtttcatagcagcttaattggaggtattacaactgtagttaccatgataggactaagaattttgttaaacctgtttccactattgctctatttctataccatgaagttacagagcaagggcatgggaacttaagatcctcaacaaagtccgactggctggtgtggagataggattctcccttattcctatgtataaagttccaattcattctgttatttacagtgacacaacttactagatcctaagtatgaagagaaaatctctctctgaaaatggctgaaactggcaatctgtgtgttaaaagcatctgtgaaaggatttgacaatcaggaataattcttgtgtcctggcacttttcagaatgatttatgtatacaatttccattgatcctctgcaccacagcgaggaaacatcctcactttacataagtggaaacaaaacgttgtaaaagttatctcattataagaaaaaaactgttgagcacttactatatgacagggtttataaaagtaaataaggcatagttcctgacctcaataagtttacagtctaggtggagaaacaaacaagccaattacaattcatggtgattagtgctacagtagtaataagtacagactgctgtaggagtatacagcaggagcatccacccaagattgcacggcaccaaggcaggctttccagagcaagtagtttctaggtagagactctaatggagactcacaggctgagaagtacctagccaagtaaaaaattagaggacaatcccattacaaattgatccactttattgttccttcccctagaggggaagaatgggtttggaacagtgtttcagtcagagatgagagctggtgcaaatgtacccaggagtatagccaaatttggatcaataggaataattttatcagatccaaaaacataaaagaaatgaggtgccatgcctttaagattggtaggggtatagctgaatggcatgtaccatgaagtaggtttagtattttattgaggcttgttggtttttaacatagggtagaggagtcttagtgctgtagtaaagaatttggtttgtagagcataggataatgaagagtaggctccaaaggcacccttgatggagaaacagtggcctcaggggaaagccatccttgaggcacattgaaaagtgagaggagccatatgagagggttgcaggggaaagggggcccaaggcttcatttattcaactcaattcattaattcattcaggaaatatttcctaagcacttattctgtgatgatactgtgctaggctattaagtaaaagagcaatttgaacccaaattgctattagttcagtattctttctattataccatcatgaataattaagcaacaaatacatcaaaacaaaaacaatcaactttttaattcaatttactaaatgtttgttaaatacttgacctattacgtgcaaaatattgcactgtatcaaagtatctacttactggttaatggttgttggttatactccatgctctctaagaggaaaggaccagtggaattttagtaaaatgtgcttagtactaaatactgtcaaacactagaaaatggtagaaatttcctgatgccttcaaaatcagtgatcaacaaataggtattgaatacttcttttggaaatagtgattgctgagttgaactctggtgagacttaagtataagtagaatgaaagtttatgtagaattataataatgtaggcagtaaaaaatcaacacactatcacaaaagcttggtgatagggctgaaatagaatcaaattttatgtaatttttagctgggtaggcttagtgtggtcctgcctgaaaggtatgttctctcaaggtccttgacagccttgtgattcagttttaagtgctatgaactttggttccgaacctgagtaataaaaactgcataattgttttccttttatagttcccatgttttaaagctttattttagtaaaagtgcacgtgttttaccaaaagaatgactgtgaaaagtctgtttagtttgttaaaaaggcaactttctcaagacactcttgttgaattcggatgtcatgtaagattataaattctactgtgacagacttcacagtattcttatgaagtcacaattctaacaacataggcttcagactttatattgaaatgtacattttaatcccacagtacataaatacatgcaaataaaagtttcaaatatacattttgaatcatcttattagtacagtgcagccacaattaataaaaaaaaccacagaataaaaagtagccttgtttaattggaatatctacatttccattcaccccagtagttggcattgataaaaatgagacaaatatcaaaaatacaaagccacctccaagcttttaggttctcttcatttctacattgaggccattcttcaatggcttctatatctatagtctagtgcaatgaaagtggaagcagctgaccagaataacatccttctgtgtatacaaacaatgttctaaaccaattccacatccaaatgcaattctacaaaccaaggagtggtataaagaagacacatgtattttagaaagcctttagccaataaattttagactaactcttgttaactgcaaagggttatgaacttggacttcagttgtgtaattattttatctaaacttgatttttatgttatgacaaaacatcatttactaaaactaccacatacttttctatgaaaagttaaaatatatatatatatatatatatatatatatatataacaatcaatgtgacaaatagggaaaattctaatttgagtctctttccaacttaatttaccaaaagaaagtgctgttatacatttaataaattaatttgttcaataaatattcactgaatacatattatgtgccaaatactgttccaagctctaaagtaaattataaaatcatggtggcagaatgatggtacagccagcccgcttgtagcttgtacttttaagttaaattgatcaggtatgttccctggtccattggccagatgctttggtactgccaatcatattgcagattcgaaagaacacactgactaaatatcctggctgtgtgttatggttagaatgcttcagaaatcaggttgattgtcctctatcctagaggtagtctgaaggaaaccaataagaaacataaagcttgccaaccactagcacttgacaagcatacctggggcttagagtatgtgggatgggaagctgcaggagaaaaaggagcataagcatccatgtttgaatgttagttgctgctccatataacatctcttctgttttgcctttccattatcatatactagtacatcttgcttaagaaaatgcaatcaatagaaaaaaattagagaacaaccccattacaaattgattcacttcactgttccttatgtatggggtgtgtgtgtgtgtgtgtgtgtgtgtgtgtgtgtatgtgcatctgattactaaatatatgacattagtatgtatatgtattcatataaaacatacaataaaattctgcatttcttgtgaccatctcatttatcaaaaccacagattacttttttcaagtcagtgaaggtaatttttgaccatatttattgaataatttgagacacattagcattcagcctggttgtatgtcaatgtgataattttttaagtgttcttgaaactttggacttcaaccattaatgagaagacataattggactttagtagtgaagccttataaatatctcagttgaagcttgagaaataaatcttaactcaaacctttaaatttcatgaaaggtttgggtgtgtccttattaattatttttgcctttgagcttatttctaactgctttcttccatgacataaaagacacaaagggtcatttcctctaacagtttgactctggtgtaacaaaactaaatacttcatgtgtcacaagaatgactggcaccaaaatagcactgcatatggctcagtttatactggtgggacagaagaattctcatcttttggtataaatgcttcaaatgagaatattgtcaaggtctcaagggattcaaagtttatcttccgtcacctctagaccctttcagaattataatgagaaaaaagtgttgaaaataaacagaacttatttgtatatggagccagttctgcatcacagatgaccaaaaaaagcagaataacagtttgctgacaggatgatttcctgacaggacatgttggcatacctcatggttatgcctttgcagatatttaaaactgcttttgactgttaatatgaaatattgctacatttcaaaatgccatttctgaatcttcctcaaatccttgtaataaaagagaagcagcatgtaatttggatatagttccaataaatcctatgaactgaaaccctccgaggttccctgtcatctactgaatcaaatccatgtcttttcacttcactctttaggtttagcaactgattccttctatatttcactaactttccttttacatcattcttgaacagtcccgctacttcagccatgttatctattgtgttagccatgatatctattcagattatcttactgacccgtgtctctgcctctttgtgttaattatataataaatgggtcctaaagtattaaaagaaaaaaagacaaagctctttttcccagtcttcacagtcccatgaatatgtatcccctttgatcctgcccagtagctgaagtaatttaaaaggaggaacaaaattatgtaccccaaaaaccagttgctttgtttcccaggggacaatcatctatgtgacacttagccagggagtcagtcttttccttctgatattatgtagatcctcaaaagaaatacacaattccatttggtgaagagttatttaagaagaaaacactagaatcaattctcatactatggtacagtttttaatctagatttaggaagaagcagcaaagggttgaacatagaattgagcaaagtgggctcagagatagaccacagaaatagaatgaatgcgcagaggcaagagctattttcagactgagatcaaaaagtcatgtagcctcagaagcagcaagaccaaagaattttgaaactgacctagcttttcctagctaaagaatgtccacaaagagacgtgatggtcaaaggtaaaattacatttgtgtaatacgtatgtagttagctgtaattgtatattgtttcataaagttaatttaagaatatatatagcaaattatttaaatcaaatttagccctactaggtgactcctaccatttggtaataaattggtatctaggaagtgatggactgtcactgactgtggttacctatactcctagctaactgatgaaggggaaagagggagttttacagaaatgatgaccttcaaaaagatgcctgaaggtgcaacatctacactgcaccactataaacctccctcctccatttatccacttttctggcttctttcccttctccaatactgggttccagacttacctgtacaatatatacattcatactcatcagcaaaatttgtaaaatcatttatatgaagggatgtgttgtataaatgtttatataaggaaatattacctctcttgttagaaacaaaacccagaccatctgtggttttggcactaagtggaaaacttcctagttgatggtgacagtagtaaatcaagatgacataatggcaagggagggtgaaatgtaggggcagagtttactgcttggttgcctcccaccaccatgataattatctttacatcacagggttgcaaataaggactaaataaaaaatatatgcaagctcagttagcagagtacttggcacatagtggtcaacaatatttattgtcattaatgttcccacatctccatctacagttccacctcacctgagctctagataggcatgtgcaattctgttttggcctcgtcaaaaacttacctcactactcatctgaagcctttgacttgattcacactttcagcacataaccctgtctctcatttttcttgggtgagaccatcaagtcataaactactttaacttctcaccactatattttgtaatttacttcctgtcttagaggatgcagtgaacattcccctttcaaagcctttccttccaactgagatccagaaacattctccagttgagccttatggcaataaactcatctacattcacttgcactcacccttcaaatccttgtgagttggcatctttctctaatattattgaatattattgaaactgcttattttaaggcagtggatccctatcttggatgcacattggcatcccccaaggatattttttttaaatgcctgagtcccgcccactggaaattctgatttaattggtctggggaacagtcttggaattgaggtttgtaaaactctccagatgattttaatgtccagtcaaagtggacaatctctagtctaaagtcagcaatgaccttctaaactggctgtgttactgtctattatttgacaatattagttacatcttcctgctgaaaagtctcctcctttggcttatgtgatactcattcctttttgttcttctatgacatatcaagaccacttcattgcttctgcccactattttaaattcagtgcttctgagggtaagataattggctctcattatttctgattgtatgtattttcactggtcatctcttttactcccgtagtttcatagaatagaaccacctatttctatttctaagaaaaattacattgggattttgatagggattacattgaatctattgatcactttgggtaatatggacattttagcaatattacatgtctccaaacacatgcataaacagatacaacacacgcgcacgcacacacacacacacacacacacacacacagacaccatttctttaaaattgatctaaatttacagcagtctatctgtccatagtagttatgacagtgggctctaatttcagactgcctgggttccgatgctagttctatcacttactacctctgtaatattgggcaagttacttagcatctctgtgcttattttattcattgtaaaatgggtataataatgatcccaaccttatagcattgctgggaagattaaataacagaatccatttaaagtgccttacttccggtctgttgttgcataaatgctagatatttctctcataatcaatgtcaccatgccctaggcagaatacacggcatggttctagcttctagacccccatggtactttacatataccactattatcacatcaatcatattgcatcactattgctgattgacatgtaccttcccaactgtactatgaatttattgagggcaaagattgcttcttactcacctataaacttcatagtttaacaaagaactttgtacagataagcaaaccaaagtttagaaataggttttgtcctttttcaactctaattgattgacaatgcttgcgtgaaatgccattttgaaagggatgtgaggctgaagctggtctcaacaggggaaagagcatcatgattaattagggatgtcttccatgggacaaatagagggagcagtggcacaagtgtcatggacattccattccagttttagatgctgtgtaagtaaatacttattgaatgaattttcatgaacaaatgttactagttgaaagacatgagccaattagagttattgttaaataacttggctaatttctcttacagtctaagttctttcagagcagtcattatggattttgtgctagaaacttgtgacatctagaagcatagtatgctcacagcagacaattcattaaatgtgatcaaattctgctgaaattttcatttcataggttttgccacattaatattacacctgccatctgtgatctttgccatgtaaatacagatcctgagattaagagttctttcaaggattttgaaggaactgatatctaaactgtctacatataagcaaacaatcatttaaactactgctaaatgcctgatataagaatagagaaatgcacttctcaaattttgagggcaaagactgcacaggtggcagtgctgcttaagcatttttccctgtgggatgaagtggcttatcatactggggcaaaaagagagaaaatcatagtcactagggtacatttatttcaagattaacttcatttacctagaacagtacctggtacatagtttacattaaataaatgctgatgcataagtgtataaatgaacaaatggacggatggatagatggatggatggatggatggatggttggatggatggatgaatggatgacagataaactttgcttccatgtaatcttggcaaaaaaaaaaaaattggcagtttgggctgggcatggtggctcacacctgtaatcccagcaatttgggagcctgagtcgggcagatcacttgaggtcaggagtttgagaccagtctagccaacatggcgaaacttcgtccctattaaaaatacaaaaattagcaaggtgtggtggcacacgcctgtaatctcagctactcaggagactgaagcaggagaatcgcttgaacctggaaggcggagtttgcagtgagccaagatcatgccaatgcactccagcctgggcgacaaaactccaactcaaaaaaaaaaaaaaaaaaaaaatggcagtttaaatttttttccaccagatggcaataatgtgagatataggtttaggttgtaatcctgaagagaaaaacaaccaaccaaccaaacaaaaatgctattcggagaaaaagaagcgttaaaagaacagatttagatgacagaaatgaaatgtttgtgtcatctgtaataccttaggagtctatgaccttgtgagacttgtatcaggtcctcaacatacctcctttttatgcatggatgacttctcattcataattactttgcagtaaaatggagatattcaaaaactaatcttatctatataaaattattggccaattcacacaactaaaattattacccttggtatatatatctccatgcatttatattttcatttttaatactaatttcttagttaattgatgcctcccttggatgtgaggctgcttgggaaaaatagctagcctgtgtgcctctaggaaatcttcccctgctattcaacctgccaaaagtcatatgaaataagcctgcctagggctcattcatcctgttagcaaagaattgtgaataatattatattagtgtccatcccttaattcaaaagcttttggaaaataagaaattcagttttagagtccagcattccacatatacatggagtagggcactgctgttttggaaaataaagataatatgaacatatcttcagctggtatagagtattttctcttattaatacttctcaaaacaagtcttcaattggataaaacattaacttccctaaaaagtggaaataagcagactcaggaatatttcatggtaaattatagagcatatcatctgcccttttctaatgataatcagaatgaaaaggcgtttaacctccttataaacgcttggtcactggaggctggcaaggttgttgaagaaaatgaagggaaactaacattttttgaattcctgaagatcatcactctcatgatggcattcaatacttatcacaacctcctgacataggtatggaagacagtgtggtatagtgaagaatgggggctttagagccatcgacttgatttctgatcctaactctcacctctcctttagctgtgcaacctctggcaagttatgtctctccaagcctcagttatctcatctgtaaactggggataatagcgcatacctcatcaggtgtttatgaggagcaaatgtaaagcaccttgcagagtgctagaatagaataggtacaattccaaatttatcattattattgtgatgatggtgatgatgatgaagtcaattttgcagaagaaaaagcagattcagagctgaagtatcttgcttaagtttacataactagtaaacttaaaaggcatctagtaccgtacctggtaccatagcaggtgcccaatcaacattttgtttgcattcatccttcctgatctaaaactcaattattttttgagatcttcttcctttaaaataatgagttaggctcaactttaccttggttgatgcaagattcaactactgacatacatttgcaaaaattaaaaacatttttttctgactcacaggtggtaatacatggactaagacaataaagaggattccagatcttacaaaaaaagatgataattaggcccactatttcgcctaacataagataagtcatttctccttcaaaggggtacatattttccctcctaggtgtctctactgattggcagtcagtggcagatgagatactgtttccagacttttagttcccgggtctgtatactttattttatataagtcagtgcactgaaggatggtgctggctaaaaatataaattggttcaaaatgtgtttatgtcagttcatggatgatagattcaggtttttgtccttggcctttttctagtctcaaccttctatacactctccctgggtaatctcatccatcccctggcatctctattctgagacactgatgagctcaaatctacttataacaacagcccagatctgttctgaatcctagacacacttttccaatcgctgatgggaaaagctacctggatgtcataccagcatcttaaacttaacatgtctaaaaagaaactcattttcccttccaaacctgctcctcctgctgtgttccttctcttggtaaattaatcactattctctcagtttcccaaacttaaaactttaaagtcatccttgactctgttatttccttcaacctcaaccagtaatcaattatgaggttctatcaattcgaacacacttatatctcttgagtgtgtctcttcatctccacagacattgtttggacctctaatgcgattcttagctctagcctaattcagtggcctcacagatttttctccctgcatcccattatttccagttgcaatcaatcttctacactgctgcctacacttctacaattcccctgtatacacttcttatcctaaaaattacaattgatcatgaaattctccactaattgaaagctttcttttctgatgcttaaagggaattttaaaaaactcctaaattgggcatgcgcgacttcacaatctggctccaacattccttgctctagccatattgaatgtttcaccattacaggccttcttcagagctgtatactttgcacttgcttatctgctctctaggaatgtccttctggtaaacttttattcaaattttaacttagatcaaatatcacctttctatgtactctgattcctctaaagaagttaattgtttcattctgtgtacttccacagcaccttttttatctgtaaaaccacttcatacatttaattgcaataatgtgttttgagtgtctattttctccactgcactataagtttcctgcaagcagtcatctccatcctcagcattggcttcaaggtctgacacatattaatttgtaaataaaagcttattgaataaaaagaatccgttgaaaggacgttagaatgacatcatagagacaaacttccctcaccccaaattccttttgatgaaactgcacagacaaaatctgaggctggccagctctttatactgactcagcataaaattgcttatgtttttagaactgtcaccagaatgcattcttatttctactcacaatatattaggtcaaccactctacaccctaaacccacaacccataaatcacaattgtaaattcatcttctgtaaagacaaacttacagataagtattttaatgagaactaggcatttcctaaagccaaaaacatttccataggaaataatttcccaattgtcaggcagaagaagagaattattttagaacgaacttacatgatattaactgaaaaaaatgggaaatattaaaatgaattccttgaaaagaaagatataaaacttttaccaattacgttaagggatgaaaatgagtaatatagttaacatcacaaatatttaatgtatatttgttagaatgaatatcttaaattttggctcaatttaaggttgtttttaaaatgtaagattccagtactaattagagtactgtaattttcatttgtaataattgcatttgacatggcaatatttaaagaatagttttcaatgcatgataagcacttatatttcagttgatagcaactaattccttaaatgaaacaattataaagcatatattatatgcaaaattttatggaaaatagagatctgtcatgatccccatctttattgagtatacagtctaggagaatatatataaccataagaagaggttaaaaagaggccgggcatggtggcttatgcctgcaatcccagcactttgggaggccgaggcgggcagatcacatgaggccaggagttcgagaccagcctggccaatatggtgaaaccccatctctactaaaaatacaaaaacattagccaggcatggaggcgcgtacctgaaatcccagctactcgggaggctaaggcacgagaatcacttgagcctacgaggcagaggttgcagtgagccaagatcatgccactgcattccagcctgggcaacagagtaagactctgtcagaaaaaaaaaagtaaaaagaatgtattttcaaagttcacagaggaagatcacctacacagtgaaacagtgatgatgttgggggtgatggtgaggcaaggattcagtgggaaaggatgcttgtaagctaggccttgaaagatggttgaatatgcataaagagagatagcagcaaattgtatcccaagaaagatgtaacagcacagcaaagggattgaaaagagatgaggtgagatcccggtagaccagtaaagaaacaaaaaacagtctaggtgagatataatgagagtaatgatcatgaaaatggaaaggagaaaatggatttgagagatgtagagattaactctgctggatgaggaaactgattagatatagtaagtatgtgtggttgggagaatgggagcatcattaacagatgtaggtgatacaaggaagatgagtgggattaggagtgttaagatgattgcttccactttaaatagactggtttagaggtgtcagtgtattattcatttggaaatgccggggaggttaactgaaaatttaggactagagtttaggaaggaggttaggtctgaagataaatatttgaaggtcactcaaatagatgtgatcattgaagccatctgagtaaaaatatttcggggttcaagcagtaatcttcaatcttgagcaggaatcagaatcccctggggatttgttaaaccacaaatgggtcccacccccagggtttctgactcaatatgtctagagtggggctggagaatttacactctaaaaaaattctcaggttttgctgttgttgctagtcaagtccacacttggaggacatagaaaattaagtctattactttttatctcagcattaacttattcataaaaaagataacttgtgccatccgggcgcggtggctcatgcctataatcccagcattttcggaggctgaggcgggtggatcacgaggtcaggagtttgagaccagcctgaccaacatggtgaaaccccatctccactaaaaatacaaaacgtagctgagtgtggtgaggcgcacctgtaatcccagctactcaggtggctgaggcaggacaatcgcttgaacctgggaggtggaggttgcagtaagccgagattgcgccactgcactccagactgggcaacagagtgagattctgtctcaaaacaagacaaaacaaaacaaaacaaaacaaaacaaaaaaacaaaaaaccttgtgccaatgtcagtatcttctacgtcattaaaatagtgtctaacacagtttatctatcaattggaacaggaaatcgtatttctactagttttttgttagaaactgtcttgtcaatccataattgagaaactaagactgcccaaagaatatgctccaaaatatggctattgtaggaagggttctaaaaaattcttactttcctttcagactcggctacacaatgtttctacattacggtgatagactttctggaaccctgtttggtggtctccactaacctgctagctttgtcagcagccaaatatttatttgagacttctgtcccatataagcaatggcttgaaaagcacttagctgtttacttttcatcttactataaattatttatccttcagtctataaatggctatttgtaggattacacaaattttgaatgctctgataagaggactgcagcatccaaattcatgcataatccataaaaagcacatgtaacctacaacctcagctgggctgacatatgcaatagattctctgagcatatataagcagtgcgaattattaaccagttaacattagcaaatttatttttgaaacaaagtttatgcacacaagcattctctaatgagaaataatatttgttataaagatccaataaaaacataccttgagtagatttttctacttctttcctctttctactctggctattgtaattcatcctcagctcctggttatactcgtgcagggtctccctggagttgtatgactgtcttggttttcttccatcttcactctcatcagaagaactggtgtaagctagatccatttcatgcttgacttttggtagaggctggtagggtttgcagtcagtttgctccatctctgattaagcaagctcagtttcatgaaaaaaaggatgaggaagtcctttaatgcaagcagtcctggaagagaaagggaaaaacacaagccttcttagatttatctttttgtgaggaaatgcatctggcagattcacaattggtcctgataataccatcaaaggagagaagtaaaagacaaactagatgacatgaagctagccggaggcaataataacactctgtgttacatgcatacattgtcaagcattaaggattaagctggaggttgcagcatcagaaaatactcaaggtaaaagagagacagccttcaaaaatatttgtattggaattcaaatagaggacaacgttgttctatggtgtgtgcgtgtttttaatgttaaaatcagtggttagattaaaaaacgttatcagatttgaaagtggtgaggagtacaaagattaaccctgcacattccacatttgaaatgaaaactggtaagagaactacattcagaaagaacacattcttgcttctggtttaatattacatttaagacaggggctctgagtaagggaaggattctgagtgagagagctcatggaataaagtatccttgagggggactgaactctttgtgctcatattgtggcttttgagcctcaggcctgcagagcattcttaatgagttaggtggtggtaaatttttgttcttcatagtactgagaggatgtaaacacttctggtgagtatactggtacagcaacagcaggatctaaatcagttttggaaatagcaattttaaacttcatgataaatcaccgaaagaaccccctttccccatagaatgctgagctaggagccactgaaggtcttagggccagtagaggcattaactgctctacttagcacggagagtttcgagacgatcaagtgtcatctgagatgtcaaagtcctctgtaaatttaaaagccctgtaaaaatgttcttattttcattctttacattattttgtcatcaccatttcagtccactgttgcaactttgcaacttggtcttttcatacaatgtttaaaaatgtagttagaaaccaattaactttatgattttattttgcagtgaaactgactcttttatttttcttcagctcttcaccatatgtattttcaaagaaatctatagacatccaaatggtggctcctctatcatgtacactatctcatattttggaattcttattgcatttatgccaagcacatagaacacagaaatcattcaaaaaaggcttttagcttttcaaagtatgatgtaggctgatttttattgatcaatttgattgattgattgattgattgatttagagacggagtcttgctcagtcgcccaggctggagttcagtggtgcgatctcggctcactgcaagctccgtctcccgggttcacgccattcttctgcctcagcctcccgagtagctaggactacaggcacccgccaccatgcccggctaattttttttgtatttttagtagagacgggatttcaccaagttagccaggatggtctcgatctcctcacctcgtgatccacccgcctcggcctcccaaagtgctgggattacaggcgtgaggcaccacgcccggcctatgtaggctgattttttaaaaaaggcttacacatttgactgatatatgttttaaatggttcttcttttgtggtatgaacagtttcacaagtcaaggtcttcttttcctaatcaaatgtgaaggtcttgaaggcaggatgtgagtcttaatgtctctttatatcccccacaccgctaagtattactttaggcacacacgtagtagaaactatttaactcctgaacctacaaactgtgtatggagacacctagtttggtttgaactaatatgagagatgagcatgcttaaagagaaagcagcagatatgaacatatacatatatatatatatacacacaccaatgattcaacaacaatctaatctcacgccagtatattggcttcatatactgtctacacacccataacttctcagtttatagcttcagcatgggtcttgaccctgagccacaactttgaatatccaactgcctactcaatatctgtacttgggtatctaaaagatacgtcaaacacagtatgttcaaaagtgagctcttaattcccacccctttccaaacctaatccttccataatattctttatattgatattaatagatggccacaaggctcttctgtttgctcaggccaaagaacttgaagtcatttttgactcctgtttttcacatcccacatgcaatccatcagtaaatcctgttggtcttgcctttgaaaggtatccagaatccaaccagatctcttcaatttcccactaccacatcagttcaagccatcatatccctcctggattattgcaattgtttcctaattggtttccttcttacattactgccctccacaccgcagccagaataaaactaagtcatatcacgtctctcctttgctcagaagcatgtaccctactctacctttgctcatgtaccctagctgcactaaccctcttgctgtttgtgaaaacaccaggcatatttgtgcctcacagcctttgcaacctcccataaaaaaataccaaaaactcacgcctgtaatcccagcactttgggaggccgaggcgggcggatcacgaggtcaggagatcgagaccatcctggctaacacggtgaaaccccatctctactaaaaatacaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaccaaaaaatggtacgtctcgtctttcttcttgtctttcaaagaacttattaccaaattacacactatatattttttatttatttgcttatcatctgccatctgtctctgcccactaaaacataagctccatgaagggaggcatttttatctcttctattcattgctatatgattcagaaaaagcatagtaccttgcatatagtagagacttggtcaatacatgttgaatgaataaataaacaactgttgaaaactctcaagaggggctggagagaacgtggaaatgcataagacatagtctcggcccctgaggaactcatagcttaatatacacaataagtaaacaactctactacaaagcagaatgaagtggcttgtatacacaaaagacaaaaacagtaatgtttgagcactaaagatgaagatattggaaaaggattgcacttgattcaactagttgtcaccacaaccattgaaattccattgagcatctataacaccagttttaatctctttcttcttaggtttccataacatgatcttcaggagatgctatggaaacctaagaagaaaggtggacagttgtcttactttgctacaaacagtgcaaattgagaactgtaccaatagcaggcttccagagatgtagttttacagccaaggattagactttcacccagaaaaggaagcatctataaaattcacctaacgtctaaacaggtctttcctttctacaaatgccacagcttccccggtccatcccatatccagccacgtcttttcttttcatggaacgccgatgattcatacagctttaatctagccccgagagctttcttaagctatgtgcacctatttcaactgtaaagtgggcagctttactcgaaggtcccttaggtatggcaagtcagtatttcctccctcccaaaatgtgttcatgttctcaaacttccccatctctgttaatggccacattagtagttcaagtcagaaacctagaacttaccactcctccatccacacaagcatctagctaattgctaggtcgcattgcaatctccagtctctctcttcctttccatcccagttgccactgctttagctcagtccctcatcagttctgcctgaactgtagatgttccttcccccatacccttcctgctccaacccatcctccacactgccactagggtcatcatcacaatgaccaatgtaaagttcttcagtggctgtgagagctgaactataaaagaaatgtattagtggactagatactggaaacaacaagggaaaataaatttgacaagggtagttgcattattaaaaatatacaaagatagtctcaaatttctaagctgctcaagaatattaaatactcaaagtagagtttaggtaaataaaaatggttgctgagtgggataaaacatatatacagaaactttgaaaaacgtgcttagtttttctgttaaagtaaaacaacaccaaaaaattaaatctattaattaaaatacaaaaataaaattaaaaggtaaaaataattcacctaacttcatttcaacgaattcatttcaacttaagctttattaacttaacttcatttcaacttaaacttcagttgattatgaatctctactaatcttaatgccactcaaacctaacgatttaaatttaaaaaagaaaaatgtctcactttgaatgctgaatgttgtgttttggcaaatatgatttatcatgttaaaatcacccttaattttatgcatggaaacctaggcattctcttttccctccataggtttatttgtaacgagagagagagaaagagagagagactttcctatagccatctggaaaccctttcaaatttccaatcataactattcatagccatgaatcagctaggaatgtcatatctattcaaggttattgagtgcccttggaagcactcttccttcaaaccacaaaagtagtataaactaagagaaaataatcctttcctgctcctcgacactcaacgataactttttgtcctaaaatttgtgtcagtggacccaggtgacaaggaaaactttccaggtctctcaaagcatgtgatatggaggtgcacacaattatgtgtgcctagagttgtgaaatcataactgtgatatttgtcaaaggcttgagaaacagagtttgaattcactaataaatagctcatttttttcaaaataaaaaagcagaaaacattaagaaaaagattaatattttaaatccaccaatggttgaaagcataataattctgaaagaatgttgttccaaatactctatggtaaaggataggttcccatgtgcttaattgactttttcagtcagtgcccatcatggcatcctgggggtccactgtcaagtaaatgttatttagacatgatgatgaaactgtcaacttacagaaaaatcaaatatatataaaatgctattcacatccaaataatatcatttctatattattttgataatgataaactctaagacaaagcaaatgtgtatggaaaacacatgctgctatggaacagagtgcaaaacaaagaagtcaattatagtttttactgcagaagatgccttcagatagtccacaaagtatgaattcaaatgtcaacatctgtggcttgctcttgtgctttaaactctctacttgctaacaagacaaactctaagtgactttagaagacagccatggagacttatgttcatttatttagtcactgtaaggttagggagagacaacttagtatgtggaaatcattgaccttcaactgacagaattatcacaataaaagtaacagcagcagcagctgtagcagctaactcataaagcagttatcaggtaccaggtgctatattagtgcttttcctacattaactcatttaattcttgtagcaccctgtgaggtaggtactgttttaaatgcccattttgcagataaagaaaaccaaggaacagagaagttaagtttcttgccaagatcacacatgtagtaaacggcaggactgagatttcaattcctacagtctgtctccaatggcccgactcttaaccactcgtctacactgctcttcagaacatgtggcagaatgatcttaggaaaatcacctcccctttctcagggcattctttttctaaatgtaaactaaggagattggattatctcaaagaactcttccaactctaaaattctacaattgtttatgaaatgtgaagggaagtttagattgatttgcaaaaaataaaatgatgagtataaagaccatgtttacattagttatcattccttctcctcttccctttcttcctttgtcctcctctccctatccctagccttctcacacatactccaatctactgtagcatagctgaactaaaatattgttttgaatccatggacctgagtatatatctatgcactggggataacctttcctccactatccttttattttctttccgtttctcattcttaatcacatacactgccccctcaaaatgggaacctgtttcctggtttaccctcagaaaatacagtctggtcctactcacagcagatgcttatagtttggaacttcctccaaatagtctcactccacctcagaaaaataaattaaagggtacatagaacattgcctaaggataccaggccttcatagcacaacagatagaggaaatgaggccacacagtgcctgaggaatagctggcaaaggaggatagtactctttggaattattacaataatttttccttaataaggacttattacattaatgcagattgactgattcagaaaacactgtatttaggaagctcttaaaagaaaggtgaaattctgactgattctcctcttaactttctttgtttttctaagaaagcacttaagaagtgaactgctgtgggtgtgagaaaataaaagctataaaagtacaaacaacaggtgctggagaggatgtggagaaataggaacgcttttacactgttggtgggactgtaaactagttcaaccattgtggaagacagtgtggtgattcctcaaggatctagcactagaaataccatttgacccagccatcccattactgggtatgtacccaaaggattataaatcatgctgctataaagacacatgcacacgtatgttcatggcggcactattcacaatagcaaagacttggaaccaacccaaatgtccaacaatgatacactggattaagaaaatgtggcacatatataccatggaatactatgcagccataaaaaaggatgagttcatgtcctttgtagggacatggatgaagctggaaaccatcattctcagcaaactatcacaaggacagaaaaccaaacaccgcatgttctcactcataggtgggaattgaacaatgagtacacttggacacaggaaggggaacatcacacactggggcctgttgtggggtggggggaggggggagggatagcattaggagatatacctaatgtaaatgacgggttaatgggtgcagcacaccaacatggcacatgtatacatatgcaacaaacctgcacgttgtgcacatgtaccctacaacttaaagtataataataataaaaaaaagtacataatcacctaatctcccccataatcctaccagcctgtaagagtgactactgtcattctggtccatttcccttcagtcataatatgcacacaaatttcttcatgttgcttccttcgcgctagatgattttttgcatgcttctacacaatatctgtaacaatcatttttagtggctgggtagagtgaaggcacagtaatttacatatgcattccccaattgttggctatttacactcctccctcaccatttacaagtattataactgaagccatataaagataccatgaacatcttcaatttttttattattatttccttacagtaaattccaagaagttgaattaatgagccaaaagctttgaacatttttgtggatttaggggattgtaatgatttacactgccattagcaatgtgtgggaacactctcttctttcattgtacccttgtcaactttgagtattatttttaatgtctatttaaaataagtaaattaattgtgcttttagtttgaatttccttattagtgaggctgaatactttttctgtacgagtttgctagttatatttccttgcttattaactgtctatttatggggcttttgcacatttacctattgagaacctgagttttaaaaaaattaaatcgggctaggcgtggtggctaacgcctgtaatcccagcactttgagaggcctaggcgggcagatcacgaggtcaggagtatgagaacagcctggccaacatggtgaaaccccgtctctactaaaaatacacaaagtagccaggtgtcttggtgggctcctgtaatcccagctattcgggatgctgaggcaggagaattgcttgaacctgggaggcataggttgcagtgagacaagatcgtgccactgcacttcagcctaggtgacagagcaagactccatctcgaaaaaaaaaaaaattaaatcatattgatgccataaaacaagtatattaaccctttatgcatagtatttgttgaaactatctttcacagtctgtttgccattttcatttttgttctttttgttgatgaatgttactctaaaaggaaaacatggtcaccaactggacataaacaagttgctttagaaaaatatgacaaaactttgtaaaaccaagagtttttccaaaaacaatttgttagtctaattattcagtggctgcttgattgacttcatttagttagtcagaaaatgaattatagtttgattgaattctaacactgaaaaagaacacatcagtttgtgtgtgatgacagcttacataagcatataaagcttaaaggactagtctgattttatcatggaattggtcagttcttttggtttcacgtggaaacagccataacattttagtatataaaaagagaagtaaatcaccactttttaggagatgggctgagaattttatgtactgaatatgggacttcttctccagaaaatgatggctttcaaagtagactgcttgcatggtacatagacattctattatgtcaaagagataacactcaagagttgaactgaaattatttactgctatcttagtttgttttgtgccatcttagtttgttttgtgttgatataacagaatacctgagacgggctaatttataaagaaaagagatttatttcttacagttctggacactggaaagtccaggtcaaggggacacaactagttagagctttcttgctgtgtcaattcatgatagaaggtaggaaagcaagaaagccatcttgagttaatttttgtataaggtgtaaggaaggggtccagtttcagttttctgcctatggctagccagttttcccaataccatttattaaatagggaatcgtttccccactgcttgtttttgtcaggtttgtcaaagatcagatggttgtagatgtgtagcattatttctgaggtctctgttctgttccattggtctatatatttgttttggtaccagtaccatgctgttttggatactgtagccttgtagtatagtttgaagtcaggtagcatgatacctccagttttgtctttttgcttaggattgtcttggctatacgggatcttttttggttccataagaaatttaaagtagtttttttctaattctgtgaagaaagtcaatggtagcttgatggggatagcactgaatctctaaattactttgggcggtatggccatttccatgacattgattcttcgtatccatgagcatggaatgtttttccatttgtttgtgtcctctcttatttccttgagcagtggtttgtaattctccttgaagaggtccttcacatcccttgtaagttgtattcctaggtattttattctctttgtagcaattgtgaatgggagatctctcatgatttggctctctattattggcatataggaatgcttgtgatttttgcacattgattttgtatcctgagacgttgctgaagttgcttatcataaaaaaggatgagttcatgtcctttgcagggacatgga

SEQ ID NO: 535 - DNA, 20969 bp, Homo sapiens
acaggtgcccacgaccatgcccagctaatttttttgtatttttagtagagacggggtttcaccttgttgggcttcaaacaactggtctcgaactccagacctcataagccacctgccttggcctcccaaagtgctgggattacaggcatgagccaccacatccggctgggagtgtggtcttaactgtgctcattgatgccacagcaatatttttcatccttaatccccctagcctcagtcagcccctgcctcagagtaataaaaagattacaaatggtgagtttccaaaaagccactgactacttttgtttcacagcccatttctttccatcttggtcttctctccaagacacccacaccttttgcttgttaattctgccccgctccaccaccttggatgtgatttttttgaaaaataccatgctaaaatttctttttcccaagagggggaaataattttagaatttgataaactaaactgtcctcactcaacagactcccccaattctgtcatttgttatgtcattccctgttcagaaaacaaaaataatgtcactcatttagtgctgaatcaaatacctgtctctttaaaggcaaaatcattcactgatattttcaaaattcatagtgtacctcttattaaaatccagattaacctattaaaacccttgcttaatattaaacagccactaaaccagatggcactgcaaggtattaaacttattataaaagaatataaaaaacagtctcattattctctgtaccagtctttggagtaccctgatcctacctactaaaagaccaaacaaccatgggaggaggtttgttcaggaactctctctgagttataaaccatagtattattacaaagcacccagtggttccaaatccccatactgtattaaatccaatacccattgatagcagattcttcaccatcactgatctgtgtattacattattcattattccaggggatcaagccaaccaatatcttcttgccttcacctgggaaggccaacagttcacctggacattaatgcctcaggggtttactgaaagtttttcctattttctcaaatgttaaaggcagacttagaggatgtaatttttctccaaggctcttgtttactacaatatgtagatgacttccttctttgctgtccttcacaggcagcctgtgaaaaagacagtgtatacctattaaagcaagtggctgcttaaggtcataatgcctgtaaagaaaaactgcagtgagtaaaaactcaggtgaaataataaagccatttaatttcagagaatgaattacatttagaaccagaacagattcaaggcattttacaatttcctcagcccaaaagaaatgccaactttgtgagtgggtttcttggactcactggctacttttgaaactgaattcccaacttttcttttctggcccaactcctatgtgctttacataaatttaccaaacctgaccccattacttggacaaaatcataagggtaagtttttaaaaagctaaaggagaaattgataaattctccagttctaggtaattctaatcataaactcttttttttttctctttgtctgtgaaaaggaagaaaatacttcagggatcttaacccaaaagcatggaggtccacaccatcctccaggatactacagttgacaactggatcccatctcctgtggattccctctctgcctaagagcagtccccgctgcatccttgttagtcaaggcgactgaggagatagtcatgggattcctccctgactgtgttttttcctcatgccatggaagccgttttacacactcatcacacttggcatttttctgctagcggactaacctcctatgaacctcttctacttactattcatcatattattcaatcatgctgcaataaccttaaccctgtggctctctggacctctccatcagatgaaacaccacatggctgcttaactctgacagaccagcttttaattccttgggagcaattcctgtggacaatgctgagttgtcctggtttacagatggctcacatttaaagaatgagtctggcaagtattgtgcaggctgtgcagtcgtgacttcctttgagattgtgaaagcagctcatttactattaactacttcagcccagcaggcagatctgtttgccctcgcttgagcctgactccttgctacaggaaagacaatgtttatgtaagcagcaggtaagtgatatggcttggctctgtgtccccacccaaatctcatcttgaattgtagttccataattcccatgtgttgtgggagggacccagtggtagataatttgaatcatggggagcagtttcccccataccgttctcatggtagtgagtaagtctcatgagatctgtcgttttatcaggggtttctacttttgcgtcttcctcattttctcttgccaccaccatgtaagaagtgcctttcacctcccactatgattctgaggcctccccagtcatggggaactgtaagtgtaattaaacttctttttcttccgagtcttgggtatatgtttatcagctgcatgaaaatggactaatacagtacattggtactggaagtggggcactgctgaaaagatacccgaaaatgtggaagcgactttagaactgggtaacaggcagaagttagaacagtttggagggctcagaagaagacaggaaaatgtgggaaagtttggaactccctagagacttgttgaatggctttgacaaatgtattgttaatgatatggacaatgaaatccaggctgaggtggtctcagatggagatgagtaactttttgggaactggagcaaagttgactcttgttatgttttagcaaagagactggcagcattttgcctctgccctagagatccgtggagctttgaatttgagagagatgatttagggtacctggcagaagaaatttgtaagcagcaaagcactcaagaggtgactggggtgcttctaaaggcattcagttttaaaaaggaagcagagcataaaagtttggaaaaatttgcagccggacaatgtcataggatagaaaatcttattttctgaggagaaattcaagctggctgcagatacttgcataaataatgaggagctgaatgttaatctccaagacaatgggggaagtgtctccagggcatgtcagagacctttgtggcagcctctgtcataacagacctggaggtctaggagggaaaaatggttttgtgggcagggcccagggtccccatgctgtgtgcagtatagagacttggtgccctgtgtcccagccactcccactgtagctgaaaggggccaacatagagctcaggccatggcttcagatggtgcaagcttcaagccttggcagcttccatgtggtgttgagcctgtgggtgcacagaagtcaagaattgaggttgggaacctctgcctagatttcagatgtatggaaatgcatggatgcccaggcagaagtttgctgcaggggtggggctctcatggagaacctttgctagggcagggtgcaagggaaatgtggggttggaacccccacacagagtccctactggggcactgtggttgaatggctttgacattggcctagtggagctgtgagaagagggccactgttctccagaccccagaattgtagagccacccacagctttcaccaggtgcctggaaaagccatggacactcaatgccagcccatgaatgcagcggggagggaggctgtaccctgcaaagccacaggggtggagctgcccaagactatgggaacccacctcttgcatcagcatgacctggatgtgagacctggagtcaaaggagatcatcttgcagctttaagatttgactgccctgcttgatttcagacttgcatggggcctgtagcccctttgttttggccaatttcccccatttggaatggctatatctacccaatacctgtacccccattgtatctaggaagtaactagcttgcttttgattttacaggctcataggaggaagggacttgccttgtctcagatgacactttggacttttgggttaatgctgaaaagagttaaactttgggggactgtagggaagacatgattggttttgaaatgtgaggacatgagatttggaggggccaggggtggaatgatatggtttggctctgtgtccccacccaaatctcaacttgaattgtatctccaataattcccatgtgttgtgagagggacccagtgggaaataatttgaatcacgggggcagttcccccatactgttctcatggtagtgaataagtctcatgagatctaatggttttataagggttttctgttttttcatcttcctcgtcttctcttgctgctgccatataagaaatgccttttacctcccactgtgattctgaggccccctcagccatgtggaattgtaagtccaattaagcctctttttcttcccagtctcaggagtgtctttaccagcagcatgaaaatgaactaatacagtaagcctttggagttgttcataattttggtatggtttggaagtaaagaggttcctcacttccaatggagacaaaataaagaatgacccttatgcgtaagaattattagatgctatacagttacctgatgccctaaccatgatcaaagtctctggccattcaaaattagacactgtggaatctagagaaaatcactttgcggataatgcagcaaagaatgctgtccttaaaagatcctattgatcaaatttctatcatggcccagctagaaaattccccccaaataattctgaaacaattactaaagaagcacagaattgggcatctgaggccaaaaaaataagctggagaatagtggatgctgattcactggtaaagatatacttgggtttgggccaaataaacaaacctgtcctgctagactccatgaaatttccattgtttactactgtacataacttaagccactgggctacataaaatacaattacttctataaaacaatactggtcaggtaccatcaataaagcagccaaaaatacttattttaccctgccctacattccctaaatccaatcctgggaacgcagggtgcataaccctgaacattttaacctccctaatgggcctttcaaagttggattttatcgagctccctcctttgcatggatacaaatgtgtgttagtcttgatctgtatgttctccccctggattgaagcattcccctgaagatgagccaccacattaacagtagttaaagtccttttagaaaagataattcataccagggccatctctcttgagctcccagcaactgaggaattaattttacaggacaagttataatacaaatgtgggccatctggccaatcttacagcactttaattgtgcttatcatctccagccctctggactagttgaaatgcaccaatagtactcttaagacccaactggcaaattttgtagaaaccttatacttgccgtggccaaaagccctgcctatagtgcttcagagctaaaaggtctccctttggaatacataagatctcacaatttgtagttattactgggtaccccatgcatttggccccaacttcaaagacccaaagttcataaaaggtgaaatgcttcaatattataaaggtataatcaaggctatggataaaaagtatgctctggtagaacaatctttccacagtgcattcccaggagatgaagacctaaaacaccataatctgcaatcaggagattttgtctatttgaaaagacatttaaaaaaagactccctctgacctcattgagaggcccatttccagtcctgttaaccaacctttgtgctgccaaccttaaaggaattgattcttggatatatgtatcttatctaaggaaaacatcagctcctgagtggatctgcactcctgtcaacgaattaatactaaaaatttctaagaactgaacttagtttataaaactaaaaatttctaagatttgaagcaggtggcatctgtttctcccaagatgtttggatgacttctatataccctttccttatttctaattcttactttatcttatccatttcttttccctggaagacgatattcctgtccacatttcccagtctgttggtacaggggaaaacttactgattgttggatctgtcataaaaaatcctgacctgttaatgactctagttttcttttagtacaatctgtaacaaatttagtacaatctgtaacaaacatctcagctccaaccctctgtacaaagtgtatcatgggaccatcctataaggttaagctttctcattcaccttctattcctgtctcctgtctcatctactcaaaacaatgatctcctagtagggccctagagacgtgcaatggatcatctctctaaaagtattccttgggtctctttaccatatgtaagaaaacttgttgggactgattttaagaggaagggccattagcagtttatagtaatataactgacccctggtttaatcctgccagacacagaaaatttacagatggaagaattctttgttttcctattggatatatttacttttgtgggtgggatatgtcaatatgggcctccagatatttagacacttggacaacaggaggctaatgtgtgttgggatgttttgtttctctgttgtcaatgcataatagatctgaaactggtcacgggactgtcattggactagtcccgtcttactatatcaaagggttaaacatgagttaccaggtgggcatgggactctggattgcttcctttgtcagatcttttgtataatggtatgatatagccactaatgaagaaatggtaaaagatttatttgctaccctaggaattcttgcagacttcactgcaagtatacaatagcattcattggcttctcttgccagggtagtgttgacagaattgctcttgattatctattagccgagcaagatggtatctgtgcgattgctaatactgcatgttgtacccaggttaactcctccaggtaagttgaaactcagttacataaactaaaagaacaagtctatctggctacaagtctcacccatttctctggggtcattttatctatttagttggttgcctttgttcatggctcaaaagcatcatgcaaactggactcgtcatattatggctatttttgctctgtattttcctttttaaactgtatacttgttgtctgttaaatctttgcagaaatacaactcctgacaaaataatgttggcccagcaatttgagatgatagtcaatgcctatggaacagacaaaattaaatttaatgatgaaatccagatgagataagcctaagagcttctccttctggcctccttcttgctcaaatgtggctaaaagggtcttgagactgacttccagctgtttatcacttccgcctgatgtgggatgagatcaactaactacaacaggtctatcccagcaccaaaggacaattcaaacctggctacaggctagttgatcaatgatatttttagagaaaaatcattatcaaaagagggaaatgtgaaagttgcaggtatcaggatgaaataacttttgtcacacccagacaaaatagggctgggaaggcatgaaggagagggggctcatgcttacgtgtctgagataagaactatttccaagaagtttctaagagctccagaagacatctctttgtatctttcactcatctgctttgtacagcttgcaggtttcacacatatacatatgcttctatggcaaggtttatcactagacattcttcaggactgcagtaattcagataacatgctctcaaatggtcatttgcacagtaacagcatctctaccaatgaactgatgacaactttagctttgagcctctggagccagtggactccgtgtctaagcagctgacacgaacctcttccttcttgccaatgagagcttccctttaccctgccctcaccagatgcactggtggcttgtcattttgtgcaccctgggttataattttcatttctcattcctgaataaactcaacatatttggacatttctctaattttttttttcctaggtgaatacttggcaggacaacaggcagacaaggagcagcctgggctacaccctcctccatccagcttggcagggaaggttggggcagggcctcgctaggagataggggctagagggcgaggccaggggcagggttaggcatggggacagcaccacggtggggtcttcctggctcactgtccactaccaggtactgggatccccagttattttattgcctcaccatgaaaagaagtgaaagcattccctaaacataatttcatcattgtctttatctctctcccgccacatttcttcttttctattgctctttctctcacaaaagcaggggatatatatgaaacttgctaagtggttctattgaagcttcttccattaagcttgagataaggagaaaaacaaccctctccctgttaggaggatttggggttcactatgcagctttctctgaaagaaaactttacaagacactctcttacctccagctctcagctctttttagatccacattagattgagaggctcaagtgttacgatattgattattattattatttcctatcaatatcttcattttgtgtgtcacaattcactttaatatctgttgtctcccaggtcttggtgcctcagttgaaacttccaatttaacatcctgacacacactactccctcttcctgtgatcatcagaacaagataaaaccttgtgtgtctggatagttctcatctgttaagattcaggtaaagaaacgccttctttgggaagttgtttatatcctcttccatcagactgagctaattattcctcttcaaacccacacagtgttccatgtaaactattatagtctttgctacactgagtcactctggaatcagatgccaagattcaagtcttcctttcacgaactatatgatcttggggtattcttccccttttagagcctgagttttttaaacttaccttttggagtttttgtcagaattaagttagatgattttaaggtatattaagttcttagatcagtccctgagagaactgaggtgacatttattttgtcactgaacatctgtatgtgtttggggagaaaggaagtgtgggctatattctggaaggacaagacagcagtgtgttaattattatgtaaggagtgagaaatgtcatatgtttttcttaaaatttctgaaagggcttcagcttcctggatatctggtgcctgggcgaaagaggagccatatcttcacaaaagtggaaaattcctaagaaatagaggtgtgaagggccagacacattttataacaaatttaaaatctgggaaaggtcagccctgatggcttccttttcataccagccaaagtgacataacatgctcagaatattttccaattccattacccaagaaaagagcaaacaaagtcctatacaacatatcctattttactattccctcaaacagatgcaataataatatcaggaaagcatttcagagtgacagctgtggaagaaagacaagtgagctatattttcaataatttgtatttctgtattattgaggaaaaatattacatgggatgttttaaaagaaaggtaaatatcagttagaataatggtttttttttactcaataatttttttttcttttttcttttttttgacagagtcttgctctgtcacccaggctggagtgcagtggcacgatcttggctcactgcaacctccgcctcctgggttcaagtgattcttctgcctcagtctcccgagtagctgggactataggcatgcaccaccatgcccggctaatttttttgtatttttagtagagactgggtttcgccatgttggccaggctggtctcgaactcctgatctcaggtgatccgtctgcctcagcctcccaaagtgttgagattacaggcatgagccactgcgcctgacctactcaagagttttcttagggctcccttaatgtctttatttctcagactgtaaatgaatgggttcaacatgggagtgactgctgtgtatatcactgaagcaattatgttcttgtcattggtgttgctggatgggggaagaaaatagagaccaataattgtccgataatagatagtcaccactgagaggtgggatccacaagtggacaaggctttgcatatgcccttggtagagggaatctggaggatggtgaccccaatgtgaccataagaaaccaggatgcacaggaatggaagcataatggctgtcaatgctgctgtaaagattgctaactgattgagggaggtgtctgagcaggacaacttgagcagggcaccaaggtcacagaagtagtgagggatgatgtggtcagcacagaaggaaagctgggccaggaggagggtatgcaaaagagcacacgcacaagcgatgacccaggacccagccaccagcatgacacactggctctgagtcatgatggtggcataatgtagaggatgacagatggccacatacctgtcatatgccattgaagtgataaggaaactgtctaagtcagcaaaaaatatgaaaaaatatgtctgtgaaatgcatcccttgtaaaagacggctaggtgctgagtctgcatgttcatcagcatcttagggacagtgacagatgaaaaggagatgtcagtgagggccaagtggctaaggaagaagtacatgggggtgtgaaggtgagagtctagctggatgagcagcatgatgagcaggttccccagcaccgtggtcaggtacatgcccaggaacagggcgaagaacacggcctgctgctctggccggatggggaggcccaggaggaggaactcggacacgctgctctggttctcagggctcatgtttatatcagctggagggcactagggaaatttgaaggaaaaaaatggtatgtcttggaataagaaatgataactgtggcatagtataatagagatgttcttttgacttagagaatgtcttcatattttcttacatttgccacatattttgctgcaaatgtgctgaaaaagaaatgaaggtttagtcgatatagctactttctttctgaatctggtctctgtaaatgatagtactaaaagttgtttgctaaatgttttttaatacactgttccaatagctgatgtattgtaagtgattcaatagccttcaatatatgagctgggtggtactgttattatttctactctttagatgtgaaagctaaggcagacagtcttatagtcacagcaataggaagaggagaagctgggatttggaccgaagtatcttgactccatagtttcttctgtggaaacaaagcaattatttgacattggaaatctcattgccttattttgtgtgcaatgacctatttaattctgtataccctgcttgtctacacagtgcatgattatttctaatttattcattgtttatagacccctaatctttttttaagacataacactttatttattaaaaaactcttccatgtaaacaattactccaaaagacaacaaaacaagttattttgagtgatttttcaaaggacatacccacatattttatcatgatatatatgtactattctagaaggtggggagggtggtactgttgaaagtccaggtaaataaatcataatacgaagtaagcaacaagatagaaaatctttcttatggtttcagatccatacataattgctctgatctttttttgtttgtttgtttgtttgagacagagtctcgctctgttgccaaggctggagtgcagtggtgagatctcggcacactgtaacctccgcctcctgggttcaagcgattcttccagctaattttttatttttagtagagacggagtttcaccatgttggtcaggctggtctcgaactcctgacctcatgatccacccgcctcagcctcccagagtgctggggttacaggtgtgagccactgcacccagcctaattgctctgatctttttaaagtttaagataagtgtaagatatttaattctatgtttgaatatcaatgtgtagcgcgaaaacatatatatattcctccaggctcaaccacacatgtgacaatgtctcttggggacgcagcggtgaattcctctcacagtatgtctaaggagcattggctcagtgagatttcacattcagtggatttcagccatctcatcaatttctccatgctactgaaatctcattgttccactcagaatttgtcttttccccaggatggctttcaaagcattttactgactgtgtcaagccagagtaagtaaaatgctgatgagtttggatttcctcctccagtctctcggcctttgtgttttattgttttgtatctcatttctatatgacatcagatgctgtattagaaattcctgcttgatcttgaaatatatcaaaggtactgactgatgaggcattaaacacaacttaaattcagtctttaatcactaccacttttaaaacatttaatagtgtaattacgaaaaattcataaagacttggaaacttcacatcataataaattcagatattagcgaggctgtcagatgctgttactctattctaaataccagtaccagaaggacgagacaatttctcaacatatttggaaataatacttcaggttaagatatgagctggatgtcttattttggtctattctttttcatgtttccatgttcctttctctttttcttgaaagattagacctagaatctatcataaccaactaatgcatactctatataaatttgttgatcaaataaaatgttagagctatttaaatttatcataacagctttattaaaaaacttttactgggcttagttcaagaaccagctttgctctaacaatcctggggccccatgttatttagttgccacatggcctcacattcaaagaaatacaatctaaaagctaaaagtaattttaacaggaattctgttctttcagcatctctgaaatagcttataagcgatttatttttcaactcacatcaatatttatcaaagtactcttttttttaataaaaagagagggcagggattcactataacatatcacagcttgttacaaataataaatatttgcaagtgattaaaacaaataaatatttgcaaggataaaccaataaaataatgaagaaaaatatagagcttagaaatagacatgtttataatgaggaccatgagattgacaaaagtgcattataaatcagtgataaagtagtaaaaaggaagaactgttcattaagtggtgctgaggaagttggctatcaataaaggaaaaataatactatatccctacctcacatcattagaaaactttatagattatgtttatggccttaggttaaaacatatttctttctaacttgtattttatgttcaagggtataagtgcaggtttgttacgtaggtaaacttgtgtcatgggggtttgttgtacagattatttcatcacccaggtatttcttttttttttttggctgttgaatccttttgaaggatctaaaaacaaattttattagaaagaaaatgtatttgcttcttttttttattattatactttaagttctagggtacatgtgcacaacatgcaggtttgttacatatgtatacatcatcacccaggtattaagcttagtacccattcgttatttttcctgatctctccctcctcccaccatccaccctctattttttattttattttattttttattttttgttgagatggagtcttgctctgtcaccaggctggagtgcagtggcacaatcccggctcactgcaacctctgcctcccgggttcaagtgattctcctgcctcagcctcccgagtagctgggattacaggtgtgcaccactacgcccagctaatttttgtactttttaatagagacggggtttcaccatgttggccaggatggtcttgatctcttgaccttgtgatctgcccgcctcggcctcccaaaatgctgggattacaggcgtgagccactgcgcccggccccatccaccctctaaaaggccctagtgtgagttattcccctctatgtgtccatgtgttctcatcatttagctcccacttacaagtgagaacatgcagtatttggttttcttttcctgtgttagtttgctaagcataatggactttggcttcatccatgtccctgcaaaggacatgatctcattcgtttttcatggtaaagcgcatttcttaatcaagatccccaaagcacacaggataaatgaatcttcctttaagtttgataacattaaaatgaagtttcattacgacagcaaccaccaacaccacaaagccacagatgggagaatatatactgccacaaatcaacaaaacactagtattccggacacatagagaactcctataaatcaataaagaaaagacaaaagctcaataaggaaaagacaagctcaattaaaatatggcaaaaaatacaaactagaaactcacagaaaatgaagtccgaatggccaataaacatattaagcatgtgaggggtccactttcaaagtgataaagtaaataaaagttaaaacaatggtaagatagcactgatgaaattttaaaaatatacatgaagacaccatgaattggcaagtatacgaagaaaaggaactctgatacattgctataagatggttaaattgggaaggatagtctcttcaataaatggtgatggaaaaactggatatgcacatgcagaacaatgaagctagacccctatcctttatcatatataaaaataaactgtaagaggattaaggacttaaatataagatccaaaacagtaaaactattagaagaaaacataggggaaatgcttcatgacattaatttagacaaggatttttttgacaagagctcaaaagcacaggtaacaaaagcaaaaatagacaaataagattatatcaaactaaaaagcttctgcacaggaaaagaaacaaccaactgagtgaaaagacaacctacagaatgaaagaaaatattttcgaactgtgtgtctgacaaggggttaatatccagaatatataaggaactgaaacaacccaatagcaaaaacaaacaaacaaaaacaataaattttaaaatgtgcaaaatacctgaatacgtatttctcaaaagaagacatacaaatggccaataggtatatggaaaaccacttatataactaattattaaggaaatgcaaattaaaacctccatgagctgtgacctcaccccaaatagaatggttattatcaaaaagacaaaaaaataccaaatactggcctggatgtggaaaaaggggaagacttatacatggttggtgggaatataaattatatagtcattttgtaaaacactatggagatttctcaaaaaattaaatagaactaccatatgatccagcaatctcactactgagtatatattcaaaggaaatacagtcagtaacttggagagatatctgcatgtttattgcagcactattcacaatagccaagatgtagaatcaacataaatgtccatcagtggataaatggataaagaaaatgtatatatacacaatggaatactattaagccataaaaaggaatataatcctgtcagtgtggcaacatggatgaacctggaggacattacgttaagtgaaataagttctggcacagaaaaacaactactgcatgatctcactcatatgtggaatctaaataagttgatctcaaaaaagcagagagtagaatagtggttaccagagcctgggagggtgagcaggatgagagatgggaagaaattggtcaacagctacaaagttacagttagataagagaaataagttgtcatgctctattgtacagtagggtaaatattgttaacaacattgtatatttcaaaagagctagaagagaggattttgaatgttttcttcactaagaaatgataaatgaatgaggtgatggatatacaacttattatacaatgtatatatgtatcaaaacatcacactgtaccccataagtatatacaattattgtgtcaattaagcataaataaaaaggttcatcgatttaaatcgttcatctatttgaacagtttaaattggcttatctgttaaatatttctcataaaattgaagatttacttctcttgatgtatttctccatagatgctgtaaaaaattgctcacaattctccagaaggaaaaaggccacattattatttagagctttgtaataatgaagaactgaaacaattaattgttcaatagccaataactagataaacagaagttaatttatttatgtaattctatcctgcaataaaaaaggaataaactgtatgccatatgtgtctacatagatagatatttaaaaattaatttagggttaacatgcaaactatgctcgtgtaatatatcaattaaaacgtggaacaacactatatattatttatgggcacatatatgcagtaaaagcacaaaaacaagtataaaaagtatttaaaaaggtattaaaaatttctttgtagtggttaaccctagaaaaggagaaagcaaaggggatatgtgggatgcacctttggctgtgctgataacattctgtgttgtttgttttaaaggtcagaaacaaatgtgacaacatgtcgatgtttgttaaatctgaatgataagtacattaggtcatatgttttacttctctttatttttgaactaagtaattaaggtatttctctaaataaaaaataaatgcttctaaggtcacattctctaaaaaatgttattagttgaaaagggtgaggtagagtgtagagaattaggtttgttcattagcagaaaggtcagacaggaaaaatttgtctcaggtaaacccaatttataataagagttattagtttggtgaatgcactgtatatatcagtaatatatatatcttaaaaagcatggcttcatgaagtaatcaatattaggagcccattgtgccttcctctgtttttctccatcaatttccaaggttctcttatttctatgttttcccaccagcagttacaataatttttactatttttgggggttttttgtttgtttttttgagacaaagtctcgctctgtcgccaggctggagtgcggtggtgcgatctcggctcactgcaacctccacctcctgggttcaagagattctcctgcctcagcctcccaagtagctgggacaataggcacgcaccaccatgccgagctaatttttgtatttttagtagagacggagtttcaccatgttggccaggatggtctcgatctcttgaccttgtgacctgcctgcctcggcctcccaaagtgctgggattgcaggtgtgagccactgcgcctggcgaataatttttactattaaatttaatggaactactttggccagtctacacagccaatgggcagattatcctattggcctatggtaaagaacaaatctcctcttaggccaggtagtcaaatctaaagaggttcttaacataaagacactattatgaagcacagaatccatgctctgaaaattctctcccatttaaagaaggggcaaaaatttctgctgttcattcctacttagtcatgagctatccaacaagagaaaaagaaaaaaaaagtaggacaagaagacagagtgtaggactaggtgcgttggctcacacctgtaatcctaacactttgggaggctgaggagagtggattgcttgagctcagtagtttgagaccagcctggacaacatggtgagaccctgtgtctaccaaaaatacaaaaaattagccaggaatggtggtatgcgcctgtggtcccagctactcaggaggctgaggtgggagggtcgcttgagctcgggaggtcgaggctgtgagttgagattctgccactgcactccagcctgggtgacagagtgagaccatgtttcaaaaacacaaaaaacagtgtgcagaagccccaccatcactttctcaactggattcaaaaggcaaccatgtcctaccagtcctggttcctcttccccaccgagtgacaggaagagtgtaaacatgagccaacttaatctagtaggtgaaaattcatgccaaatggtaactttcagtaactacagcaaagtagacaactggctccatgtaatattgaattagaatttcagcagaattagaatatttatgaatgctttactattaatcccagaaacacgtgaaagctagtttgttacttagtcttagaggctaaaggctttccgcacagactccagcactttggacccaaacttgacccccacatcttcatagattgtagaaaatgagtgatagaaccatgtctctaagtttctcaccattcttcagattatctgggttagttttgttttctaagtgaacatgtagtgtgatgtgattttcagaacaacattgagcctttcctgtccctacccaagacatcaccctcaatagcttgctgatatctgaaattcttttagcaagagaaaaagggctttaagtttccaactagagattaggtttcaagttaagttttcctgggagagagagccctatggccaacactctaactcagatagaatggctgagagcaatttatttggggatccaggtttggatggcagaacaaatgcactggctttctcagacaaagtgaggagacaaggttggagattacaggcagaatgaaagcagaggctgcagacactgagaacaaatttactatctttccagtttggctgcaatgactgctgtaaggctgggctgtagaaatagttgaattgttaagaaatctgatgtagtgcttaatttgtaccaggtgattttcaaataatattcacctgttcccacataagtttttttttttttttttgaggtggagtctctgtcactcaggctggagtgcagtgcagtggaaccatctcgactcactgcaacctctgcctcccgggttcaagcaattctcctgtctcagcctcccgagtagctgggattacaggtgcccactagcatgccaggccaatttttgtatttttagttgagagggggtttcaccatattgccaggctggccttgaactcctgacatcaagtgatccacccaccttggcctcccaaagtgctgggattacaggcatgaaccgctgtgcccagccaatgtaggcattctgatcctcactttggagaggagaacactgggattcagtgatgaaacttgcccagtattatagcactagtatattgtgagcctgggaattgatagcaggtccatctggcttcaaagactatattcttcccactctattaaaagcccttattaaatatatcttcaaataggacaatatttgctgcctgagagcactcaagaatttcatgaagtaaattggagagtttaaggatgaataaaaatctatagtttcaagatttgtgccatgatggtgatgtcagtaatactgataataaaaattagaatagcaatcattcattaatcacatatttattgtgtgaataataatataggccagctgctgtgatgcaatttatatcatatcagcctaacaggatcacaaaatggcattattctcatctaaccaattggaaagtagggtttacagagtataaataatttgcctaaaattctacatcatgaaaatgatggggaggtcattcaatcctgtgtttgtctgatttcaaactcatgctgctaatcatcatgtcgtattgcctccagcagagcattgatggaaaagacatctggatatgcacctgtcattaaagaggtggaatctgtaatttcttaaaagcctttgcatagatgtattgcttcagtctttaatcagatgatcagaagagaatagagaaaccaggaaatcagttactggatttacgaaggcagcttcccagaaagtaaatttctcggggtcccaggaaaaaaacaaataagaccctggccagtgttgttgttgatacctatattccatcagtaagggaaaggttaaggcaactatggtacacattattgaaaagaatatgtagtcaataaaataaattcattaaaagcttatgatataatttttaaaggacataataggaaattgcatgtaggtatgtttataactatttataaaaatgcagattattattattttttaaaccttgaagaatgtgctcatagctgggatgcaggccagatattcagcaaaactgtgagagaacattttcctaaagaggaaagtacaaacaccagagaataataataatgatgtccaccctaaattatttgatgtaatacaaaaattatataaaccacctggcacatgtgtactcatctgcaagattttggaggagatgattaacacacacacacacacacacacacacacacacaaactgcttaatggagtctgtaagcattggtcttacctagttcagtgataaattcaaatattgtcagctccttggtatgaaccaatcattcattttctctccaaaagtcttagagctggaacagtgagaaaagtcatgagctcaaccctgaagtggagaagaggcacattctttgtttttcaccagccacaaggctacagcaagagtatctccctttacctgcctggatgggaacccaggggactggtgccagaagtctgtggtgagacacagttaggggctaattactgtatttcccttaatattcccagttgaaatgtgcctttgccggacaccaaggacagtcaactcctatgggaatataaataagaacttttattatgtacagattttttttatttataaagaactttcacatctataagattttttaagc

SEQ ID NO: 536 - DNA, 263164 bp, Homo sapiens
tctaggtcatcaaatttgtggacatagaattgttcagagtattctgtcattatccttttaatgttcatgggatctgcaatgtgtgttccctctttcacttctgctattagtaacttgtgtcctctcacttattttcttagttaagctggctacagacttaacaattttattgatgtttttcaaagtaccagcttttggtttcattgattttctttattgattttctattttgaatttcattgagttatgctctaattttttattaattttgtatctgcttgctttggatttaatttgctcttctttttctagtttactaaggtagaaccttagataactgattttagatctttcttcttttctaggatataccttcagtgttataaatttcactctaaacattgttctcacagcacccacgaattttgataagttgtgttttatttttgtttagtccaaaatattttaaaatttcactcgagatttcttctttgacctatgtggcacatgaggtgtgttattcaatctccacattttgagattttccagttatctttttgttactaatttctagtttaatttcactgtggcctgagagcagatattgtataatttcttttaaatttgttaatgtgccgggcgtggtggctcacacctgtaataccagcactttgggaggccgagacgggtggatcacgaggtcaggagttcgagaccagcctgtccaatatggtgaaaccccatctctactaaaaaatacaaaacttagcccggcatggtggtgcacgcctgtagtcccggcgaatcgggcggttgaggcaggagaatggcttgaacctgggaggcagaggttgcagtgagccgagattgcgccactgcactccagcctctcaaaataaaaacaaaaatagtaaataaataaataatttgttaatgtgaattttgtgtcccagaatgtggtctatcctggtgaatatttcatgtgagcttgagaagaatgggtattctactgttgttggaggaagtggtttatagatgtctgttacatccagttgattgatggtgctgttgagttcaactctgtcgttactgattttctgcttgatgggtctgttcgtttctgatagacgggtattgcggtcaccaactttaatcatgcattcatccatttttttctttgaagttctgtcaatttttacctcatgtattttgacgtctgtcattaggtgtgtacgcgttaaggattattatgtctttttggagaattgactcctttatcgttatgtaatgccctttgttgtccctggtagcttctcttgctctgaagtctgctctgcctttcttctttacttttatttttttactcttaattgtaagatacctgttgaaaagtgcacataccataaacgttcatcttgatgaattttcaccaagtgaacacacctctgtaggcagaacgcagttcaagaagcagaatataacctggatcccaaagccgcctcgtgtcctctcttaacaaaacccctcctccatgggtagctattctctgcagtctaacatcatcaagtagtgttgtctggtttttatttttctttgttttcttttttcggacagagctcactctgttgcccaggctggagtgcagtggcatgatcttggatcactgcaacctccacctcctagattcaagcgattctcctggctcagtctcccaagtaaattactacaggcacacagcatcatgcctggctaatttttgtgtgtgtatatttttagtagagacaggctttcaccatgttgaccaggctggtcttgaacttcggacctcaagagatctgtccaccttggcctcccagagtgctgggtttataggcatgagccaccatgcctggccctggtactgaaccttctgtaaatggaataagatagaacacagtcttctttaacagaatattgtgatacctacccaggtttttgtctggttaatttcactgttgtatggtatttcattttgtgaatgtagctcaatttaatgcctgctcaaattcttaggttaaaaatttcaaaaacattttattgtctgataactatctttgatttggatgagttattctgcgtgtaacacctctggacattggcatgcatagcttgtgtgtctgctcagcaaattcctctgtgtccttccaagctctgctcagcagggcggtggtgtatttttgcatctgttttgtgtactgctggattgccagtgcctggtgcatagcaggtactcaacaaatataggtcacgtgcaggcaccagtgaaaggccatttcctggagcttccctgagcttcccagcctggccagtggcttcatacactactacctctccatgctgtgatggtgttggacacggcttaccccctcaccatgcagactgggccaagccatcccgtgcctgacagcacacaggacagggcctggcatggagtcagtgtttggtgcatgtttgttgagcaaatgtctgctttgtaagccggggttgctggtagagattttggtgggttggggaggccagagggatgagctggagctggtattatggaaagaatgtaggagcccttttctgtcctgttggtaacccttgttagataccctgtctgagcctcaacttcattgtttgtaagaaagaggatgattattccaacctcacaagattataaatcaatgcatgtgaggtccttggtaagctctaggctctataaaagtgctgtcagcattaatcttgttacctcctcctcttcctttcatacttcctcctcctttatcatcatcatcaagtcagtgacttttcgggggacccaacaaaagcatgaggttcctgcctgtgtgagttggggtatatatgatgcaataacagcctgagctctggagctgaggacatgggatccagtcctggctttgcaggtttgtgacctggggcaagtacttaagaactttgcctctcattttcctcattggctaaatgggaaaatcacagttctacctgatttgggtagtttcagccttagccatggcaatcattgtaaagtttttagaacaatggctggcacatggtaagagctaagtgttaagtaaatgaaaaccctactatcagaggcctatgccagcaggatgtttggtccctttataagagatcaggagggagacaggtgcaaggtctttctctgctgttagcgtttcatcctcctgtgtgttgctgcagggtcacaggctggctgctgctgttccaggccccacaggcactccagagcaggaagcaggaatgcagtcaggactgcaaactgcacctgcaatggtgacaaatgctttttctgtaagtggctctctctgtctatcagcaatctttcccagaggccccagaagcctgttcctctcctttcattagctagagtcggagcatgcagtatctgtcactgtgtggggggacccaggatggaggaaaagtcacctggaggtctatagctttgtgctgacaacatacaagatgggtcagtggcccatgacacaagagtgcaggggccagtggggctgctttctgccttccctgtcgaaagcctccctgccccgggttgtgtttctctgctctgggttctgtcttctatctctgctgcctcatagataggcccctctcccagtcacctggatgtgctgggggcacggaaggagaatatcaaagggcaggtggtctctctcaaggaactttttgttctgctaatggtgaaagcgtattgagggcttctgtgtgctgtgtcaaatgcccacaccctgtaaggtaggttatcttcttctcacttacacacggaggctcagcggggccacacagtcagaaaatgttgggacctgatcttgtgcctgggtctgtggctcctgccctagacagcttgagtggacttgaccccaaggagggctaggcatatctccaggaagccatgggatgcccacaccacattttttcagggcgactctagctaccagtgcctttcagggcagaggccatgaatggtgaaatcagggatttggttctggaagagctgggtgtgttgtttttaaaaagccttggttggcattgcattgagcaccactctgggtagtctctggtcacagctctaggtagagagtccctcagggatgtggtcaaaggtgcaggaagtgaagttcaaggctacgtcgtcaagccaggtccaaggaccattcccacccgccactacttcaggtgttgtttttccaggtgaccagcagagggcgcggctgcccacctgacgaacctggcctgtgtcagagtggtggttttgccttcatctttccttgggtcctggaactcccacactggtgttttgccttcttgtttctctttagatggttccctatgagtttagcctgagatcgtggcttgagcagttcttcttaagcatttgaagtttgctgaatgagttatttttacattaagcatgaagaagagttccctggagccccagagaagaaactagattgtcctgggggactgaggcagcagagggagcatgagcccctcagtcccacaaagcccggagccagcttggccgtggggaggctgagccttcactcctggagcagggcagttgcctggctaggctccgccgtgcacattcattcatttattcatcaatggatatgtatgtactgggagactacgacctcccaggcacattcttgggtgaacaaacacaacaaaaatccccgtgcctgtgaagccgacattgccaccatccaggtccttggcccatcagctccccagggaacttcaaggctcccagggccttaggagagcagttggtagcataagaagacggcggaattgagctaaccgtctaagtgcccgcaagaagtagcctcaggccagtggttggtttcagtttacaaccccattgtgatgggcagcagactcttccacatcaccccaaaggctgcttgtcaaacggggctcctcctctttgctgcctcctccctccctgatctgatcctccccacccaggagatagcatcacacccaccctgttgtcagtatcagatttgctggtaacctcaattctacccccctcataaatagttaactagaaaacaaaacaaaacaaaacaaaacaaaccctggaggtatccttgacttctctctctagtcccccgtagctcatccatcacaaacctgtgggagccaccttcagagaacaccgagtccagcctgctgggtgcctctgcctattcctgctgggccaggctgctgctaccactcaccaggatgatttccagcctcctggtccatcctgctgcttcctcccttgccccacatgtcccttctctgacagcagccagaaggatgctctggagacccaccactgcctcagtggctttccaccatccttggaacaaaatcaggctcttcctgaggtccatgagatgttgcatggtctgggtcatcccctctttgtggctgcagatccttgctctggcctctttgcagggacttcagggctccatgctgctcccacctcatggtcttcgctcaggctgttccctctgcccggggcgcccttcctcccttgcatgtccagttggcttccatttgcccttgcacttccagagcatcacttcttcaaaccaggctccctctctgctccagatgaggcatgctgcactctgtactcattgaaattaattgatcctttgattcatattagtcaatcttgtcttctgtgctagacctcaagctccacaaagccaatgtgcaatcatgtctcattcatggtggtattcctggcaaagtgactgtttgggcacagaatagattcttaggaaatattggatggttggatgcatccattggtctgtacctgctttaagaatgagaccaacttgggaggtgtgtgggggtggaattggtcttggggtaccattcctcaccactccctaatgagcaggggtgcctcatacatgcgctgtgtgttggaggggttctgccatccctgagccacctttgcagtgatgtgctccctggctgcccctgggcagaggaaactgcctttgcctttgcggttttgtgagttttgaaagggacttgggcaatttggactgactctgtcccatctttgtggttcttcagggagcagtgttgggttatcggggctgccctgagtcaggaaatggctttgggttttcggatcaaggagatcaaggggcagaaggggggtccttcgatgagcttctatctgatctagaatctgggtggagacagggagggtttcagtgttgattatgcccaccagggcaagaggcagaacccaatcctccaaattcaaagctcagcctagtgcctctacatgctttttttttttttttaaagctttattgaaagaatttacatatcattaagttcacgcatttaaagtataaaattcagtggtttttagtatatttacagagttatgaaaccatcaccataatctaattttagaacattaagaacatttctagaactcaaaaaagaaacggtacccattagcagtcagcccctctcttctcccactccccatcctcggcgtccacagatctgctttctgattggatggacattgcatataactgggttcatgtggcacgtggccttctgccactggcttcttttacttgcataatgttttccaggttcatctgcatgtgattgtggcacatgtcagtacgtccctccttttcatggctgcatattatcctacagttaggatggaccacattttatttacccatttatcagtccatggacatttaggttgttcgtaattttttggccattatgaagctttgttcattccaatagggtttctgcaatggccttccaaatccaccccttgccagggatcttgttcaggagggacaattggtgactttcacaaaaacctgttgtgggccctcaaggctggaaaccctcctccaaacaggtgcctttcacacaccttggggaccagatcctcacagggctcaagccagtcatggtctggagatgaccgactttgaagtccaaagtctctccggcaggcaatttacccggagaccttattatcttctattggtcagtagaggtgggattgctaactttttttaaatttaaaactatttttagtatggaacatctcaaagccaaagaataatataaggaaaagctccagctctacctacctttaacaaaccacagtgctttgctaaaatatatacttctaagaaataaaacttggttgcatctcatcttctgcttccccactccatgtgggctcctgagctcaaatgccaagtcttatccttttatatgtttttaaccctcatccatacacagtttggtggagtaggtgaatgggtgctgctgtgtagaccatctgaagggactagggataatttttggtggtgcacggacaaggcaggaacattggcttagatagaaagttccttccattctttgtccttatggtaacattaaggaggatgtctctattcggtgcctgcctggctgaactcctctctcacccttgggccctttttaaccacacaggagacagctcaggccaagagtggactcaggtattgagttagtgccgtggtcccccccaccaatgccagccagcgaggctgtgctccatcagtcctattgaaggcttcctttaacatgcatgtcggcccggtgtggaggtgcacactgtactcccaagtactaggaaggctgaggtgggatgattgtttgagcccaggagtttgaggctgtagtgcactatgattgcccccgtgaatagccactgcactccagcctggaaaacagagcaaaactctttcaaaaaaaaaaaaaaaagagagagagagagaaaagaaaaaatatgtttaagtgcaaagagttgatttaaagacaaatcttaagggatggaaggataggttttaaatagggaaggctaaaaatcatagggatggttggcaaatgacagacagctggagacctctggtgtgatctttctcctcccccccacctatagccagtctctgggctctatcccttcctgcccatccccaccatttctgcacctgccgtggctgggtcagctgcaggcttccttccaatggaactgaactgtctcaggtgttcactcacccagactcggaaggggcccaaggcatggttgggggcaaggattcagaaaccttcccatggggccagtactcagtgtgtcaggacagcccctggggacttggagtgggaggtgttgaagacccacttggagagaccctgggccaagagcattggctgtggcccagctcttccacgtgctggcttgtaacctgggcaagagtgctcacctcttgaagttgccttcatctcaaaagtggagaccacagtagctctcacctaccagggcagttgtaggaaggaatgaggtccccatgcaaaatgctcagtccaaggctggcaggccacttcaccatccagccagcacatttttatgtggataaaacgtatctattcctagcagtttcccaccagtttcctctttgtttcctgatcttaattgccaactgtaattaaatgattatttgggcatcttattagtgtgttggtgaccattctcggcttcaccctccccctttcccggaagactcaaggagttggggcgtctctgtgtttgtgcactgctaggtccctaatgcctggtgtggtgcctggcacacactcgactctgcacacagtctgaatgaatgaatgagtcctttctttagaggtgactgatgctgctgaaataactgctgctaagagcccaaagctctgtgtggagtgaacatccactttattccccctccccaccaccaccccgctcagttctgtccttggcgcttaaccgggatttcgtccacactgccagcgctcacactgcactcccaggccctgctgtaggtgctaatctgatgggggcagccttagggagggctctgtccccagcaggaggacccttggtgagcgactctccccgcttgcccccaccccttccagcacctgcaaagggggcttagagcggggctgccccatggggttgagaaattgaaatgggggtgtcctcccccaggtgtctctgtggtccttgaatcctggtgtctgttgaaatgcctcctcctctgggcaccttccaggaccaggccaggtgacaccaccattccacccccgtctctacccctttcctggactttcttccttccctgccctggctggggaagcagcggctgcctgcctgtgttcaccccacaccaccgctggggttgtgagaatcgctccttagcaccctggaggacacctctgtgagtggcagccctggggggtgtcgcctcccttgcctggcccctcaggttcctaagggcgtctgaggaaaagcctcattggaaagcgcccgtgccctcctccctctcccccgcccccccgccccccggcagggaggagggttcggagcgagggttcggagggtccggggtgccctagcaggcccaggccaggtggttgcggggaggaagcctcaggtcgctcccctccggtgccggggtgggcgcgtcgggacccactggcctcccagtcccaggagaggaaggaccagggaaaccagctgtctgcagctgctggggaaattaggggctctcagggttccctttcctccgggaggggaggaaacgggactaggaagctttcctgtttctagagcacggcttggtggggtgggcggctcctaacccggggtccagcccctcctcccccaccccggcgcgcggtccaggtatgtgcgacccctcccagtggccacgcgccttctcacgcccctctcccgtgacgtcatgctcctctcgcgcggcatgatgggagaatcctaatgttttccaacagatgctccaagaacagctttcagattaaagcaattgcaagagcaaagattcttccttttcccttttttcctgggggggtggggggtggggtggggggagggagcgcccccagacattccaggacatcaccccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccaggtaacgggctgggcgggggcggcgggcgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcctcggagccctttgtccataaaagagctgatttcctgggtagagccgggcgctgcagcttcccctcctctccggctggtgagctctgccgtcccctcgaaggaggcttcctttcctcgggtgctgaccggctgggggaagagaggcagacccgtggccgcctccgcccagcgccggttctgggccattccctccctccccactgccgggccccagctccggacgtccccgcttgggcatctgctcctggaaggcagcgctccgcagctgaggccaccgcgctgagggcttccaccaggcgcctgactccagcggggcctggcgcacctgggcgcgctagcccccggacaggtgtgctgggcagagccgccggcagggagacgaagggcgtgcgccaggacagagcccggtttcgtgacagcgtgtggactccgtccactcttccacccccatggcagcgttgattgtttaggtgataaaccggtcacaaaggcgtctatagggcttgattgattactttccagagaggaagaaaggcctaataaagcggggggggaggtgggggggggggtgggctgtgtgcgcctgtcaccatggagacgcaggaagcaaagtgatcattaaaacctctctccaccagaaggcaattttcacttcacagggagaagtctgggcttctgaaatgtagggttcaaaaaaagaatcaaagctggtgttttggtatcaagccacaggactcagttttgtatcttagagaagcacaattccttcgtagattctgttttgataacaagttgcttcgcctgcctttgaagacttattctctctaaatgcaacgaccccagatggggacttgatgatgttaaatggtgggcatcagaatccctggggcccgggtgaaggctggctttgtggggagggattcctgcactggaacacaccagagcttcccgataaactgcctagaggactcattacaggcagctgtgtgggcactggatccctcccccccccatttgaaaatttaaacaataaacccgggcaagtattggaagatttctttgttaagactattgacactgtgtcacttggtcaaactaaggtaccggcctgaataaatctctgacttttctttatctgggagggcaggttaatttccttagagtttcaagcagaggctgccatggccgacccttaaggttttaattaatccttttactaggaatgggggattcagccttcagcactccatgatggattgcctttctctgggttggagaggcgcatccacaactgttccaatcatggaagttgagtggcttctcatgagaatccttctaagctccctttgtctccctggcagtaagaggaagcaaacttgaaatggaaattatggaggacttggctttttggctgtatgtgagtttatgcctctgtgggtgggagcggagggttgggcaggtggtgccggtccatgagagaaggaggaggaagggctgggatgcctgtgattaagttatgcgtgggagggcacaggcttgagctctcctctggtgcaactggtctaaatgggacccagagaacaggtgtcagaggtgaaaagtctaaaatatgtgcaattctgtgagcagtagaaccttactaaaaagcaccaagcaattaagtatttatggattgtgtgaagcagattgtgtttctgttctggcagaaagagaatcagaatcatcaagttggagggaacttgggaacttgatggaggaagggcgggctcagggagtattttctgtaagcaccttgcctggctggcctggtgtgtgcctgcatacttcttttgatggtggactcagttcttcctgatgtagtgcatacttgtctttgggcagatctgtttaagaattctttttccaatggttccaaagggtctggtacccatcagtcctgatgggatcttctcctgctgggtgttactcagggctttcagagagcctggggttttaggtattgaaacaacctcagtcacttcttggaaagtctaggcccttcacctgctcttcctagatagcctcccttatttgtccacctgctgctctaatgtgagactcctgaaaattgaacctgaagctccagctgtggaataacctcacacagagttaagaagcagagctgtctcctcccatctaaattctataatttaatgaaagagtccaaggttgcgttcaccctttcccctgcaaaggcatttttaatgcatcagtatttgcaaagactcaaagcattcttcaaaaggtgagctatgttttgacacctctttctcccattttccagaggttacccctgctgggaattgaggggcatcctttggacttttcctaatgttttatatacttgtgttgcttggaaaatggcatatgggaatgtgctggactcatggctcttccatgagtggttctgctccacactgggtctcggagatcttgcctcattgcaatatccatctccctttcccttttaacacccacacaggatgccaagaaacaatttttcagtttagccattggatatttgtattgtttccagtttttacccactacagacaacacagctgtaattacctgggcacaaactgccttgtactcacctgagaatttcctctagggtgggtgtgtgccagctcttgggatgttgaggccacaggggacccacatattttattttaatgatattgcactctcctagaaaatgtacgaattcacactttccgtaatctatgagagtgccctttctccaaacccttgccaacacctgagatcatcaatctatttttctctagcatgaagggtgacaaatggtttcttgttgtgttaatttgcagttccctgattgctagtgagcatgagtgtctttttgtggccttattagttcattaaatctcccatggccgggtctgtggccatggactgtgtggcggggatgaaatatttcccctaggcctgaccttcccgccactttcaccactgcttcgttaatgggcccgtctgtatctacacaatgtgcctctctataaatccgcactctacacccgtgagcatggttaggtgttcttccaaaatagaaatttaatcaaaggtaaggaagcatcccctgatctttcctccttcagaggagctcatggtcacaaggggttttgcttccttttcttccatctgctctcaggctctgggactaggcttctgcccgctccacatcctggggccagcccctggcatcggccccagcacgatggtggcctccttcttgtcgggtcccaggctgcctcctgggccttcctcaacatgatcccatcactgctcctcaccagccatcccctgtcccttggctgtcgctgccttgctctgtcctggctccatgcctctccagctcctttctccaactctctggctctgagctccagacctctgtgttctgcccggtccttccagtccttcagacctgttccccaccccagggaactctgatctcatttctgatttgctcctggcactcttcaacacctggggttcttgtcagtttcattctctgtggactgtcccttctagactgggagcctcttgaggacagggggcttgaccatcacctgaagtgctgcacccctgagctcagcacagagctcagatgcaggagactttcagtaagcatttgtaggacgaatgggcacaagccccaggcgctggtgtctcaacctatgtggcggtgcctggccaggcaactggccactcctgccagctggatggggccagagagtgcttggagggagagcaaagaggagccagcagctgcatccttctgcagggccgggtccaggtctgctttactgcctggagagggagaccctctcagagcatcctctcctgtcatgagctacagacggatgcacagacacattccccaggccctgggctcagggcatcccatgctggccccttcctcttttatgccactctgccagcagacaggtgtgggcttgtgctgatggccacttccttcatcacctgtgcaccctcatcacccacacaccgtcaacaccaggctctgttcttgacacctccctctcccaaggtcacaggtctgccagacacgggcctcctggagcccaccccacttgtttcaggtctcccacccccacccccaccctcacccccaccagggtttagctcctaccttccctttcctggacaacctcaacactgagtcttggttctcttcctcttaccggttttcctgcagaacaggaagtttccaaaatgcaaatgtggtctagtctctcctttgcctcaaaccctctaatgctgcccccttcctgggcgtgggagagggcggaggcaagagcctcttttgtctgtaccatggctctttctagcttccttcctcgaatgttctcttattctggagtcctgggttctgaggatctccctctggctccttgtagagtgtctacatggcttaattagtagtagaactatgcagtaattaccttgtcagcttcttcagggttattaaaaacataaaagctagatgcttaaaaaatactgagtttaagaactcagagcttttttttgattatgaaagcattgcctgttcattatagaaaatggatgctttaaaattccttttcctagctgggcatggtggtcacacctgtaatcccagcagtttgagaggcctaggtgggcagattgcttgagcccaggagtttgagaccagcctaggcaacacagtgaaaccctgtctctataaaaaatacaaaaagttagctggttgtgatggtgtgctcctgtcgtcccagctacttggggggctgagccgggaggatcgcttgagctggggaagcagaggttgcatggagctgacatcatgcctctgcactccaacctgcgtgacagaggtagaccctgtctccaaagaaacaaaattcctgttctctgcccccttctcaccctaacaccacacagaagccaatgacaatggacccctttgtctttaggatctgccaggtacctggcgaagctgtcagcattggaacaacagacatgaggaagtcaggcccaggggcaccgtccagcctcacctgccttcctcatggtcacaggaacctgttttcagtacctcacttggtactcctggagatgatctcatttgtttattagacaaacttgtttatggtctgtccaatacagtagccactaactacatgtggcaatttgaatctgaataaaataaaataaattaagattctgtttcctcagttgtagccacatttcaagtgtgcgggagccccatgcagctgtggctgccatactggatagtgcagatctagaacattccttccttgcagacagctttgttggacggtgctgcttggattgtaagctccctgagggcagggccttgcctgtggtccttttggctgtgtcaccagtgctagcactgtgctaacacttggtagttccccaatgaatgctgacagaatggatgtgccagagtgactggtgtggtcttgagctctcctgcgggaagggaccctcagcctccctagtctcatcatctcatcctctgaaagggagggtacccagcagagataatttcctatccacacagaactcatttatttcaatttagtgagctttcccagagcacctgcaatgcagcacacttggcccttgccagaagggcctctttggacaagagaacaatgagatgcaaagagattctttccctggggctaaataaatgtgtccaagtcctggctcagccatggataagctgtgtgactttgggcaagtcactttacctctctgaatctcagtttcctttaatgtaaaatggtaggcattattgtccttaagttcagaatgagtgaggataactgagctgttgtctttaacaatgagtaaattttgagacacagctttaggaggcagacacctccccaaacattctccaatccccttgaggtaattccatcttctgttaacaaagtcatggtggcagtgaccacagtgatgtatacagcagggagcgggaggaggcgcagcctgcaggtggaccccagcccttctgtgtgcctggctgagctggtcagcctctctgagttctgtgaaatgtgagttagagcaggactgatctggctaggggccaggcaggagtcatgggaccgtgtccctcagtgacgcagaacagcttcaggcaccagggccattctcagcaaatggtggaggaaggaggaggaggaggaggatgtggttcctgctctgattctggattttgggcccctggctctaaaaggctcctcccctacactttcccactctcaccttttgtggaggctgtgtctcccctacccctgcctccctctccggccccaggtccacccagcctcggatgttgttccccggctcccttcctggctccccagcttgtgaatggaaatctcctagggtcccccaccttcacaagttattccctctggtctggtaattttgggatagcacactggttgtcttgaaatgcgatttgaatgtgtattttgcggggattgttttactctgatgagtttgtttcctttgcaagtatatcttcagggaaggtgctttttaggggagggtggctgtctggaatgacacaggtgagccttgttaatgctagtcctgtcgcatggccaaagcgtgccggaggggacggtgcaggtagtgggtgtgtcctgggccctccccagagctttagccagggcagcatatatgggaggatatgaaatgtcacaggaacagaggcaaaaagaaaaagtttgaaaaaaactagtatattagtttgagaccttttcttattgaatttgagagctgggttctattccatgcactagaaaactctttaacacagggcaccaaactgcagcgtctgcagggccgggacttccgctgtgggagggtcagggtgtgtgcctgctggggcggagctgcttcttgccctgtggaaatgtgggcccaggttggtgagaccatcttcatcttttttttttttttttccaggacagtgtctcactctgtcgcccaggctggagtgcagtgacgccatctcggctcactgtgacctctgcctgcctggttcaagcaattcttgcctgctgggttcaagcaattctcctgcctcagcctcccgagtggctgggactacaggtgcgcgccaccatgcccaactaattttttctgcatttagtagagatggggattcactatgctgaccaggctggtcttgaactcttgaccttgtgatccgcccactttggcctcccaaagtgctgggattacaggcgtaagccaccgcgcctggctgaccatcctgttttaagagtgacactgggaatccagatttttatatgacatgttgtgttaggattttgtgttgctataaagaaatacctgagactgggtaatttataaagaaaagaggtttaattggctcatgcttctgagggctgtgcgggaagcgtggtgccagcatctgctcctggtcaggcctcaggaggcttccaattatggcagaaggcaaagggggagccagcacatcacacagtgagagtggaagcaagagagggatgaggaagggaggtgccaggcttttttaaacaaccagatcttttatgaactatcagaacgagaactccctcagcaccaagccattcatgaggaatccgcccccatgattcaaacacctcccacccagccccacctccaacattagggattccatttcaacatgagatttggaggggacaaatattcaaaccctatcggatatgatttttaaatattgacaagtttatctattagggattgggttgactttatgtaatagaaaacctaaataacactggcttaaagaagataaaggttttccttccaccagaagtccagacagcatgatggcgtccctgtcgtagggtgggacgttcagtgaatttcatactgaattctggttgcaacatggttgcttcacctccagcaacaagtacattttctaggcaggacaaagagggtagggagaggcacaggggtgtccacctgccgagtttgacattgccttcttgggagcactgcccagtgacacccacttatacctccttggtcttaggacatcaaaaggctactcccagctgccagggagcctgggaagtgtagctttttctttttgtttgtttgtttgtttgcttaagataggtgtattgctactctaacaagagcaggttccgcggaaggggagggtgagaatgactatcaggtagtgaactacagtctctgccatatcaactttataaaagcacaatgtgatcaaaacaaaacatgtctgggagctgcatgtggcctgtagttgccctttcaaacctcagatagaaagaatctcatgggaagactgaagcagtttttatgttttgtgccattactaagaaattaaaggttggactaagatatgtgatccaagcctaaacattatgtccattcaaattttatttaacaatatccagggaacaagataggcagggtcactgttcctcacagagccaatcatctggtcagcgatcaacggctggagtgaaaatgtgcttattgtcaactcttgttataaaaggagccatcatacttccttttattgaatagtcctctaaacccttgaggtagggccagaaagctagcgaggctgagtaaccggcccatggtcacatttatataaaggggaagcttaaagaggatcttgaatccaagtgagtctgaggcctggcccatccctatctgcaccacccagcttctgcctccctcatcctgcaacttactggaaagcggtcctctgtcctttacatggaatagatatgtgtgtttcacccccattcctggctccagccatctagctgacagacgtatacatacctgtagtcacaaaagcacacagaggcagatgtactctttcatttcccagttcatttaaccagaatggccactgggacaagatttatgtattgaaagtcaggcaaggcgatggcagagaatcagctgtctgtagagttgttgaaggtcccgtctttaatgggctgggactcgtgttcctgtttgttaaagcaagtcggttggatgggtagcttggcaacgcaccttatctaatggtcacgacatctgtagactttgacgttgattagttggcagccacgaaatggatcagccctgcactgagaagacgggagctgtggctatacgacctaagaagtgtgtttattatacatactatgctcctgtttgtaatacaacccttttaaaaagtcaccattggtcttgcaatactcttcctaatgagttgtattgttatggcattactttttggttcaattatctcttgaaagtttgtatccatatatagaaaaaattgttgccttattgtaatcactagctctggagtttcaatgaagtcaggaagatatgccaaaaatgatctttctgcttccctttggcaggaaggcattgtcttaggcagcgttactcctggggtgactctgcgtttcttgagtcacgtgagtcaaatggttgctgactttggcacgtttattggccgggttttttgtgcaaagcttctgagatctgatgacctccacggtgtcaggactgtcttgtcacctgtttttcggggatctgcctggcccctaccccacattctttattttcctgttattctctatatacaaccagagatacaggttttccatcaagagggggcctatagaagtgttctttccaatcaagcttatttacataaaaaagaacatgacttgaaaatagtaataatgtagtggtggtaatacacagaaatatgcgaagaaaccatgaaggtagtgcttggaagacacaggcatgccaaaaaccacaaagctggtgtacaggtttcagtgaaatggggaaatgctgttataaattttcatcttggtcttgtggcccggccatgattacttacctatttgctgacgcattaagcactacagtgtgcatggagcatggtgtgagggtatgcaaaggggcatcgtgcatccgggaagctcatggtctggctaggggcataacattttgacaagtaaaatgacagggcacatatgtaataagtgccaggcctctcaaacttgtccccttctgtgctgtatcccattcattctctgccaggtatcacaggcttctgcaaaagcattctccagacctccgtggccctacagcattgagctttcagtccttgggtttctgaaggttggcagggtcgaaggtccaggctggctcttctccgtgcatctcttatccttcttggacctgcagtctaaaccagccatgttagtcttgtgtagtggtgaagatacatgggacctcttagggcctaggctggaaaccttcacttatgctgattctgttagcctattggccaacttcaggtcaaagagagggaaatacacttgacccctttggttgggggagcaggaaagtcatatgtagatacaggagaggtggagaattggggccagtcttgtaatccacacattaggcttatttccctatgtagtctgtgggctcctggagtcagaatcaccttggaatctcctgccacctctgataaggtgatgccttgacattggatgccaacagacaaggtctgtggggtgcttgcagatgtgtggtctctggtgtcagactgcctgggttcactgtgtggctttggaagatctacctaacatctctgatccacagttttcccatctgcagaatgaggattactttacttatattaatacccccttagacgagcagttatgatgctgagatgagatgaattctgtaaagcgtttagcacagttcctgggacacaggaagatcctggtcaccatgagctagcattcgcctcctcctatcactgtggagaagttttcaccaaaggccatgtcttggtggataagagcaggaggttctgatctggtgcagttttgaggctcccagatgcccttgtcttcctttgggcctcaagatgcaggagggagggctttcctggtctgagctgctgggtgaaatcaggcatccctctagaacttcctcccttcaccctgtactgccctggagctggttcaggagactgctggcatgcaccgggaagctccgctcaaggcgttgccccctgatttcctagtgggggagctggcttgaggcagtcagaatactgagttgggtaaaagacccagggtcagaggctgagtctcattccagctgggacgtgaggctgtggctgcgctgagctgaccaccagcccctgggttccttagggttgcctctgggctcaggaaggaaactgcatgtagacactgagctaagggagcactagctgtttgctttggttagttctttcccctaatccttgcaagtagctggttctgctttgatgtgaaataacaaaagatttagggagaatttataatttagctcatttttttttaatgggaagggtgagttttggagcacatttaataccatgccatgtggggtaagctcagagcgttgcctgcactctcattcacctgggctggctttccccgctcgcttccccgttgggagtctaatacagcctgccttttccttaagatcattacttcaaacagtgttgacattttaatgtgattattttcctgtaatatttttccagcccttttctacttggggagtatatttgcatcctttttctttagggatttgtgttgttccagctccatcctggtctgtagaatagagctatgctcatagtaggtgcatggtaaatattgattgactcttgggtacgtgatagtgacgtctagcacccctcctcatacctattcccatgttcccataaaaaaattaaaatcgagggagaaaaacccaaaaaaaacaacaataaacaaagagttccatgatggcttcaggttaaatagtctcaccctgttggaaattcctggagcaaatgagcaagccagtgggcaggagcccgagtgtgagttctcaggaatatacatcactgaaagtgagcccacacatttgttaatgattggtctctgtgtggtgttaaaaaattaactaataacaatttattccagaggatattagtgtagagcagctattttcttataggaaaagagggattccagtcatttttttttttctgttttgttgaactgatgtttgcatcttgcctggtgaaatctttagcaaggaggaggtggaagttgttcactttagcacccaggggctcagctaacatttcgtggggctgacattctgggtgcctgtgctaggtgtggaaggagaattaagcggcttctgtccacaattgagagtctgagtagaaaaaagaggcatagctcacggcacgtgtcatttctcccttcgtccctccttccatccctccctctgtccttcttctttctccttcccttccagcaaatttagtgcctatgataatgtcaggggtgaggctgggcttggggaatagcgcagcaaaccgacctgttgcctcatcctcgtggtagatcgtctggtgagtgatgggcttggatcacatcagctcataggcgaatgccccatccagctgtggggaggctgccctggagccctgcgggcttgtggaggggttggcatatctggggatctgagggaagggtccaggggagggcacttgagttagagccaaaaggtggcttcgaattaactagcccagcaggaaagggaaaggtatgctaggccgagagattggcagtgcaaaggccaggtggtgggggcagcttcggctggagccagaggcaagagagaagcaggagtatggcgggatggggctgcaggggagctgggagccagacggttggggcctcctggactggggaggagcttgtctgccatgagggaaccatgggatgtctgaagagagggatgtgagtgtgtgtgtgcgtgagtgtgtgtgacagagaccaagagacagtgtgatcgggcacatttccaagccgtcactctggctggccaccccgggtggaaatgggtcccaggaaggcagcagagtgagaccagggaagagggtgtggcagccacagatggtggggcctgggctggggtttgcagagctcattcagaaaaggggctgggactacattgcccggaggaagatctgtgcaggagaggaggctcaatctcagcttggaagggaagggcaggagagggaagggaagggtatgtgccatgaggcacctacgtggtgtctgggcaccccatggtgcagccaaaggctcctcccaggatcctcatgcaggagccctgaaggctgtgcaagaggtgctgtctcaccctgagcagggccgagagcctgagaggtgctgtctcaccctgagcagggccgagagcctgagaggtgctgtctcaccctgagcagggccgagagcctgagaggtgctgtctcaccctgagcagggctgagagcctggaactgtttagagagagtctggggcagtgcaggatactcggagagattgcctggggtgccctaggatggactgtgttttcttctttatacatgagaagctggaaaatgggagttggacgtggattccgtgggcaaaggttcttttcctggcacagtggagcagggatgctggcaggggtggatgctcactacctcctgtgtgcttttcctactgtgagcaaatgtggaagggagaattgctatatgaagaccctccatgacccatatcctgtatagccccctcccctgagtgtggcaggaaccagtgactgtgacaggtttcgcctgcatgcctaggctatcttatatgcacaggagactttaagaaagtataagccttggtggccctgccctaatcagggaagccctaaaggggacaaaattcttcctggagattgagactggaagcacaggatggaagcgggggatgctggtttgaagatggaggggactatgtggaagggaatgtgagtgacctctaggagctgagagtggcccctgctgatggtcaacagagagatagggatcttagtgccatagctgcagggatctgactcttgctaacaccctgagtgagcacggaagtagagtttccccttgagggaagatgagaaggcaccccactgctacactgatttcagcctttcggaccccgagcagatgagaaggcacctgggctgacacaccgatttcagcctttgagaccccaagcagaggacccagtcctgccatgtcctgacttctgacttacggaactaggagctaataagtgggtgttatttgaagccagtaagcttatggttttgtgttatgcagcaatagaaaactaatacggggagggaagtttattgcttccatattacaggggaaagcctcaggttcagagaggtgaagggatcgtcctggtcacctggctaccctggcggagctgagaagcaaagctgtgtggccagactctgatgctcctgctgtgtgctgcctcggtttcctgatctgcgaaatgggctggtcatggcattgtcctgaggccgcaggaggagtggcctggaggctgtgccagctgtgaaagtgtcagggcccttgtgactgttttcaccctccctgttggcacacaggacctggaggggtgcccctccgaggccctccctggcttctcacactcaccctaaacccggtgtgtttccatggttactggtggctttactagtgtgactctcaagctggccccatagccactcctttttatgtgtatttctaatttcctttagagcatttttaaacttttcgctttgaaatattttagacatctaaaaatgtcacaaaatagtaaaaaaataactcctgcgtacctttcacctatattccccaaataacatcccacttaactacagtaagtcatcaaaaagaagaaattagctttggtacaatacaattaactcatctaccaaccttatctgaattgagtccatttttctgctaacatgcttttctatcctgtgatccacccaggatcccacgtggcacgcggccagcatgtctccttagcgtccgccaatgtggaacagttccttagtgtcttcatagcctgatgcctttgaagagtgctttcagttattttgtagactgtccctaaatgaggggttgtctgatgtttccttctttttaaatcgagtatatgcgtttttggcacaaatcccccataagcgatgtcgctggagatccctaggtcagttggaccaatcctggtgatgttgactgtggttgctcagccaggtgcctctgctctaaagttaacactttcttcctctttgtaattcgtcagcgttttgtgggaaaccttgagactgtcagacatcgtttctcatcacaccctttcccaccctgggaatcctcgcctgccagttgtcaccatggtgcgtgttcaggggtggctgtctttccgtcatttctcttaaatgtattagtgagttccattactcactaataagggaaagcttcccccacgctcccatgtatttattcacctgtttacttacactagtgtggacgcctgcatgtatgtttatcctgtggagtagagtccactgctgtcatcttcttgttgctggaactgtcccagacgtggccactgggagctccttcgagtcggtgtctgtgccagtggagtgctcccatcattgtctgagctctttcttgctttctggcagcataagacgctccaggcccccagggcctcgcctctgctgaggtgcttgctgtgcaggatttgggaaggtgctctcaggggctgtgggctcccatgcctgcttccgcctcatccttgcagacccctgtgcaggtaggttatttgtaggtgagcaccccagtgcacatagactgatgtagccgggttccccagggagcaggtggcagagttggggcttgcccagactcctgctcttgccctgtggaaggacctatgagtcggaccccacacagggattaggtggggccatgctgggcagcccatgtcagcctggcacatcttggggactgtccacagtgtcagggctgggagcatggtcttggcacatgtaacatgccccgtttctctctttcttctggggttcaggcatatttctggtccatgataagatctttgcctccttcctgtctttcttgccctcgtggatggcccagaatcctttgtagatttcccacagtggcctttcccaggcaggcactggctggcagtggcagtctagacttcctgcctgcctcagtggccttccctgaaggagctgtacaaaagtgacagggagcacaggccactggcccctggggaggtgtggggcatggtgagccacgtccaccacatactgtgtgccaagctggaaaagagtttgggggtgcagaggacaaaggaagggaggtcacctctacagaatcacatggcacttaatttgtctttcctcttccctacccactcccctcctttcttcccagagacaagaggcagctcctgggagaaggcacagcctctgagactcacaagcagatcttttaaggtcaactttgccatctgtcttttaggcaataaccttcactacagctttttctgcttatttttgtcgaaagtcattgggagaatgagtcattgcgtgtgtatgcctgtgtgtttgtgcatatatatatgtgtgtgtatgtgcatgtacaagtatgtgtttgtgtgtgcaggtgtgcacgtgtgggtacttcccctgatttttttttttttgtgacataacttcccctcatttttttgaaaggctgaaagggactcagggtcaaggccatggtgcatccctcctgcagggagctggagctgggtgcctggaagctggcctttgggtcaggcttcagcctcagccgtactgactgtgcctggccaacctctgtcagtcccttcatcaggccatgctttaaggtcctcctctataaactgggggcaatgctagttcctactcctggggtgggtatgagttccagatgaggcacgtgacctttgcaggattttaacattacagtgacataactgtaatttacctactggtaaatgctctgttcatgtcagttagtagaatagaaagtgctggccctgctgacacagcagccatctcctggtttgcgatggacactatctcaggaggaggctgccgtgtgcctgctgcgaggggtgctccctgtttgctagggaggcccagagactgccccggcacctcgctgcacacagagaggccgtgtgtgtctcttgacccttcagctccacactgggaatgagggagaccaggggttagagatgcctcgggacctgagccgggcaccagctcccatctgtccatctgtcctgggctgctgggggagccggctctggccaggactgatgattcctggcacccaccaggagatgcacatcctgcttgaaagctgtgaactgctatccagagtgtctgggcttatcctgttggagcaaaacccctgggctaatatgtaatcccattgtgaaatgtatttcaaggagggcttctacaaggattctaattttacagcagctttaaccaaaaaaaaaaaaaaaaaaaacccaaatcttcagcaaacactcagaaccatggttcctgtatgatgtatagctttcaaaaacactcccccaccccttggaaatataggcagggaagggaaaataaatgtttttttgtgggaggcaggagcattattgaaaaaaactcaacaggctttttaaaactggaaaagtagaacgcgcgcatgttgaaaaattccagggcggctggagacaggatggggtggggcaggtatgtcggctccgcatggatcaggcttggtccagcccgtgttatgaccttccagctgtctgcttctcctctttggcctcagtttcctcatctataaaatgggaactatagtattgtacgcaccatgcagctgttgtgggggttaaatgatatgatctgtcacattcctgttacatgtatgtattcaacaaacatcgactgtctttttcattagtgaaaaccaggtctctctggctgtgcacccgtctctcgtcccacgacagctgctgatggctttcttgtgtacgctctcaggaaatttctatgcattcttttcttcttcgtttgtttgtaatatgaagggaaacacgctagcccctgttctgtgcctggcttttccctcttaaaactgcatctgtgggatgtagatatgaagtttgaaggatacgtgggaatggaccagatgaaggtggggtggggatggtgaccactgtccctggcagaggaacagcggatgtggtggccatgtggtgggaggggcaccgtgtgagcatgggctgaacggctggtgcgtggggatggggaggtggcttgggcctgccacgcgggacagggaagaccaggttgagggtttttgtctgtatcctatggagtgatggagacctgctgacacttatggagcagagggtgacccactgatctgggactcggaaaggtcaccccacttctgctttggtgcccatgggcgttgtgtagagaaggtgtcctgttttggtttcccaagagaggaaatggacctgctggcaggagaagtgggggagagtggttgggagctgctggtgtgtcgcctctcgatttggagggtggggacataagagtgggaaatggctggggcagtgtctctagagggtggctttcttcgatgtgagcctggaagttggtgaaaattgcccctcttttggtgctctcatgggtgtttggatattttgatccccaggtcatctttcaagccaagtacagcatgcaccaacccctccgtggctgcatcctacagcccctgatccactggtggactgctccacacctgctccctgttggggtctctgtcctcctgggtgatcttctagagcaggagtctcaagctttagggtatatgagactcgccgggggtcttgtctatgcagcatgctgggtcccttcccagagctcctgacttgacgcatctgccatgaagccagtatgaacatgcatttttagcaagatctcaggtgccgctgatgctgctgatctgaggacaccctgctctggagactagaaacatctctggcctggtctccctcccatgctgctcctgtgtagcctgcaggagacacctcctggcagccgggtgtgcaggctggtccagcgcagccacctcagtccctaccggagtggtctctggcaactcgggtaccattctctgggcctacccaaggaacatattacaggggctggagctgacctgctggagccccctaactcagtctgatggaaagaagacttaaaaaaaaacttgtgatgttaatttaaattttacagaaaaattgtgaagctagtacaaagactttatgtaaacctgcaccctggttccctttcactcttatagtagatttgtatcactaatgaaccactcttgaaacattattattaactcaagttcatactttattccaacatccttagtatttttctaatgccctttttccatcccaggatgccatccagatcccgcatgacatctggacatcatgtaccttcaggctgtcttgctgtgacgccttttctgactttgcttgttcttagtgaccttagcagttttgaggagcacctgtagggtgttctgtagaatgtccttcaatccagaacttctttttaaattcctcttctgcttgcggggcatcttgagtcatggaaatagattctcatttgttttctttgtaaattctgcctagagccagggtctgcagagatctctctggaatctgatagctagaggcctcagttgaccctgaggcaggccccattcctgttagagaaggtgcgtggaactggtgtggttgggaggagtggttgagaatggtctctgtgggcacggggtttgcccggcaggcagctgcccagtacggctgcctgtgtggctgatgtcatgttctcatcccatctgatgcactctccgcaagtcactttcagaaactggaagatcccacttaattctgctctggaatatatttagaaatctattcatggccctctcccaaagctgatgttaaaattaagagatatcatttgtaggatgtcatggctgtgcaggaggaacatgctgatgtctccctggccgcctttggtttcttctcttgcttagggatttgcccaactcccattgcccatctgagcccagctttccccctctgagcccagttttcctcctctcaccccaatgtcagagtgggcacatcctccctgcggaggcatgcaggcttttcctctgcatgcaccgtctctgtcttgcgtgacagcccggggctgtttctcacccttgttacgctggggttcttggctgagagctcctgggcaggggctgactttgagatgaggcttctctgttcgtttctggctggttctagatctgggtggcatttggagggtgcaccgcttgtatctgtgaccgaatacctcagggtttgtggtgagggacgtggagatttctgtgctgcaagagatcttagtgcttctattgtgctggggagaggccagcccatcttggggtaccagggctggaccaaactttagagggggtctgacccaggtgttcagagccagaaatattatttgcaatcctctgcagggaatttaaaaatgaaaccattctgaactctccctccagaattcatggtcgtcagccattcaacaaatatttactggacacctgttttaagcctgtcaccgttttttgagtatgcatatagctatatatggcaggttgcagtgacgactcatgtctctgccttcatggaatgagtagtctcgtgggatgaggggaaacagacagcatagaaatagatgtatgatgggactctaggtggttatagatgcctggagtgatgataaagtgaggctggaggaatgagactggcagggaggagagcccaactgtctgtgatagatggtcagagaggacctcagagcagggcatctgtgcagagaccaggcaaagtgagggagctggtcatgtgactaccctcgagaagagcactagggcagcaggaacagcaggtgcaatggccctgcagcaggcatgtgcttgggtgtggtaggaacaaggagaccagtgaggctgagtgagtgatggaaaggggcaagtttttgatgcccacaatgccaagaggtggccaggggaggatcccagggaggtgccgaggcctgggggaagacttgggctttattttcagagctgcccgttgaagatttgaatggctgcagagtgagatgagattgtgctggaggattcgaaggtcatttagtcagagatgctggtggtttggagcaggttgttcacagcagatgttctttgtgcctgcatcacaattccttggaccagctctgccttggtcttcagctgtggcttcaatcaaccagcatgttgggtgatgagcgctgtattggagcaggtggctacactttcaggaatgctgcaagctggctgcagtgggaagtatttacaccatggcaattggcaaatgtacatatcagctcccttataccacccaaacactttccagcacagcacagccatgagcccagtgctgtggatattctcccaagcatcaaagtgcagccaggacatgaggggagctaatgtctgaaggacaatcctcagctgacgaaatgggagtaaacatcccaggcatgcatcctttaggtgggtgcttcttggagctttcagagaatgcaaccttgctgcctacagctgtgaccctggaaatgcacgtgtgtgggtttgcccttcctccctccctcactctcattgctcccttgcttctgcttcctgagatacctcccaaataagctaccttcacctaagcccgcctgcagctctgcttttaggagaatccaattaagatggtggtagagctagatgtggtgtgagagggatcagatggctgggatgagacagaagagtcctggatgactccaagcgttccagcctgagcagctggaaggatggagaggttctggcggcaatggggaggaaccattgagatgagcaggatgggggttgggcaaatcaatgctctgttcagctgtggacaggttctgtttgagagacctatcagatccccaggtggaaattgtacctggagttagggagaggtgtgtggttggatagagatatctgggactggacaacactgattaggtcaggtgcccacctgcatctgtgattcagttgtgccctcctgcttaggaagcgtctgtgtatctatgtatgtatctatcatccatctatttatcatttatctctcttttttatttatctctcaatatatctatcatctataaatatatgtatattctagcatctagtcatcaatcatttatctatttttatttatgtatcaatatatctataatctatttttcaatatatctataatctgtcatccatctgctaatcgatcatctaccattatctatcaatctgtgtatctatcgtctctctctctgtccatccatccatccatctatccaggcagtgcttgcttccttctgccccctccttagcccatccctgcccaggaaaattctcgtccctgctcaaatgccttcagtgacaggaaactcaccaacctcttaaggcttcggcatggaagtttccaactcatgtggccactccagaatgctgtcctccagggactgtgtttctctctcatgtcctcctcccaagatttatttacactcctcacttgccaggagagagtacttgggagctccgagccatgcgtgttccctggcagggtcgcctgtgtgctggggaagaatgggcccagtcatggggtggagacgccccccagctgcagccctggctcccgagcagaggcggctttgtgcttctcggggacaagggttgccattgaggcaggccagggatgctgtgcaagctagcgatggctgcaggctgaaatcgggcatttcacagagagcaagcactgcactgtccccgcagcctgcacgtgaatggaggctttggccctcggagtgcagccgtgcatggggccacgtgcaggcatttctggctcctggctcccagggagagaggcgagccctgttctctccccgagttctgtttgacaaaattcacaaaaacacaaagaaacaaaaagtacgggagaggatcagttcattctcctgactcctggttggtctcaagacctcccctgttgcctgtgctctggaagattccccatagtacctactaggtgggccagagaaggatggatttgtgggaccctggaaggctgggaagaggactgagaagccacagccctgcgctgggaagagccacggaggttagatcttgttttttgtttgtttttaatacaattgttcacactttctaaacttttttgaaataattttagactcacgtgggggttgcagagcttccctcaatgacagcatccacctttccatggttcactggttggcaccaggaggtggacattggtacagtgaggttaactaaaccaactaaaccagaggccttagcgaattccaccaggttttgcaagcacttttgctgttttttcagtgaataattgaatgaaattttatcacacctatagcttcacgacaaccaggtgagacttgacttttaaataatgaggcgccaggccccttggctcctgaagtggcatgggcgacgtgtgtggatgctgactggatgcccacctgcttccttttctctacgttgtgcccccaccatgctccagtggcaggggcagcctcctcctggcccccaggcctctgcttctctggtgcctgtggaggctcaagcctttaccccacctcccttcttcccaggaaggccctggctgcctgagaaggcccagccttccccttctccctccgctgttctggctgagctcatctcctgtggctgccctagcatgtgctgcagactgggggattccacagcagaaacctactctctcgcagtgctggaggctggaggtctgagatcaaggtgccagcagggcgggttccttctgagggctgtgagggcaggacccgtcccaggactctctctgtggctgtgagtggccgccttctccctggttctcttcacatgatcatcctgcccttccagggtatgagctccatgcctgtccccagaagatctggaggcttccatcttctgctccttatcagacaatggagcggaataaacacggttgcctctctggaattggagcttagtgctcatgaaataaaattctcttaatctcacaattgtcctcaatacagttgcagtgggtggcaccgaatgagtgtcgtgcttgtcaagacagccactgtggccttccgtcttcccactgactgatggcaagtcactagaaggaagcacccaactccccgtgatggcattaaatgacacccgtgggtgtggctgtagaccaggggttctaggcagccaagggggttccatgcagccaaaggaaagaagaaactttcctgcagaatgcatgaatatagggccaggtcctaaagcccagcccacgggcaagtgtgtcctggtggttgccactttccagtcaactgattagtgtcaatcatgacactgatttcctggcaatgtgtgagatgattttaggtggtaaatgaactattaattttataaagaacgttcatatcaggtatatgtctgtttaatttttcttttttcttttttttgagatggagtctcactctgtcccccaggctggagtgcagtggtatggtcttggctcactgcaacctctgcctcccaggttcaagtgattctcctgcctcagcctcccgagtagctgggattacaggtgcccaccaccacacctggctaatttttatatttttagtagagacagggtttcaccctgttggctaggctggtcttaaactcctaacctcaggtgatccgcccgcctaggcctcccaaagtgctgggattacaggcttgagccaccgttcccagcctgtttaatttttcattagaaaaatattgcatttccattaaagtagacgtcaagttttcattttaaactttcttaagaaaacattatattcattttagaccaagtggttctattagagcaacatccataagagtggtgacgtgtgagtgaagttggggagacaccgggtggtgcagttacccagcaccatctagaggaagtaccactggggtgggcggttacctggcaccatctagaggaagtgccactgggtgggggtcccttcacagaggcagggtccagtcccggccaccctcaaggagcttgtactgtcgaagtggggagggggacatgagaaatgttgactcaggggcagagggttcttaggcttatcaaggaagctctaggattctcggtgttctaggggattcgaggaggaaagttacacctgatgggtagacaggggtggttggagggatttggtaaaacgttcatgaagaaggggtgggtctgtggggtttctggagttgaagtgaccaccaccagggatgctggcatgtggagctagcttcatggctgttagctgtcattgtggaatggaagttaaagtgtgcgttgagcagggctgaaagaggcatagacctcccatactgggagagaagccatgctcagggaagaatgcccagaggctaaaagtcagggtcagatgcccatcttaggggcccttggttgccataattatcaaggcaaggtccttggataaagtctggtccggtgcctctgaaacttctatgtgcatacatgtcactgggagtctggttaaaatgtggattctgacgcttgggtagggcctgaaactctgcatttttaatgagctcctgggggatgctgctcctcagatgccccgctcttctgtcccctagcccccagcaacagcaaacacttagtgcctgcctttctgcagggacaggggagggaggtttgtttgcagtgacagtttttgggtagctatggagggaggagagaggtaggactttgtcttggtccagtttacaggggccttgacagaggcaggaggggtgggcaggagttgccaacttttatattttggtcaactagggatgtttaaaaacaacaatgaagaaaaacccgaacatccttggtttcacaacagtataataataacactattaacaccagtatttcccaaaagaaatggaatttcaaatccaaagagtcaggaaggccatatactccaacagaagacagtcttttcaaggacacagagccagcccccaaaacacctcactgcattgtcctcatttttcaaaggacttgggaaacatcaccccaggctggcatggatgactgggctgaggcttgggggctgcggctgtatgaacgggaatgcctgtggtcctcagagctgaggtctgtgttcccagaagcccctgtagagtggcatctggccccggcctgtggtagcctctgtcctttcccaggagagaggttgccagggcctgagcaaacactgacctggagtgtccctgcttctgaacctgcctccctatcgtcctcaccttgtggtgtacgggacgtgtggggactgtatcatctgggctgtggctggcggcctctcgtctaatgctaccacatgcccttcataggccatgatgagccatggcagtgctgactgtgttctaccactgctccaggttcctgagatgctcacatcctgggatgtgctggggttgagcaccaaagctaggggaggtcctagtagcccactcctgttcctcagtccccttgcgtctggctgggaaaaggtgcacctcctccgtctctgtccacgtggaattgaccatcatcctgcacagtctctgcccctggtaattggttctcagatgggctcatgactcaggcttcacgaatgagaatctgttctaggacttcagttgaagcgcttggaaagagttgttttccctccacaagaagtcacagagctggtcggctgtgggcttggagtgctggtggccattttccccaacccagctggagcctgagaatggaactagcccaaaggaaagctgagcaaagacaattttgaaggttgatttcccgatggcattatttgcatccctggatccagcgtgtgtgaagctggcgcacccccgggcttctcagttaaacacttcctccctttcaggcttcagcagctttgattgggcttctgccatttctgattattacagggacttagaggaaggaaatggctttgcccagatcacagggctcatgaaagtgcccaggctggaatgcaaatgcccacctacttcccctcacatcactctccctcacctgctttaagtgcatgcccagtcccagggagatcttcccatcactctttggggattctgcctcactgaaagctcttgaagctgcttcaaagtggagtatcatggtgtttcccgggagggtggttgccgggtgctgagaaagactggcctgcagtgctcttgcttttgcacttccgtcccccaccttgatcctggggtgcacgggggcaggaaggagaggagtgtgggagttgatggggagatgagaggagacatctacccatggcctctgcttctgggaggacctgtcacactcccagtgacacagcgtgtgctagagattaggcttttctcgtgaaagtagggttttgaaatataaatcattctataaagacatatgcatacgtgtgtttattgcagcactattaacaatagcaaagacatggaaacaacccaaatgcccatcaatgatagattggataaagaaaacgtggtacatatacaccatggaatactatgcagccataaaaaggaatgagatcatgtcctttgtggggacacggatgaaggtggaagccatcatcctcagcaaactaacacaggaacagaaaaccaaataccacatgctctcacttataagtgggagttgaacattgagaacacatggtcacagagaggggaacaacccacaccagggcctgttgagtggtgggggtgaggggagggatcttagaggacaggtcaataggtgcagcaagccaccatggcacatgtatacctatgtaacaaacctgcacgttctgcatatgtatcccgcttttcttttgtttttgtttttagaagaaataaaagaaaatagaagctcacttgcctggatactttaatattgcctgggtttttgtgttgtggagggctctgtaagtcatggaaaaggtattctcaggagctgctaatgacatatttaattttaataatgagtcacccatgcccacaatttattacctcctgtggctctggactctggttctttgagtggtataatagggcggaggttaatggataacacaattaattatttaggaggttcttacaaagccaaagactttgtaacagattaactaataggttcctaacttcattatcattttgatttttccaaagaatattttctcccaaaccactcaactgtataacattactgggaaatgtctaatttttacacgattcctctgctcagtttaaatactaatgttctgcttactccgtcactgttcagcgcccagctttcggtcttcaccttattgcctgggagatagatataatggattcagatgttatgagccctggaagggtttgtaacataaggcagtattttaatgctttaggggctggaaatatttaaggcaatattttaattctcatgagggacgaagtgttgtggttgcaagtgcagcctctgaaatcaggcggagctgggtgtgaatcccagcctctgcacttaggttggttacatcacctctccaactccgttccctccttcataaaatgggcacactagtagtattaacctggttgcattgcagtgaagattcaatgagaaaatgcaggtaaaacacttaatgtggtgtccagcacagagtaacaggttaggagtgttggccgtgaacggtggtgatggtcatctaatcacagcatggaatgaggaggagcaagccctcaccctggcctgctgctcctttgttgatgaaatgcctgtggttgttttcacaccgcagcaacagaattgagcattttcccagaaaaatttcccggtctaaactgtttactctctggcccttcatagaaaaagaatcgctgctccctgccctcaaggcagcctcctgtgcttttatcttctcgggtctcctttcagaggcctcattataggtgagcgccatccagcagaacgtcctgtgatgatggaaatggtctaggtctgcgccatgccgcccgggattgcgccgctggccgcagatggttgctgaacactcgaaatgtggctcatgcaacctcagaatggaatttttaaattttacttagctgtaattgatttaaatttaaatagccacctgtggctaatggcaaccacatcgggcagtgcagtgacaccacaccggctcagagtagagaaccagtcacctccattctagcatcctttctgagagtgccgggtggagggtgctggctttggctgaaataaaggaaagggagaaggctgctccttgcattttctttttctgttcttttttctttctttctttctctctctttctttctttctttctttctttctttctttctttctttctttctttttctttctttctttctttcctttctttctttctttctttctttctctttctttctttccttccttccttccttctttctttctttctttttttttttttttgagatagagttttgctcttgttgcccaggctggagtgcaatggcgcaatctcggctcactgcaacctccacctcccaggtacaagcaattcttttgtctcagcatcccaatagttgggattacgggcgtgcaccaccacactcggctaatttttttgtatttattagagacggggtttcaccatgttagtcaggctggtcgtgaactcctgacctcaggtgatccatctgcctcagcctcccaaagtgctgggattacaggcatgtgccatcgtgcccggcctgctccttgctttttattatgtttttgctgattcaaagcatctgtaaatataaaaattgaacttactcttttgtgtgaactatttggtaaacattcacaagcatgaagaaggaagttaagatgtcttaatcccatgctgtagagataaaggattttgggcagtacatttgctgtcactttcaaatatttgtatggcgcgtaagaggggagtcataatgtctgcatggggtgtgcccccacttttctgctgggacagggactacacaaagcttcatattatcctgattaatggctgcagggtgctcggtgtgcagtggcctctctgggcaggtctccgggctgcacacagttggggactgttttaagctgctcagtgatgagtgtccttgctgtgaagtatttctgtgtttttcatgtttgtccagagtggccacgaggtcctcctaagagactttgatcaatgtatgtttctacagaaaatgttagaagctgctgctccttcacattagctaatgctggatcttgcccatctttcttccttgtgccaatctgctggcgaaaaattgcttgtctatattttcatcacttttatgtatttatttttttaaaaaagacatgttcccagaagtcactgcttggaaatatctctggtcatttctcttgcttcttttagtttctgggtgaggccagtggttataagccagttcctgagtctttggacagtttaatgggggcatggatcaggtcgcagatagcagactttgatagcactttgattcaatgagggcctactatgagctttgcaggttttatctcattcaatattcataaccacctgaggagctgggtgctatttatccccattttacaggtgaagaaactgagaactctctcaagtcctggtggatgagggacatagtctggatttgaacagagcatgtggccacctgagctcacactcctggtcagcacaccatgggaggcatggggaggggaaggggtgtgggagatggccaggaagacctggtctggatcggggctctgcttactggctgtgaggctctggacaaagttatgtgacctctcagagcctaaatttccccagctctcaaatggatatcaggatatttaccttgaggttgttgtaaatagaaatggagatgtgtatgaaggccctggcataattcctatacttcactgatgcttgataaatgatggctgttttctgtactattagcaatgattattaatacagtgatgaaaaatacagagcaaagatgataaacagaaagtgtctagaagatagttgctacctgagagttagctattgtttattctgttaatgtgttacagtgtaggtatttctacattcagtaacatcataagcaaagaagactttgcttgccaagggccctattgaaagccctcgatgggtacaggctgttatctcaccaacacagactctgatccaaggtgaccaggagaattttagaatgatctaggcaaggaaattgccgtgcttccaaagcaacctgctcctcaggctccctgtggggctgtctgccccagcttgccacacctctgcaggtttgtggctttgtttcctgtatggggtctgaaggtgagcagtacctttgtttcctgtatggggtctgttctgtgttcagaagcaggactcagggctgctggagctggagctggagcctctgagtcctcagggttctccacagctctcctgaccagctctgctagagcgatgtctctggcagatgccttttccctgttgccctgtggtctggcctttctgctgtaggttaaagaaatcacagtgtgggcaggtggcctagtctgtaagtgtgtcctctagtgacctttgttttacctctagccatgcttgctgtttgtcctttcttgggattacatagttggccaggccaaaacatcttagctcacatgaaatccaagttcacagctggtaaaaatgccacagattaaatgctccatagaaattcatgtctataatggatgcatttctcctgggaattcactccttaaataggatgaccttgtcattgactcctgtccctaccctcaaccctaacgtgaacaaatatgaaatgatccttaaccaaccaacatgctagaataaagacacaaagcattaaaaaaaaaaaaaaaaccaacaaacaatgaggagggaggagtaattcttttggcaaaacttgattccctattgtggttgatgtggctgcattctttttgctcgttgagaagttgctagaagacagggtcagtggtggttctatgagggtggctaccatttttcttgagggactgcttttatctgccaagcacatagttctttacatactttatcttcctgaagcctcatgagagctctaagagattcccattattattatccccattttgagcatgaggaaactaaagctcagggaagtatgggaatagaaaactacatggccagggtctgaatccaggctgttttgctgctggccccaaggtcttagccccagtgcatactattaaatgctgcctgagttccttgacacctgcaccactacccctccttccaccaaccaggtggggttcactggtataagctgtcttagcatgttgaaagtgctcttgtagtacttagaaacactgtcatttaactgctatttaggttcttagtagttgtagctatgttagatggatgggccaagccatagccttgtgaggacagggacagtatccagtttgttatccatcccttatctatgccttatacacagtagagtctccataagtgctgggtggatggatgggtgggttggtggtggatggatggatggatggatgggcaggtgggtgggtggatgaatggatgatggatgatggctaagtagatatatgagtggataggtagatgggtggatggatggatggatggatggatagattgattggtagatgggtggatggattgatggatgattgctaggtagatatatgagtggataggtgggtgggtgggtgcgtgagtggatggatggatggagattgatagatggataggtggatggattggagaatgggtggatgggtgggtgaatggattgacggatgatggctaggtagatataccagtggataggtgggtggagggatgggtgggtggatggatggatggataaatggggatggatagatggatggatggatgggtagatgcacggatggataaatggagatggatagatggatggatggacgaatggatgggtagatggatggatgggttgatgatggctaggtagatatatgagtggataggtgggtgggtgggtgagtggatgggtggatggatggagattgatagatggataggaggatggattggagaatgggtggatgggtgggtgaatggattgatggatgacggctaggtagacataccagtggataggtgggtgggtggatgggtggggtggatggacagatggataaatggagatggatagatggatggatggatggatggatggatggatggatggatgggtagacggatgtatgggttgatgatggctaggtagatatatgagtgggtaggtgggtgggtgggtctgtggatggatggatgagtgggtagaaatccaggcagctggaaggacagtggtggaaggacaggtatttggaaggacagtcatttgaagaggaaacaaagacatagtatttgaggggggaattatctgcacagcccccaatttgctgacattagctcctggagaaaggagcacctgcaggatgagcatttcccacctgtctgttcttttctcttggccaagaggacctcacagcaatgctctggttacagtcaggggaaggctgtactgaccacacaaagttccaagaggggacaagcatggtgtgacctccagccaacttgactctctcatcttctccccacgttcctaccttggacctcttctgggctggccgattgaaagagaatattcataaagctgactttgaggagtgttttgggaggcaggcacaaagattattggtattgagtcccagttctataacttactagctgtgtggctttgggcaagttaatccctctctctgagcttcagttcccatcctgatgccaaccttgggtactgctgagggaggaggggagaagggggatggatgcacatgaatggaaggcagtagcagttgttaattccccttatctgactttccattttactaccttcatttcttttctcttagactcttggaagagatgtactgtgctgggatataaatttttgaaacctgttctctttcctcttccatgttctccgtgataatgcaggaaaaaaactcgcaaacctggccatgatgcccctaggccgacagaggctttcctagttccaattctggcattgtaagagagagctctatggaatagcaaaaaacaggcacacttcatcctgtgcatgctggggttgaggctgtgaggtgtgcaacaggacagtagagcatagcagatgggttgatgagctgtgatctggattcagacctacttgtctcagaccctgggtcagcccgtcagcagctgagcaatattgggaaagattcttaaccttggatggttggtaggatcaagtacagtcagtgtagaaatgcttagctcaccacatggactcaggacatgtcaactctccctgctttggctataattactatcctactgtcaaggaactttctctctagttgggctaggtcatgtgcgcagaagggttggaggacaaggtgttgaagaaagatttctccaaagatcctggttggatgtgagctggatagagcaaggctggagagtgcagatgcccctggggccaggcggtcttcaaccagtcttggtgagaaatagtagctcgactcagctttggggtgcagagacactggggaggggcggggactgtagcaacctaaagtgctcctgccctgcctgcagaggatgatctgcacagccctgctcattatgatgacatgggcatgtgcgtgactgtcagctctttggttttcaagagaatttggaagtctaggtttccatgcatcaaaccagtagtagagaaggcaaccatggggagaacctaagtcttgtttctagagagatcatagggttgtaaattttaccttgcatctcagagaagggcagtgctattttagattagggaggttgcaaaggtgatgaactccaagaacactgacaaataccattatcattgcaaaagaatcttaaatgtgtctttgaaaagcaagcatttggcttctaagttgtaaaaatggaccaaaaatgaagcagtagagtagggactcataaccaagtttatgccattattgttacaggtttcttttactgtgtttctctctatatatatgcacatctatataaatatagatacatagatatatggggagaagatatagatagagataatgtatgcatatatatacatattatatttgtctgggttctccagaggaacaccatcaataggatatagagatttatctattgcctatctattcatctatttatctatctaccaatccatccatccatccacctctgttcatctatccatccattatcgtatctatcatctatccattcatccatccatgtatgtatgcatgtatgtatgtctctctctctctatcattttcatccattcatccattgtctgtctatctgtctatctagatgtattagaaggaattggcctatgtgttgtggagtctaaaaagtcccagcagtcagcaagctgaagacctgagagagccaatggtgtagttctagtgcgagtttgaaggcctgagaaacaggagagctaatggtgtaaatttcagtctgagtctgcagaagactgatgattcagctcgaagacagatagagagaattctttcttattccgtcttcctgctctattcagtccctcaatggattggatgaggcccactcatgctagggaaggccatctgctttacccagcctattgattcaaatgtcagtctcatccagaaactccctcatgggcacccaaaataatgtttcaccaaatgtgtgggcaccctcaggcccagtcaagttgacacattaaaggaaccatcccatgcatatctatagattgtgtgtgtatgtacatttgtgtatatataatatataattatcctgttaaggatgtctcacagccttgaggcagagattaattgtgacctggtggtttccaatgtttctgtatatacaaataaattatgcagcaatgataccctagtctcattttattaattgctcttctattagtctgtttaaagtcaattaaacctcccaaggcccctcacggaggaacctctcacaaaatcagtctctgtcacttaggaatcctgagtggatgtcacatggctgtcctagctcctggggagggtgcagacaacatctctgttggaactcctgggtctgtgggtgatcattggcttgcattttgtagtggcatggcccgtggaggtccggatgtagagaaggcagcctttctgcagagcgttagaatttgggaagaagtggtcaggattagagaggaaaaaaaagacttagacatggacaaggatgccaccccagcttacccttcctctagtttcctggacttttgcagggttcggtggataattagttatttgcttgcttggttggtatctgttcacttttatttcttttagactttttttttttctgattagaacaaaaattatatttattattgaaaattcagaatacataggagattatcaagaacatcaaaagcattcacaaatccccccacccccaccccagagataacccctgtggctacttttgtgtgtgttcctccagtacttttcctatagaaacatttttcccgtgtcgggattgttcagcctatatcctttattaaattaatacatcagaagcttttctccacactgcttaggacacttgggaccaaatgctccagaataggaatttgccaccatttattttcccattctgctttcattggaaactgagtctggcttgaggcttttgtttgcttctttcttgctatagtaattgggatggacttaaggctgcctgcctttttgtgtacatctctgattatttctttaggctaaattcctagaagctggaacccggggcagaaggaatgaagattggaaacccttggtgcatgacagcaacttgctgtcctgccaacattggggcgtttgcctacagaaagagctctctggttgaatcaaagaattttaagaatttaattcttcttcttgttttttgtttgtttgtttgtttgtttttgagacagagtctcactctgtcgcccaggctggagtgcagtggcacgatcttggctcactgcaagcaccacctcccaggttcacaccattctcctgcctcagcttcctgagtagctgggactacaggtgcccgccaccatgcccagctaattttttgtatttttagtagagacggggtttcaccatgttagccaggatggtctcgatctcatgaccttgtgatccgcccgcctcggcctcccaaagtgctgggattacaggcgtgagccactgcgccggcctaattcttcttttaaaagttggggatcagagtaaggtgagaaggtatcctgcacagcatcaatgcacacagcgcacattaaatgagtgctattccacttcatttgtagtattttttttcccatttgtaggaactacttttgtgcctgacttccttgttcctttaaatgagccttaaggaagtagtgttgggggaattcaacacacacagagcagttggtctttattatgattttaagcatcttgttttcatgtgagcaccccaactttgccttttgctaaattttgcaacaagttttgagtaattctgcacaaaacagtgcccttgctccaggaggagaacagacatttgctcgttcttcacaggataattagactctaaaattagaagtcaaacactgcatgttaaaatgcatctggataaaatcccagtgggagaattaatccttcttggcagtgcaggggaacttgggtgcacgcctgatggagcggcgagaagctgagagggagtgaggcagcccctctgtgtggagtgttcagggcaaatgcacgggtgctggtgacgcagtccctttacttgtctaaaagtattggattctaagtgaaaaggggggtggggatagaaggccttctgcctcgcctcctgtagtcacagtttggatatcctgtgaaagtagcacttaggcaggcattcggtcctgcttggcgttgtttggtggacttgttagagaacactactgactgtgtttgaggaaggaggtggagcagagggctcagggcttaagcggcatctcctcaagggcagcaagagacctggaacgttccagagtaacccctgcctgcatccgtcggacttgccaatacacactgagaaactgctaaaggttatggatgcaatggaggcttctggtatagtggggaggaaaagcctccattatgaagtcaaaggccattgcgtgcctgcagtgtgcgacaagagctagtggttgcagcaccctgatgggcagaagcttccctcacagagctatggtgatggagaaggcagctgcaaatcaagtcattaccagcaaggttataaaattatttgattgcatttcgaagtgaaaaacagttttgaattaacttctatttgttgtgatataaacaacagatataaaaagatataaaaggaaataaacagtgaccatgacattggttgttcagtttcaacactatcttcgggttccctggtccttgtcctccctcattcgcctcccccaccactgaattgtagactccaacagggggcgggagctgagtttgtttttgctcccagctgggactccagggtctagcactggcctggtgcttagcagcctgtagcaagtatgtgttgaatgggcaaatgtatcctttggcggtacgagacagaagctggtggtcctgtgctgcctgtggccagagcacttccagcatacggggccaggacacatttgccctggtgtcccaggttgctccaggcacaggctgcacctcctgggggctctccctgcaccagcctggtggttctctgtcgcttctcctgcaccctgcgccttccctttgtgtcacatccctacctcatcgctactcatttgttggccagtgttttttttagaggatctctttttataaaatttcagtttttattttaggttctggaggtacatgtgcaggtttgttaccagggcacatcgcctgatgctgaggctggggcttctgttcattctgtcacccagatagtaaacatagggcctgacagcacgtttttcagcccttgtccccctccttcgctccctccctttctctttcggagtcccctgtgtctgttgttctgtatgtttgtgtgtactcaagatttagctcccactcatgagtgagaataggcagtatttggttttctatttctgcgttaattcactcaggatagtggcctccagctgcatccatgttgctgcaaaggatatgattttgttcttttttatgttagcagatctttttttttttttttttttttacccactctctgattctccatgcatcatgagtcccccaaaggcagggctgggttaacctccctgggcccagagaacaggtgctcagtatttttagaatgaacaaaagttctcttgtggaatcatgagggaggtggagggaggaaggaaggagggaagacctctgccctggctctttctcctgcctgaaacagcctccctcagatcccagcctgtggcgcctttctcgtcacgtgtgtgtccgccccacactgccctccctggcctcggaggctaaagcgctggcccctgccagcctggacctctcctcgtcctgcttgatttgattctgagcgtgctcatcaccatctggacatatgttattcacgcacaattaaatgttgcttatattgcatataaaacataaatttatataatgatatacatgtacatatgtgtgtgtggcgtgtgtgtgtgtgcatatccctgtcgacaccaccagaatatgttttaatgaaaccgtcatgttttaatgaaaacagaaagccttctgtttcatgtcgtgacgctggaatgaaaacagtctctcccagcatctagctcagtgcctggcacatcatgaaagcttaataaatacggctagaattaatgaatgagtttctttcccctcccctgtcctgtatttttaataaggctgttgagcctggggcctctgccctctgctggtcactatcatcacacagcctcactcaggaggcccctggccccgttctgcctggagtgttggcaggtggcaagggttgtaagctcctgcccagtcccgtgggcagttctaggatcttacccccagcccctgcgattctgaggggacgtgtcagtcattcagcctccagccagtccctggggatgtctgagggaggaagtaaggctcaagtcccctgaagtgggcagctcctgtcatccacagctgctgcttgttagtgggagccctggggccctgggtaaatgtcctgccagagctgggctcactctggcctcctttgtatacctgggggcaaggtttagctattcagcaagggctgttttaaaaaattgggttggttctggatattataatacctttttataaaagaccacgaagaaaactacattttcttggtgacttttacaataggagcaagttaaattttctttcttcactgagttgtcattgttgccttttttttaaaatcagtttttccctgtcaaaagaaagtaccttaccatgtgatctactgaaatataggagttacactgaacgaagtgaaaatgaagcttgtttgtcagtccttcctgctgactttctcaatctgggcccagtgtaccctgggaggcacagccagagcccagggagtgaatccgattgttcagtagatgcagttccccagttcaggccctgcaactaccagtccaggcctggaggggagcatgcatcccccaggaacatgactcggagctggaatctgactaggcataggagttaattgggcctgaggcagggagggtgctgggaagaacattctagggagagcagacagcatgtatgcatgcacacatgttctgtggcagaagactgtgtgagtgtttggggaggtatgagtgactctgaaagggtttttcccagtggagcacaaagatgcccgtgttgtgggaggaagcccaaggtgggaccaggcagggctcattaaagggatttttgtctttaaatgaagagcaccaggaaagcctctgaggattttaaacatggtggttgcagtcgggcagatcagcttggcaaagatttgatgactagggtattagtctgttctcatgctgctaatacagacatatctaggactgggtaatttataaaggaaagaagtttaatggactccacagttccacatggctggggaggcctcacaatcatggcggaaggcaaaggagaagcaaaggcatgtcttacatggcagcaggcaagagagagcttgtgcagggaaactcccatttataaaaccatccaatatcgtgagacttactaccatgaaaacagtaggggggaaccacccacatgattcaattatctccatctggccccacccttgacatgtggagattattacaattcaaggtgagatttgggtggggacacagccaaaccatatcaactagcatggagaggccagtgtggagtttagggtaccaggtggaaggccccctgaggttggggagggtggtgcagggcagcaggtggcagccaggcccttggaggtccattggcaggactgagcagcagggtgttggagtgacatgcaggtgggggtacagtcctcttcattcttattcacatcttttctgttgatccctttccatctctttccccactagtttcctgtgttcttttgatccacaagctccacatttcctgaaagaaatgaatgccattattatcacatacagccacacacacaccctgtacaaactcatctcccacaacgcccaactccctaacatggttgcctaaatcagaattaagctccctggattcaggtcccagtcccacccttaatgtgcttgtgaatctcaatgaggtgcttggcctttcttggctgggtttcctcatctgtgaaatgggggattttgcactgttttatttttctactttttgccagccttgcaactttccataggactttgcttcatctagactgttggtgtaggaaaacatccttttggttaatggatagatgttataggctaggtgccttccctccaggaggttcctcatcttattagtgaagattctgtagttgcatatggctttagttgctgttgagaaacctacccagactggcttcaccatcaaaggtatttattgactgacaccgttttgtgattagtccagggggagtttggcttcaggcccattgaccacagggtctaattatactgttcaccattgcttctcgtccctctcactgcctggttctctgctggcctgctgtgaggccacatttccttctcctctgttcccccaggctccagccattttgaggaaggaggtgagtttctctttcctattagtgaagaataccaaagctgtaggaatcatatcttactggcctggaggtggtcagcttctttaaaatcacatggcctgattgggcaaggggtaggtcccttgagggaaatcaaggtgctgaaccagaaaaggtggtgatggcaattgggtaggaaaaaataagtccatctcagagtctttaaaaaacatctttaaaatctcctcgtgatttcttaatcagcaagagggtggcttaatctgtttatcccagaggccagggatggagggtcagggaggggttgaccttctggggctgatgatagcatttgtttttcttcccagtccaggcttacgctgaccttggtacttaaggcagggcctgtcctttcctctgctcagcaacatccatcactgccatgtccttttggcactaattaaagaggacacacttggattaggaaaatgatggattgggttgatgtgatttgatgtgaggtggagtgaataagtgacaagctcgcccttagagaaaccacctcggagtagccacaggcagcctgtgtcccccataggagggactgggacagcttggcaaccacctaccccagaacacctgctaggaggagagagtcctgttgttccggcttgggaatgtctgtgtttacatgatgaggctgggaatataggcatcgaagcatcagtttcctttgctccatctagatcagcgttgttgatggatgagtatggtaaagagttggatgattttcccccagagtttccatgctggacaattgtttatttacttgagctaattactgaaatttttttccatgacttggcctaatataaaaaaagacactaatgagagtgaggttttatggtaagcaaattgaaaagcaaatagcaaataactcatctatgaaatagttataagaaaagttattatggtaatggttagggcaaaacaactctatttaattcttgatgcttatggagattccagccaagatatgtgtattttccttaaaaagatttctttaaagcatgtgtcttaatttaatcctgttatacacaggcacatctattaatgaagtaaattcaacaaagagttaattataaatagcagcaacatgttttctttctttaaatattgtatatatttcatgttgtaactcgggggataaattatactaggtggattttgtggtaatataaaggacggttggaattttattgagtatttacttttatttggttttgaagaagagcttctccatacctcagactatcaaaaatcattctgttagagtcacagaaattccaattaagagcttagatgccaatacagactgattattttgaagacttttttcagttcatgactcagttaatattcagtggtgtattttctgtagtttaaaagtatcactgataagttgggagtatgccttccatatgagatacaaattgtccctaaccactcaatcaatgtttactttacatgttaaaaataagaaactaagacctcataatgtggttttaaaggttcctgttttttgccctgaaggtccaaaggtaaatttggcacatttgtcaaaatatagatgaataatttatagatgtgcatccattttatttttataagtatggaaatagatataaagggatttgctggaagaatttcttttggcaaatgagcaaaaaatttaactataaagaatgaaatactaggctctagatataaaataatattcacaatgcaatacaaaatgtgcaggcatttttggtcatattttctatgacaggtttcttagaaatctgtgtttctactatgaaacacatgaaacaaagaaatatttatacatcagcagaactataaattcaaaaattcagagaaaattccaaatgggtgtgatgttgatacttgcatttttctctaaaattaataaggtatgtgtgtatatatctgcatatacctatgattcatgtaaagggttgcagatacaaagattctaagttcataggtataagaataaatatatgaagctgtatcctgtcttttgcattatattgattgttctcgttggggggagggcgttaattttaaaaagtcaagtgaaagtaaattttcccatcaaaggaaggcactattgctttcaaacatcatcatattcaatacaaattaaaacaatgaactactgtatctacccatcagactagcaaaaatcaaagcatataacaatggcaagtgttgccaaaggatggagacctgctgatgttagtgtaaatgggtgtgaccgctttggagagcaatatgacctatcccgttgagctggggacactatgactcagcaatgcttctccaggccttttccctggagaaaatcacatttgtaagtggcaagagaattatccaggaatgttttccaatgcgttgatagcaaaaaaaaaaaaaaaaaaaaagtctcaggggttgggggtggtgggacagaccgttgatagtggaatgagaaatcgtaaacaagaaggatctacccagaagttgccctagttgttacctctgcagtgtggcagggttgggggctatgatagggcttctgaggtgactgtggaggcttacatttgatctataatgttttgtttttttcttgtgtcttttaacaaaaagaaaacctgatttaagcaagatgtcaagatgttaatctttgttaattctggctgttgaatgcatgaatgttgtgtgtgtgtgtgttgaaactgttaaaaaaaaatcatctttgggttgaccatggtggtgtacacctgtaatcccagcactttaggaggccaaggtgggagaatcatttgaatcaggagttcgaggctgcagtgagctatgattgcaccactgcccttcagcctgggtgagagtgagactttgtctaaagtaaaaaatgtaaatgaataaatacatcctcccattacattacattttctaaagtagcgtaacttttcatgtcagaaactagaataaattaagtcactgaatcatgtagtaaattatgaactattgcctctatagttggttgccaaaatggcctgccagtgtctattaatcaatataaaatataaaaatagaacatttaaaaattaaagcatcatgttatattgccattaccagctagccatatgaaccttatggaaggaaatctggctatatttagcaaaattacataaatagtccccctttggaccagtaatcccacttctaggaatctatcccaaaatatcttggcaaatggtaaaatagcacacaggcaatggtatttgttttgccattattcattatagcaaagtgttggaaacaatgcacatatcacgaagagtggactggctggataaataatggcatagccagacaaaggggtatcggaagacaataaaagaaatgagcgtgttctctctactcacatggaagtcatctccaggatatatcatagtattcattagtcagagttttccagagaaacccaaccaacaggatctttttggtaggtaggtaggtaggtaggtaggtaggtaggtaggtaggtaggtaggtagatagacggatagatatggagatacatacagatataaaaggagatttattatgaggaattgactcaagtgattatgaaggctgagaagttctacaatctgctgtctgcaagatggagctccaggaaagctgatggtgtaattctagtctgagtctgaaggcctgagaaccaggggaactggtaatgtaacttccagtctaagggcaggagaaggtccctatgctagctcaagcaggcagacaggaaggaaaaaaggctgacttcctcctttatctacctttttgttctattcaggcctctatcaggtcggatgttgctcactcacatgagggaaggcatgtgctttactgagttcaccaattcaaatgctagtctctgatagatgtggtggctcacacctgtaatcccagcactttggggtgggggcacctagcagggaggatcacttgaggccaggagttccagactagcctgggaaacataacaagaccccatctctgaaaaacaaaagtaaaaaattagctgggcatggtggcacacacttgtctgtagtgccagctactcaggaggctgaggcaggaggatccattgagccctaaagttcaaggctgtagtgaggtatgattgcactttgtgccactgcactccagcctgggcaacagagtgagaccttatctcttaaaataaaaaatgctaatctcatcaaaattagcattaatctactctataatttccattagattcttttaaataattagataatttctgtctctttattgacattatctgtcatcataccttctctttcctctttaagagtgtacattttttcatcgagattagcattttttaagatctggaaatacccttgtagacacgtccacaatccataatatcatttaatctggaaacctgtggccagattgacacataaaattaacatcacaatcattgagtgaaaaaaaaatcgggatatttttatagaatactgcctttcatgtaaaaaagagatgtgttcacgtgtgcattttcatgtgtgtgtgtacttagattgtttaaaataaatgctgggagtaaaaagcgagcactaacggttgcctatagtggaggaagtaacagaggggagggcagaaatagaagtgagacttctatgagtgtactttgttatatgattctgaattttaaagtgtgtaaatatttttacatattcaaaaaattaaaagggaaaatattcttataattgaagacagatggaaataattgaacctaactatatatcaagttggtagcttaacccgagaaagtaattttttttttttttttgagatggagtcttgctctggcacccaggctggagtgcagtggcaccatctctgctcactgcaaccttcgcctcccgggttcaagcgattttcctgtctcagccttctaagtagctgggattagaggtgcttgccaccatgcctggttaatttttgtaattttaatagagacggggtttcactatgttggtcaggctggtctcgaactcctgatcctgtgatccacctgccttggcctcccaaaagtgctaggattacaggcgtgagccactgcactcggctgtgagaaagtaatttctttaagtaacactaaaacccagtattttaactgtatatccatagtggggtggaatttaaggatgctagcatatgtaaataaaaagaatcatatatttcatgattagtgttattattagctgtaatatggatgttattattttgaaattataggactaacttggagaaagcaattaagcaatatgttaatgttgttatgaatcaagattcttattatgaaagaaaagagataaggtataatattttttaaagttatctgaaatcctaaaatcttacatttaaattagaaatattaatattcatgatattctttgctcttaaaatatctatttcataactctgtctactgaaaaagcctaaaagcagtgaaaaccctatagcaacgaacgctttctacacccagattttgtgtactaaataccattccccactaaaacgaagcagagttccttggagaagtgactgcttcctggtctaggatactttattatgccagaaagcaaataagctatcaaaggttaatgagatgattgcaaaagaattgaatgattttctgctggctaagaggaattgcttaatacatttccaacaggataatgactagaattgattgaaacacatcagaattataaaaatctgtgccttcagatggtacttcaaaaaataattggtcaccgttgtatattgctagaacaccagctctctattctgaaagttgctaaaaaaggaataagaaacaagcttttattctgccttcctgttttatttatatttcagggtaaccaaatagctgatgattgaacgtcttctttatagaaaaattttaattaataaatgcaaaaggaaagaatgagaaaattaccatttgacaacccaaatgaaataacaggtgtaggcaattattatcaataggtgttaacagcattaggtaactatcaatggggaattttataatggataaatcaggctgatataacctgaatgtactgatctcattttacctctctaaaggtaggacaaccagaagttatatgcctcctaatatgtaattggaaatataaaccactgcctctaaaggattctttcctaaaaaattaagcctgaatgtgaccaagcttttaaattttactaccagttttcaggaaatatggaggctaaaggaacgtgttaacaaattgaccagcttctcaaataaaatatggaaaagtcacatcactccagaaattttcccagtttactcttcgagccaattcctccttagctcacagagacaattactttccatagatctgtcaccatagattatcacataagtgcagtcatacagttggcatttgtgtgtgtgtgtctggattccttcactgaacataatattttagaaattcattcagtgtgtgtatgtgtgtgtgtgtatgtgttggtttctttgttttattgagtacttcattgcatgaatatcccataatttgtccagtctctcgttgcatatttgtgttttttccattttctggctgatgtaaataaagcttctgtgaggattcttgtacaagtccttttgcggatctatgtttttattttaattgtgtaaattataaaagtgaaattgctggaacatagggtaggtttatgtttaaaaagaacttccaaatagttctaagtggcatgagttctagttgcttcacacctttttcaaaagtgagtgttatctttcatttaattttcccagtcaggctgatatgaaatggtatctcattatggtttttaaatttttttatatatagctttattgagatacaattcacatactatacacttcacacttttgaaatgtaaactttaattgttttaaatatctttccagagttgtgcaactatcatcacaattggtagtctttggctttctaggagtttgtccatttcatctgagttactaatttattggcatgcagttatttatagtattcccttataatttatttctgtgatattggtagtgttggccccttttacactcttgattttagtaatttgagtcttctctctctcttctttatcagtctagctaaagatttataagtttattgatccttcaaagaaccaactctttattttattgattttctctgttgtttttctattctctatttcattaatttctgccctagcctttaattccttccttctgaatgttccaggcttagtttgttcttctttttctactcttttcgagtggaggatttggcttttattttgagatttttcttttaaatataggaatttagagctataggcttctatttaagcatttctgtgactctgtttcataaattttgcttcattgtttcttcattttcattcatctcaaagtactttctaatctcactcatgatttattctttgactcattggttatttagggccatattgtttaatttccatatgtttgtgaatcccctaagtttctttctgttattgctttctaatttcattccattgtggtcagaaattatactttttatgatttcaattattttgaatttattgtggtttgttttatggcccagcctatgatctgtcctggagaatgtcccatgtgcatttgagaatgtgtattctgctgtttctgggtaaagtgttctatagatgtctgtcatatggtatatagttcatttatactgttgttcatcttttcttttttctccttaatcttctgcccacttattctattcatgagtgaaagtgggatattgaagtctccgatttttattattgagttattttccctttaactctatcaatatttgcttcatatattttgggggtcttatattaggtacatatatatttatcatttttatgcctccctgatggattgactctttcatcactgtttcaccatcatctctctatatctatatctctagttttagagtagctttatctgatattggaatagccactctagcttttgtatgattgctgtttgcatgctatatctttttccattctttacttcaaactgtttgtatctttgaatctaaagtgttttctcttgtagctagcatatagtagtatcagatttttattcagtctgacagtctttacttttgttggattgtctaatccattcacatttattgttataatggatatagttagatttgcatctaccattttatttttcattttctatatctctcatgccttttttgttcctctatttttcctttactgctttatttggccttaaatgagtatttttagtgtaacattttaatttctttaatcattttttaaaaatttattttcttagtggttgctgtggggattaccatatacatcttaacttatcagaattcttcagattcatactaacttaatttcagttagatatagaaacattactcctgaatagcatgattttttcttctacctcatttttgcgctataattttatacatattacatctatatgctacaaactttacaatacattgttacaattaattattactttatatgaatttatgtctttcaaggaagctgagaaaataaagagcaagtgctcatttacagagtctgttatcttaaccttttaatttaccatttccggttctcttcatttgttcttgtggattcaagttactgtcttgtgtcattttcttactccaattcatctttgctcccatatacttcctttgcgttattgtcaaacattttacatttctgtatgttataggcacaatgatagaagtgtgttgtgtgtgtgtgtgtgtgtgtgtgtgtttgtgtgttattttatgcaattgtttattaaatcagtgaacagaataaagcagaggaaatatgcattcaggctgtctttcataattacatcattacctttactggagctccttgttttgtgtgtgtgtaaatttgaattactgtttggtgtcacttgatttcagcctcaaaactttcctagcttttcttatatggcagatcttttagcaatacattatcctattttatttatctatgaatgtcttgaattcactttcatttttgaaagatacttttgctgggcataacattcttggttaacagttgttttattttctccttcagcactttgaatatatttcatcccactgccttttggactccattacttctgatagaagtctgctgttaatcctattgaggcatccttgcagtgactagtcagttttctcttgctattttcatgatttttctctttgttgtttctcaacattttgatttttatgtgcttgggtgcaggtctctttgcatttatactatttagaatttgttgagtacctgggatgtatagattagggttttttcgcactaaatttggtaggctttagccattatttctttgaaaaaaatttctgcttctttttcactcttctcttattctggtactcccattatacatatgttggtccacttaatggtgtctacaatttactaagcctatgttcattttacttcattctttccctctgctcttcagattgaataatctctgactgtcttcaagttcaatgattcttttttctaccaattcaacaaagccactgttgatcccctctagtgaattttgaactttaattattataattttctactgtataatttacattagattattttaaataatttctatctctttattgacattatctatttgccaacataccttctctttcctctttaacagtgtacatatttataatattttggacatatttataatagttactttgaaatctttctaagtctgacacctgggccctttcataggcagcttcttttgaatgcttttttttaaatgtatttgttgcactttcctgtgtttttatacatactagatttttttcaaagctggacgttttagtagataatatattttagcaactctggatacttgttttcttttcctctgagcttgccattgttgtttgtttatgtgttttgtgacaggaataggctattttagtgtttatttctacccacagtgtggagcctttggtgttacttttctgacgctgcagccttgggagtgtgcacagtcaccttgagatgatagtagttttagcatgtgtctctttgacttctctcttctgcctccttccttaatctccctgttaatctgtctgcctctgttggtatcataccaagctattaggctccactaactgccaaattattgctccattatttttgacaatgtccagggcgcatgcattcctctacaacctgatccagttaaatttgaacccctttgcaaaggtattttttgaggtcagtctttgaggtttgaccaagagggctcttcttagctgtcttgctctgatcctctctgataaactatctggcctacaatttagcttgttgccatcatggagctgtcagccttctatacctgttttcatgcttacttgtcttttttttttttttttctctgcctattctgtcattaagaccatctaatgaatgttttaaatgataatatatttttcattatagcatttccatttggatatctattgcagtttccatgtggttcattttaaaaatctcttcatacatgtttacctttcacacactatttttaaaaactgctatcacgattatttcaaagttgtgtgataatttcaatagctgggctatttatgaatcttcttctattgtctgtttcctctttttgatcacaaatcaaatgttcttgcttcttcaggcatcatagtttatactacatgtcaggcattctgtgtcaaataacagcacattctttttctttccacttatcagagttggaacactgagtcagtcgtacctgtagatcagctgggtctgggactttttttttttttttttttttttgagacagtctcgctctgtcaccaggctggagtccagttgtgcaatctcagctgactgcaacctctgcctcctggattcaagtgattctcctgcctcagcctcccaagtagctgggactacaggcacgcaccaccatgcccagctactttttgtatttttagtagagacagggtttcaccatattggctaggatgatctggatctcttgacctcatgatttgcctgcctcagcctcccaaagtgctgggattacaggtgtgagccaccgcaactggccgggtctggagctttttgtagctttagtttcattccatgtattaccagcttcgagtgcttagagggaagggtcaggatttttcccttaccatagcttaggctctgagcactgagtggtttctttgtactttatatctgcagtactagctttctgaaccttggagtgctttgaccatgccacagcccggccagcagatgcaggggtcacagagagctacgtttgttttctagtcccactggagtgctccctctgccctgctactcagactttgtagggcatctgtcctgccctcagtaaagacttgcaatgccctggagaggtttctcccagctgtcttccctgcccccagccttcaataattgaatgtccggagttcccaggatagatttctcttgagtttcctccttagccccccactttcagaggacactgccttttacttaggtgaggccccacatatctctggggttcttgcaggtttcttgctttacctccaggaagacctgtacaaaacagtatccagtggttaaaaactcactctgggctgggcgcagtggctcacgcctgtaatcccagcactttgggaggctgaggtgggcagatcacgaggtcagaagatcgagatcatcctggctaacatggtgaaaccccgtctctactaaaaatacaaaaaattagccgggcatggtggcggatgcctgtagtcccagctactctggaggctgaggcaggagaatggcgtgaatccgggaggcggagcttgcagtgagccgagattgcgccactgcactccagcctgggggacagcgagactccgtctcaaaaaacaaacaaacaaacaaaaaactcactctgtggcttgggcttcttcacattctaatctgtcatctggccaccagaatttcattaaagtatcagcaagtttctccttcctccaatctatggcaattccctgttattgcactactgtcaggggtgaaagcagtcagctggcaaatgccttaaatagtgttttctatcacttcatctccataatctggatttcatacaaaagttagtcatatataaacactgagtatctacagcaagaacatcattctcttggagagccagaaagtgagttgttttatgaaacatttctaatttagtcaattttccaaaaatagggaaattatacaatagtcattgcctttgcctatgaaaagtagaaagaagggaaatcaggagaccattgcttcatctgtgggaaacactttctatttgtccttacatatattctttgtttttccataattctgagggataaggaagagaatgtggcagcctgaatgtctgtttgactgtatctcttcacactgtgattctcattttcctaatgtctgtttcagaattttaaagtgggcagtggattatgccagtttctagatcctcctattaccttccagggaaaggaaaattggattcgattctaggggcatgattagcagaagggcacgcccgggtaccgtgactttgttctgaattaaggaagtttgagtaagagaaagcactttttcctgctggactgggctgcttgttgatggctgtgccgttaggagtgtggagcaggatggtgtttcagacagaggtcctgagcaggagagagcaggatgtatggaccaacgacaggcccatgagtctggaaggtggggaaggggggagcatgcacgttgctaatggagagagcacgtctcagaggctgcatcctggcggctttgtggtcatttgttataacagccctaggagactcacatactctccttcaccctctcacagccattccctgtgagaaccagacagagtggctgagttcatcctgatactcaatggacaatggacaggaccccctttttaggacttggttcttcagccccatggcacaatgtgtaccagcaaatgggtttggccaggtcctcttaaacaagcttcaaaattgtccaacttggacttccacagggcttctttctgtggccagagatgccaatacatgtgattttctgcatgcatgtggtcttggctccttggactccaggttggccacgcagcgacagacctgcctctcggtgggagttctcaggaagtcaaatcagatggaaacctgatctgtgtgcacgactggcttcggcagttaggtggtgtgaaaaatgaaatttctactggcttctcttgtccacagggtgaccgctagtggcagggctgcttgctgcggctcctaatctccttgtgggatgccttgggttggatcagtttctcttggcccctgtgaaaggaactcgcggtggaatattgtattcggtgctgcacaggagaccccatttagagacaggaaacttgtgcttgaagggcactctttgtgcagctacagacgattcattcattccttcatttattctgtcaccccaaatctgtctgcatctactgtgttccaggcaccgcacagggcactaggattctggtggtgaacaagaggccggtctcaccctcaaaggcatgtagtcttgagagacacagacactagacaaggaatgacacatgggtgtatgtgaagatgcttaggatatggtgggggcatttagcagggagatttgacccagcttggggtggggtgggggacacagaggcggattctatgaggaagcagcctttaccctgagacctgcagtgggggagcattccctagatgaggaatgagaggtggagaggaatgtggagcaggatggtgtttcagacaggggtcctgagcaggagagagcaggatgtatggaccaacgaaaggcccatgagtctggaaggtggggaagggggaagcatgcacgttgctaatggagacagcacgtctcagaggctgcatcctggtggctttgtagctttgtgaagaaagtgggattttatccttaaaacgaaagggaagaagttggagctgttaagtagggagtgacatgatttgattgcttttttaagagagccctctggaggaaaaggggctggagggggcagggggtacagggcacggtggccgtttctgcaatcgctgaggcaggaggtgctgggggccagtcctgggctggaaatggggagtgggtgagggaactggactaacccagagtgttgcatgaggtgacattcatgccacatggtgacggacttcacagggagggtgaaggagagtatgtgagtctcctagggctgctataacaaatgaccacaaactggggggctttaaaccatggagatgtgttccctcgcagttcacggctctgcaggccagaggtctgaagtcaaggcatcagtagggctgaaacctgcccttgaaagtttctggggcaggatgcccctgggcctctctagcgtctgggggctgcaagccctgcttggctgcagccgtgtcaccgcagcctctgggcgccttcacgtggcctttactgtgcatgtctctgcacatcctctcctcctcttagaatgacacagtcattgggtttaggacccaccataggctagcatggtctcattttaacgaatgacatctgcaaaaatcctacttctaggcaaggttctgggtagacatgaatcttggcaggggaactattcaacctgctacagagagggaggcggatttgctaaggatggctccggctggctgtagcaactgggtggagacgtggaggacagaccgacgccagcagaaggacatcagggccactgaaccagaaacacacatggacgtgtgagtaagtgaggtgaccagacctagtgaggcccccagttcttttcaggttttttgtttgtttttaacaaatgagactgaaaatgtttcggttcactcttacttagtgaaagccgttcttgtgaagctgacatgtagtccagcgacagtgactcaggttagtaagggtgtgtgcttttcatggcgtgtcgacaccaagccctcacgcagagcaggctgactgacgatgccgcgtgcaggaggttccctggctctggggccggctgacctgggctgtcacctcagtgctgctgctttcgagctgtgtggccttgaggagggttctgggcttctctgagctgaagttatttccttgtgcaacggagatgaaaacacttgggaacaaggctgtggaaagacttatagcatggttgcacgtgcttggcaaagaaccagtctgtttagcttgcttgtttattttactgaaggcattatgtataacgattatattgtatattctaccaaacataccaacaagagtgtccaagatgttgatgcatattgaaacgtccatgttactctttagcataatttattgacaactgcttgttttcttgtgattctccctttttcctaaacacttatgagagaaaagccacacttaactgtaagttcttacttattaaggatagtctttatttagtagactgggaaagtggtggtagatggataagtaattaacaaatggataagaaaaatagtaggcttccccacaggaaggagataaggctgtgaacaatccacaaaaggagtgagtgtaaggactttttaattttgagagatattggatacatagttgttatctttctgttttcaaattcccccagcaacccacctccatggccatatccttgttccttgcatcaagcagaatggctcttcctccaaagtgaaccttgggcagcctactctggttacagtcctgcctgccaccgcctccttgtgaccttgtcctcccgccctcctggaggctcctccagggctgcttctcgtagccgtttcctggtgtggcttcagccacttgctgaccctgtctgggtccccaggatcatgcttggcttcactccccattggaccacagccttgaccttctcctacacctcccttcccaactccagacatccccctcctgatcccgggagccagtgcctcactgctggcagaaatcacataaccaagcttcaatacattttccacagccttggcaaaggccaaagggctgcttgccaatccttttgtgtatctcagtgtggcaaagttgttaagaccgtggttcaagtctcacctccacccctcactggaggcaccatacgtcttctgccaacctgccagatgccgcctttcacaagtcagcccctgaaatctgacattgtctgtgaagccttctgtctgattcatcagacgaaagtgaatacccgtgcggtatccattgcgggctgggtgcaggattctcctggacctttctgtgatctcaaccctctcgctggaattaggcacttgctcttgtctccttccctaatagtatactatgcttactttgcacctgatttatttggttttattttataatcaaatcaaataatttattccaagtagtctaaattgaagttttattttcaaaactacaggcataagcagtctttcagtagaatacccactgtagaaaaacttccttaacggttccccttgtgttgcagattttcaaggcttcaccattttcagtgtgattactaatatagcaggaaatccttcaagtatgtggctctctctctacctaggattctttctccaggacagattctcagacacgaatgtctgcagttaaatgccctgtgcttcttgagaaatgatgcagaattgccatttggaagggtcgtgctgacttgtgatgccaccaaagatactcaaaggtgtttgatttcactgcacctctgtgagaattgggaaatgggacagaacatcatctggggatacttaaagaacccgaaggtccttagcaccttgctcaagccaagtaaaatgaatttttcatattacgattttttttttccagcagattttaagctatctacttgggggcagaaataagaaaaagcagatggtaggggcaatgaggttgtggtggagttcgagggagtgattgaatcttgggtgctggttggaaatactgcccatgggggtctgggttgaattggatggaaacaacacttggagaagcctgcagaggggctgagaggggagggagagcctgtgtggactggaggctcaggagatgaagggcgagaggattgggtgcacgctgggactcagaggcttacattcttatgtgtggggagtacagaacccgccacaagctaactctatgttggccatgtttatggttatcagaagtggggttggcgttgaggacatcaaagcttcatgatgccaggggactgcaagagtcccctccgtgggcattgggcaacccaggagatggctaaggagactgaagccagctgctgggcactagtggtttgagtgaggaggaagagaccagagaggactggggcccaggggctgggacttagtggtggagggggctgtgaaggtctgtccagcttccatctgcctgttgtgcatgccttgcagggaggcatggcggcctgagctctctcctcacttggactttctgtggctgaggcagaaataaacagagatggacatcaatatgctggtgtgtgaaggcaccccatggggttagctccaggcagacctaggcattgtgtcctgccatctcctccctgcgccacatctcctgttcagctctatgcaagccacggccccacatgccctgtgagtctgccctctcccaccctgcctaaaccaggccactggtctattttacagaaagatagggttggacatagcatcaggggtcacttgaaagtcacagggctggaatgtcaggtggattcagggcctggggccaccattctgtgacagctgagctgtgggcacattgagctgtgggcaggtggagcagaaggagctcaatttcagaggaagagagagacagagacagaggtagagagagagagacaaagagagacagagacagagagacagggagagagagaaaggaagagaaagatggagagagacagagacagaggaagaaagagagagagagacaaagacagagagatagagaaacagggagagagagagagatagaaagagagtgacatttagagagacagagagagggagagagacctgatttccacatgcagactgaagcaggggcgggagcccactcccggagaggaaggggacatgcagggcaggctcgcggtccaggtcctgagatccagagaagtcccatcacgccccttctgatcaaactggtctgagtgggcttctggtccttacacggtgtaatctttaaaacagtaactgttattattatcacatgaaactgcagcacttccctttcattacctttgagggtcgtttattgaccaacagagagacccatgcttggggagcaacgtccaaggtgcccagcagaggcacagcagtgctgacagtcctgacaagtaacgtgggacacagaccacctggagatctcagcctggaggtgcctcagttgctcagggtgatgagattctattttaagttcccaggttgtcatttaaacctctctcttctgtcttgggatgggctaatggtgagatgaggtgatcgcagggcatgaggcaggggaggttgaggtaataacatcagaagtaaaagtaaaaaatcaaccaaccctctagcccagtgggcgtggctggcccaatgagctgtggggctcccacaataggagtataagcagcaggccctgccacctgggctgctttgccacagggcatttgctccagtgtactctgcctcccaactagcccgtctcattgtctcatttattgacttctcccacttgccttttcatgcatgtgacttgaagacccttggtctaagctgtgaatcctgaacacatgaggccttgtgatagatgcccctaaacatcacaggaaacaaagcagggacaccctcgccatgtaaattcagcttttctgattacaagacagaagggatttttctgactttcccctgtctccagaaattcatgcagaatcctgatttcatcacaactcaccagattttccttccaggccagcctgcctctggggcttaggttttagaccagagcgggtggaaatacagaggtggctccattgccaaggaagtcctgaaaggcttcctgtcctgcttcctttctcttgtgctgtggatggcctttctgtctaagcagatgtgtgtcacgagaaggggcaggtgtgtgtgatggccattcaggcactgctcatgcttccgagttaaaacctcctacttaatcactggctggaaataagcagtgaattctgcagggcgagccacaagggcagtgctaggaaagtcgctgtccttcctagaaccacagttgcttttgttagttttgtaaaggtgagtgtatacacctgtaccgaggcagaggtgggcatgtacacctgtacacagatagaggtgggcacatacacctgtacggacttagaggtgggcacatacacctgtatggggttagagatggacacgtatgcctgtacgggcttagaggtgggcacatacacctgtacggggttagaggtgggcacgtacgcctgtacagggttagaggtggacatgtatgcctgtacatggttagaggtgggcacatactcctgtatggggttagaggtgggcacgtacacctgtacggggttagaggtggacatatacgcctgtacatggttagaggtgggcacgtacgcctgtatgggcttagaggtgggcacgtacacccgtacggggttagaggtggacatgtacacctgtacataggctccaggctcttcctcctgcaacagtgagctgcctcgtttgggtcattggcctttctcacagtttgcaggggttgtgcagatacagctccttgctcagatgtcatttcaatttgtttcctgggaacaaagctctccaccatttaagatacatctcttttctctatgggaccctttgtccatattaggccaggtcctctcaaagctccttccagttaggcagttcaggaaatgacatgtgccttagatgacaattcaacagaacaattcaatgcctaagtttttaaaaaattattacttacttatgagccagagtttctttcttgttgcctaggctggagtgcaatggcatgatctcggctcactgcaactccgcctcctgggttcaagaggttctcctgcctcagcctcccaagtagctggaactacaggtgcccgtcaccacacacagctaatttttttattttattttattttattttattttattttattttattttattttgtatttttagtagagacagggtttcaccatgtcggccaggctggtcttgaactcctgaccttaaatgatcctcccaccttggcctcccaaagtgttgggattacaggtgtgaaccactgcgcccggcccaaagcctaagttttagtataagactgatgtgtcttcagatgctgcctctgccatttgcatgctgtgtgacttcagcctggcagctcaacctatctgagcctcagtttctgcagctgtaaaatggggaccagaactgtctctactccctagggttggagggagagccctcagtgtgacccccggtgtggagtagggagggtttcagcactgaggagttttctcagcattccctgtctcaagactgtgttaactactgaagatggggtcaattactgacccctggggacttaaaataatcagtgccgcttttcctcattgcctaatttattatactcaagaagtggcctccaaatgaggaaaacctgatccatggccaagctgccttgaaagttttctttcaattcttttggtaacagctgtattgagagataattcacatatcgtgcagctcacccattggcagtgtactgttcaatggttttgagtatgtgagcagtgttttgcaaccatcattgtggtgaaatttagaatattttcttctcctctaaagagaaccctgtgtccattaggaatcacttccattttcctttcccccggcccctggccacctgtaacccgctttctgtttctttagatttgcctattctggacacttcatagaaatggaatcacatgacatgtggcggttatgactggcttccttcatttggcatcatgttttcgaagctcatccgtgttgtagcatgtgtcagccctccattcctttttatgacagaatgatattccactgtctggatacatcacactttgtttccccattcatcaattgagggacgtttgtgttgtttctattaattgttttaacctaaattgcctttcacaacgttcttgttttgatgtaactgtctgcttatcaattgtagagttcattaattcatctctctatgtgcccagtgaatatttattgagtgcccagtaagtcttgggtgctgtgcaaggcattttgatgaatctgtgaactaggcaggtaagactcttgccatcacggaaggtcccattctagtgggggccatttaggtgctgctctttcttctgatctttagtggatgaccaacaacaaatagctattaatacacaccatgatgtcggtgatgacgaatgtggtgggaaatggagctgcctacagggaagaaggagtgatgggtgctgtttcagatgtgggcactgggaagatgtctctctgggcagggcaatgggtgcagagccatggatttcactggtctgggtcaagttcagaaatgggtggactatgatgaacctctgaagacctggagatggggccaccttttgaggcagaaacctctcttttgtcctgtgagaagtctgacttggcctcacagggtgcagtcgtcccctgccctggacaagctcatgtgaatggccagagtgtggacacacatccaccaacctgcattctcaattacgtggaagcctccatgttctctctgcatttgaccttctctggagggtaaatgaggacaggcatctgccgggggtggggggggggggcaggcacttttactgtttccatcctgcaaggtccggggagaccccaggcttttctgtcgttaaggtgtcctagagggagcattcaagcttatgtttgttggacctgtgacagcacgtggtgcttgtgtttacagcctgctccatgttccatcttctactgcacttggctatttacaggtccatagacccagatggtgctgtggtttctgtctccagaacgcctccccagtccggcacttattcccactctcactgccatctcctgggcgttgctcaccagcaccttaaatgttcttgccacttctcctctgcaatctcgtactttctgctcccagaccaagggctagaggcatgctttctgtgctcatgtgcgcatgctttctcagcaaccttgtgaggctgccccaccccctccacagctcctccctggtccaatgggagagagcatttggtttcagagagaaccatgtggttctccttctgtttattctgagcttttttttcttcatttagcatcaattcctgtcatggaaaatcacaggagccaactgaagggggatttccagaatatttggccttccttgggccttggtgaagtggcttccttggcctgggcaagtggggctgtgagcatctgtacattcacaagaaggctgggggtgcggctccatgctgggtgagcctcctctctccttgccggggaagggctagagtaagagtcggtttctccaaagtgatgatgcattctttctcttatgggtctggcttggaagccacagaattcaaaggcagtgctgggaggtggcttagccctcctctgctttagttggtggaaaggaaaggtagaaacctgaggtcaaaaacaggtggcccgtgggcctaggtcagcctgcagacttggttggtttgaacacagtgtttgtgtgtttcattgaaccaacatttaaatgtagggagatttcacaccaatatctggattttctttctggcttggcttgaaatactcagagctcgggtactgctggctattgccaggctagagggttcatgaggatggaattgtccagctgtgatattggctgtctccggggcctgcaccatgcctggtagatgaggtccatccacttaatgaaggaacggactggccatggctcttgccaggctgcgtggctgctgcctgctccaggcaggacctgccttctccagttaggccaagtccttgactacccacgtggagaatccacacctggttcacctcacctacttacctgtgtatccagcctggcctctctaggacatctgcatctggtccttgggagcaaccgtaggcatgaggaatgtgctgaaagggatcctcctttattctgaaatgtggcccatcaggcctcagctagagattcttccctaaggaagtctggagtcccgtggctgtaaccacagctttcagaagcggttctcaaatgtgggcagtttgggcaccgtctggaggcattttcagttgtcgcagctgggaggcatggtgccactggcatctcatgggcagaggccagggatactgctaagtacccccacagtgcccaggacggcccccgccacagagcatcatttagcttcaaatgtcagtattgctgaggctgcgcatccctgcgttggagtcacagtgccctgagtccctgtcccaatgctgcacttgcccttgaccttcctgcctcctcgaacctcagtttcccatctctaaagtggagtgatcctcacatgcacctctctcagctagatggagaggaaacgccatggcctgcatgtagaatcacactcagtggtcggggttgcagctctgatatttggggaggccctagccatgggggctaggatctgggctgtggaatccacctgtgtgactatgggtgggtcgtatgtcctcctgagcctcagtttcctcatctgggcatcaagagaggaatagggcagcctctaaggatgtgaggattaaatggtttaatgtctgcactcggcacatggaacctgataaacgtgcgtgagcagcgccatcctgactcagcggtgtggttctggggtctcctgagacaccactgtgtgcccgacacccagcttgcggcctccttccctccaccatctctctcctcatccacgagtcaggttaatcctcccccttgaccccacacaccgcagcaaagttttaggaagttgcctgtggttgccctttggtgtatggactccagggtggctcctgtggaggtgggaagagccttgggggcttccaggcaagagaggtgagtggggcttagcctaggctgtggtggtggggttggtgaagagggaaggaattggagagaggccctggacacagagcccagaggagttgcctgcaggttggatgtgtctgttacggtgagctgcaagcaatctgagggcaggagggtacctcatctccctcagcgtctctctagtgtgtgaggctgtgtagtttgtggatttgaatagacttggagcttttggggcatcttcctgggacaacctcaatttatttggcatcttctcagagtttatctgtgggcatggcaggagtgaccccagactgggttcagccctctcttcctggctgagcctctttgggtcttagtctgctcatctgtagaatgggaatagaatccttcactctgtggcctgttgttttaagttttcaataagacctggtattggaagcccccatcaaagtgaggagctcatgaagcacaggcgttgggcaccagatgcaggatctcttcctgatggccgagcaatgtggcgctaagcggggtgtctgcggttcgccccgcccaggtcagcagcacgacaaggggcaggccttggattctcttagacctgctcacagcctgggcttctggggccctgaatgtggccagtgctcaggtggttgggagctggcctggcagcacctggggctcccaaacacaagggaagacaggcagctgggatggtgaccctggggaccctgctatcctgtggaggccccaggattccgacttgtacccgggcttgcttggtgctgtcttgggactgtctctgggctgggacagtgagctcttggatgggccctcggctgtcagtgcctcagagctgcagaaggtcagagccaggcctggggtggaccaagtggtatctacacccctcccaaatgtgtccgaactgggtagttttgtgcagctcactctgcctctctgagccttggtttcctcacctgacctgcacagtggaagaggagaagagcctgacaggaaggccggatcaagctggtagggtttcagtgcaggccctggcagagcagccccgaagcttgggaaggccaggaaatcccgcgctggtctccagacctgcctgcccgaggagtcgagcttctgatgaaattcagctgagatttcggttttttgtgctctgtaccctgacaaggggcaggaatcgggagccagcctcggctgtcagtgtcctgggctggttccctcccacctcccgcttaaaggtgtcattagcaagggcaagacgtcttctaacaggtggaaacaacttgtcaagacagcctgtggctgctgcgtttagagacccagagaccctgaatgtggactaacgcccccagaatgttcagaattaatgtgctgccccaggcagtgctggggcggggggcatggctctgactcctgcccttgggtttgccccactctgccctcttccccttctcctgttccttccccttctcctgttcctccttctcctgttccttccccttctcctgtccccccttctcctgttccttccccttctcctgtcctctcttctcctgttcccccttgttctcgttccccttctcctgttcccccttctcctgtccccgcttcttctgtctccccttctgttccctccttctcctattccccgcttctcctgttccccccttctcctgtccccgcttctcctgttccccccttctcctgtccccgcttctcctgttcctctcccttctcctgttccccacttctcctcttcccaccttctcctgttcctgccttctcctgtccccccttctcctgttccccctcctcctgttccccccttctctggttccctccttctcctgttccccctccttctgtttccccccttctcctcttcccaccttctcctgtcccccacttctcctgtttctgccttctcctgccttctcctgttgccccttctcctgtcccccgcttctcctgtctctgccttctcctgccttctcctatccccccttctactgtccccccacttctcctgttcctcccccttctcctgttcctccccttctgttcccccctctcctgttcccccttctcctgttcctccccattctcctccctgttcctcccccttctcctccctgttcctccttttccccctctcttttcctccccttcctattcttttccctcttcccttccccctcctcccctccacttacccctctccctccctattcttttccctcttcccttccccctcctcccctccacttacccctctccctccctgtccttctccctcttcccagctaattgtattgaggctgtaccttgtgataggaactttgggtagctctcttagctcatatcacaccatccctggggaagggtaccccattgtacaggtgggtacacagaagaggggagagatgcccccactacaatgtgctgggagcagaatttggacctggatctgagtccagctcctccatcccctgcaggaaggatctgggctcttggggtgtcagggggcaactacctcttcatagcaaagcttcattcgttaagttcctggttctgggctattgtccctgtctccgaggatcagagaggtgaagtcccctgcctgggttcagatggttatggagtaggggtcctggttcagacccatggctgtctttcttgccagcagcacttctttctttggggtgatttttcccccaggggacactgcagtgcctggagacattctggttgttataactggggtggagggtgcttctggcctctggcatgtagctgtcagggatgcggctaaacctcctgcaatgcacagcacagcccccaccacagagaattgtgtggtcccaaatgtcaccagtgctgaggctgagaaaccctgcaccaggcccctccccagctgaccctatgttcctgcaactaagccagcagtagacatacctgcagcagcaggtgttggtgctacaggtgaccctaggtcctcgacctccccatctgtctgccacctgggcctgggcctgggcccggaataaaaggtgcaccaagggtccctggcttcagcattttttgttttcaggttgcatatcagactccttcttgcctcctgaggtcccttgggacttggctccaggcagcctccctgatctaagacttcagcagccgcctcaggactctgcatggccaaggtcccctctgccccaggtcaccaaggtcattgtggtagggaaggagaagagagggccctaagaaaaactccagtcccactagttcctggaacttgcctaaggccaggagaagttgctgccatcgtgggttctgtatatgggattcaggactttggttcaggtggtttctgccaggctctggccagatgccagcctaggcagtgtcctggcagtgctgagtgacacgtctcgggcacagagaggagtgggcgcctggccctgagcagaggggaggcttgttgggggccagcacttgatccactgagccggaccctcagaccctgggttgccctcctcacccccacccccacctcatctctgcttcctgcaacatctatatttaaaaatgttgacagataataatggtgttcagccccaaaatgcagacaggagcttcctgacaattgcagtgctgcgccgggttggaggttttctcagggagcggagcgagtccccaggagcaagtgagagtgccagggctgtgagggctctttgccaatcttgacctttcagggagatttgagagaaagactccagaagcccgcggggagagcaggggttctggggaagataaagcccttcatccaggatccctctgtgaccataaggtgagttgctttgccccacatctctggtgaggcagagggcagggactctgcttagggagcaggcttcttaaaggcaaagggtttgcaaattctagcagcagcagggccctaagagaatggctttttttttttgttcttgaatcggatgactgcatttggagtctggggtgaggggtgggggctgcccctcttggagccacagatgggtcatttttatgtatcaagggagtcagaccaggatcagccctgggtttctggcacagagtccagaaagagtcacgaaggtcttttgtttgcatgtgaatggtattttaacctattacttctgggctaaaaataaaaattcccctcagatgcctttttgtctgtagattgtaagatcgtttccaggaaataatagattgtcattgatgtgcgttttgactgcatggtgtcctattcttaagccaggttttataaaaattcaaagtagaggaggtttcccacagtggagattgaagccttcatttagtgtcaggaacatatgctccactatcaggagtcattgtccttccgggatctccaccactgaaccctgggtgggagtgtgggagtgggtgagggagaaggcacacttggcttttgtgtggttttacatttggtatcatttgtggacttttggttctgaaaaatggtttgcaagtgaagttggatgtctggagttggggcccaagaaggcgatggagaagtgaattctaattcacagttaatatgggtcatggttaagttcttggaagcaacattggtttccaaaggtgcctgctgcgtttttaagctgcaaggttttatgtttttttgacccagtggaaaatggcgattcaggatcccaaggacttcaggagaggttgtctgaatgctaaaaccccttccctgaaatgcttgctttctttttagaggacaggaaatatgggaaattaacagtccttttgtggagtgtggtttgcgtgttgttctttgaggaggaattacggaattatgtgcgtgtataatgatggtaaccacatacacaatcgaagaataacaagtcagaaaaatccatggtgaggttcattcagaaataatcaagagtgtattgtttaattaaggagaggatcagaggaatgcagtcccagagccaccatttcggttgtcacctaggtgcaactctcagcagaaggaagcattcccaataagatgttctgaaaacgtactgccgttgaatctcacaactttcaccccacaagctgcaataagaggccagtatgaaaatgcgctctttcttccccatacattttcttctgttcctgagccgagcccataggtagcttggcagtttgcaattctctgtctacacggaatagatatagatttttttttcctgtatgttttgggtattaactctttggttgccaagctgttgagccctgagtctatattatacaccttcagcccgtggcttacagggcttcaacacatcgttgttatataatgcagtagttttgcttgtggggtgactgttcatatcgtggatgctcagaaaattctatttttaaagtataaaataccactcttcagagcagcctgctcactcctgcctccctgggagccacacgctttgcaccgtggagttgttggcatgaaggcacatgacatatggatgggagtgcgttcctcctgtctagggcctcttaggacccgaggaatggctggaggcagtttctctccagtcctgaggttgatgatccgaagctcttggtgctgagcctgtgctgctatttttagcttcctttcttccctgcatcttgacataattcgacatgtcgcagctgaatctcatctacttgcagagcttaccgtgttttgtaatctgtgttttgtggggcagaaatagtccttgccagagcatattatatcattattattcagggggaaagttatgatactatcaattaactttagaagatgcaaaacacaattgatcctttgattttctttctactgctaatttcctggctgggagcacctggagggtaggcactcctcctccttctgccggaccagaaggcagcaagcagtggttctcacatcttgggaacctgtatcagaagcacctggaggggctgttacaaaggcaattgcagccccactggcagagtttctgagttagcaggtctgggtggggtgggggggcaagtaatttgcatctctcacaagttcccaggtgatgctgacgccggtccagcactgcactttgaatcacagatggagatcacggcagagggttggtaaatatttagggggtggacgatgcctacatgcagagagccaatttaagaaatatacagatggtggagcaggagattttcagttgttgtgtatcctgtccacgcggttgaagatggacttgattgaaaaagaaattaaagttgaaataaaattagctgactgagaggatggctcctgacagtgtccaatgctgtgatgttatttagggaggatgaagcatcacgactcagacaacttactttgagatggccaacagcacacacagacataaatgaagtgcgtgtacatgcacacacacgaaactcagcaaaatattaactgctgaaacaataggtgttcatattattctaatttcatactatttctatttctaatacttttcttcataacaaacattgtattaacatggcaaacacaataatagggcttaggacagcttttcttgtgtgtgtgcttaatagtaaatcaaggtcacccacatgttcacagctgtgttgctctgggtggcatgggcatcggtactgtattagtccatttttacactgctgataaagacgtacccaagactgggtaatttataaagaaaaagaggcttaatggactcacattaagcctctggggagccctcacaataatggcagaaggtgaaaggcatgtcttacgtggcagcagacaagagataatgaggaccaagtgaaaggggtttccccttataaaaccgtcagatctcatgagacttattcactaccacaagaacagtatgggggagactgcccccatgattcagttacctcctgctgggtccctcccgcaacacgtggaaactataggagctacaattcaagaagagatttgggtggggacacagccaaactgtatcaggcacacgcatcgctttagggagttctcatttccttccattcaacctgatcctttatctgcttgttctttcctcctttcccttccattctctttcactccctcctccctggcttccctctcttctgctctccctccctccttccttcttcctgtccccatctcctgtcttctggtgactctgggtcaaaggaccctggtccagaagggttccgtgtggggatgtgttgtgctgaacccctgttaacctcagtagggaaggtaccaggttcaagaggccaaagaagagacctggagccagcaaacaagacatacagttttattatggacttacatgcagggaagagagtccagtggtggcaggttgaagagaactgtcttaacatacagaaacggtccagtggtggcaggctggacaggagaactgccttaatgttcagaaacggtccagtggtggcaggctggacaacatatccaccttcctacagtctggtggtggcagactgggcaagaaaaccacaactgcaaccgcctgcgaacatcatgcagtttacgcagcattttcatttagcaccctcctcctaacagccctcacctggcaaccttcatgtaacccaagcttgtccaacccaaggcctgtgggacgcatgcagcccaggatggctttgaatgcggcgcaacacaaatttgtaaactttcttaaagtgttatgagatttttttttttagctcatcaactatcattagtgttagcgtattttatgtatggcccaagacaattcttctttttctaatgtggcccaaggaagccaaaagattggacacccctgatagtaacccaaaactcagggcctcaatcccctgtacagcccgtgttccacaggacaggccggaggctcagatgttgtggtagataggaacagatctctgggtgggccactcccggattccctagtttggaacacacattcaggtgcacctgtcatacagggtcattctaagggtatgcttaaaatattgatgtcaggtgtgtttaccctgcaggatgctgtggcatctgcccaggaaaaagttgaattatgccagttattgttttcccagggttttcaggctgcctccttgttttttaaataaagttttattagaacacactcacacccatttacttacacacttctctggctgctttccagcagcatagctgaggcagagaccatagatccacacaactgaaaatatttacttctggcctgttgcagaaaaaatttgcccatgctgatttgtttctgtgggctggctgtcttggagattccacacgtacacacatgtgcacatgtgcatacatactcatactaaggacatgcagcaagacgttaagggttgtggagtctagagtacatgtgattgttcattgtaccattttttttttctactttttcacgtgtccaaaaaatttgtaaaacattttgatgactgtggcagtgaccaccccagggtctctagaggaatgccacaggggtccatcccaggttctgagtcttcaacatttgcctcacccacttggcaggttaatcaaatgggtagatgacacaaatcaataaaagcattaacaaagtgtcccatatattcaagagccaaacagatatctcaacagactgttagggaggctgagtcaacaaggagaagtttaatgttcataagcttcaggtatccagctcagatttacaaagatctttgcccaggtcctgcaaggagcagactttgataggaatcaggcctctgggccaggcatggcggctcacccctgtaatctcagctctttgggaggccgaggtgggtggatcacctgaggtcgggagtttgagaccagcctgaccaacatggtgaaaccctgtctctactaaaaacacaaaattagctgggagtggtggcacatgcctttaatcccagctactcaggaggctgaggcaggagaatcatttgaacccagggggtggaggttgcggtgagcagagatcgtgccattgcaccccagactgggcaacaagagcgaaactctatctcaaaaaaaaaaaaagaaagaaagaaagaaaaaaataatcaggcctcttggctggacgcggtggctcatgcctgtaatcccagcattttgggaggccgaggcaggtggatcacttgaggccaggagttcgaggccagcctggccaacatggcaaaaccccgtctctactaaaaatacaaaaattagctgggtgtggtggcgtgcacctgtagtcccagctactcggcaggctgaggcaggagaatcgctccaacccaggaggcagaggttgcagtgagccaagatcatggtgctgcactccagcctgggcaacagagtgagactctgtctcaaaaacaaaaacaaacaaaacaaaaaaaagggaaagaaatctggcctcttaatggaaccaaagtctgcggggtccctagagtgtgtgcaaactgttccagtcactgggacatcagtgtgcaaagcctcctggagcttgtgtgctagtgggagaggacaatgaacggcacctataaccagtaggggatcgtcctgcatgttagtaataagtgttgtgggaaatgaacaggagaagtagggggaggtaagagaaggtataaatgtggtaggctgtagacatttgagtattacatggagtgtcaggattggcatcattacggaggtgacatttgagcaaagccgtgaaggcggtgaggaagtgagccatgtggatatctgaggcaagagcctttggggcaaagggaaccttcagtgaagacgccccgaataagagccggcctggtgggttccaggaacagggaggaggagcccgtggtggctggagtcacatgagattgctggggagggagacgggagagaagcagggacattgtagggaggggcctctgccagcacttgggcttttgctctgagtgtgacgggtcgggggggacattggagggtttgagatttaattatgattcatcaaataacttgagaacaggctagtgtccaggtggactgaccagcctagcagtcattgctgcaatccaggcgggagatgatgctaactggccacagtgaggttgtggacgtggacacttctagaaggtagaatgatgcagttggctgagggagcagatggggaaacagggacagtggagtttcaagggaggactctcaggttctgtcgtgagtaacagaaggatagagcgttggtcctggcctatgaggggaaggccgtggtggagcaggtttcagggagagagcagttcaattttggctacagtgaatttggagcatctatttgacatccgtgcaaagatgacaaattggcaattggctgcacaactctgtgcttgggagagaggtttgggctgaagctgtgcattcgggaggccgcagctgagcagaagctgaatgtgagctaacgcgctctctccctgacttagtcatttgtctgccacctgtagtctaatttgccaaatactttcttttaaaccaggtcttttttttttttttcaaatttaaactcattttaaaaggatatctatgttgcacttttaagtagaaatccaatattgcttgcctttgataaaaggtaaccataaaataaaacaatgacaacaaaacaacatttagttcaagttaggcatagtctctcactaaggattttgagccagagggtcttatgtattatccaaacacagagatcaacaagtgtcagatgccagggtcgtcataataccaaactaagactctcctcttgaagttcttggaagattggagggaaattggcaagaaattagcttctgttgctttgtcctgggtccacgaatcccttaaagtccccttttaccctgttatgtgcctggcccttggggagatgctgagctgagcagccgttatagtgggtagaagaaggaagcttggggtccagcttgaccctctgctagaggttgggtttgccttaggactatgtattttctgaaaggcaaactgcaatttgcaagaacgcagagaggggcaatggctgtttattctagaacagacttgggggatgagaaccttggaaagaaagggtgggatttttcctgcatggttctaggatgtggccctgcagccagctgggaaggataaaaggatacaagtgggttggtttcacttccctctgggcacaggctttctctctgagaattctcactggggctcatatcttttaaattaagtagtctgctcctgaataatatctttctttggggctgtttctttttcagtttatatattggggtccctttttgacattataggctttcctcaaatgcctggtgagccaggatcgaccttgttcattgcagaatgaagcagcaaagagctggtgtgtgctcacggtgtgtttcagctggtgggttttgtttcaggttgcccaggcctggaggtggccttggtgctgaggggcctttgcagaaccttctctttgtggctggtctggagacaggcaaggatgctcctgtactttttgcctggagatgggagttgtccatgttatctgcaatccaccctaggctgatggtgagggagggagtctgctgtcataggaagcatgtaaacagactcaggcttctctcagcatgagaagggattttggatctctgaggtccttcctactgtggatttgcagtttccctccacaacctcacccgcaggaatccggaagcgcctgatgccttccctgggctgggagcccctagagaggaggatctgctgagctgttatgacatcgtgcccacaactgtgcaggcatttgggagatgctctgaaaatgcccgatgaagggttgtgaggatgaaagaatctgctgctgaacacaaactgctgggctccaggctactgagcccaacttattccatggcccagcatgtcccacggctcagcatgtcctgtggctcagcacgtcccttggcttcccatggctcagcacgtcccgtggctcagctctcactcctttgcttctgcaggtcccttggtctggcgtgtcctccccactcttcctgagttctctgaattctacttgtggctccagggccccctctttcatgaaaccttgactcaccacctccacctctttccccacctcacccaccactgtcctgctcttggggccctgcacccacctcctgctgggcccctgcttctgccctgcagtgctgtggcccccttcctgcccagcagctgggaaggcatcctgaagtgcatatcagatcttgccctgtccctgcctcccattgcctctggaccacagcctctgagatcctgcctgccttcctcatcttgtcttccattcctggggaacagtggccacatagccaggtggctggcagcacggacttgggagaccctaccagcctgggtttgaaccctgtctctaccgcctgcttgctttgtgacctggttcctcattttcctcatctgtaagatggtggtgttgaaaggacccgtctggtagggttgttctgaaggttgagatattcaaatgctgagaacaccacccagcacaaggctggtgaatgctccaggagggttcactgcgccgttgccattttcctgttgatcctggagttccggccactctggcctctgctcacatagctggaactcgtcagaccatctcccacctcaaggtctttgcctctaccgtgctgtctcaggacactcgtcccctgccttaccattcggtcagcccattatccttcgggcctcaggttgaatgtcacttgctgagagcagccctctctgaccatccttttagagtggcttccccgcctcacattccccgttacagtctggcctgattgtatctgccagtgggttctgcttcccccaaccacaacttgcccatcatgagggggcagccttgcctgttgtcccctgcactgcatcaacactgcctggaccagaggccctcggtaactgccagttggctgaatgaatgcaggaatgaggcatgaacaatgcaaagatgctgaaccatgacatgagggactgtttcattcatgtggcatgggggtgggctaccccccccatacctaacttttccaatgtgacggttttccttctgaatttataaggtgcccaccttaaagacaggaattcagctcatatcttttaatagaccctgcaaggtatccagttcctaggacacagcattttgttggttattgaatgagactgaagggatgagaagagtggccaatagcatggagctggggcctaactgcccacgtgtggtcttggtccctagtatttattagccaagtgtccttggccaacttcattttatgccacaaaacctcagtctcctcatctatacaatgggaataataataataccttttctagagttggagggaggattaaatgagtcagttatgtttaaagtcctggaacagtgccaatgcccaccacatagtaatttccatgtaaatgtgagctgccatgatgatggtgatgatcatggttgtgatgatggtggtgatgattgtgatgttgatggtgatgatgatggtcgtgatgatgatggtgatgatgatggtcgtgatgattgtgatgatgatggtgatgatgatggtggtgatgatgatggttgtgatgattgtgatgatggtggtgatgatgatggtggtgatgatgatggtgatgatgatggtgatgatgatgattgtgatgatggtggtgatggtggtggttatgatgatggtggtgatgatggtgatgatgatggtgatgatgatggtgatgatgatggtgatgatgatggtggtgatgattgtgatgatgatggtgatggtggtggtgatgatgatggtgatgatggtgatgatgatggtggtgattgtgatgatggtggtgattgtgatgatggtggtggttgtgatggtgatgattgtgatgatggtggtgatgatggtggtgattgtgatgatgatggtgattgtgatgatggtgatgattgtgatgatggtggtgattgtgatgatggtggtgatgatgatggtggtgatgatgatggtggtgattgtgatgatggtggtgatgatgatcatggtgattgtgatgatggtggtgatagtggtggtgacggtgataatgatcatggtggtgacagtgatgatgacgatggtgattgtgatggtggtggtgatagtggtgatgacgatgatgatcatggcagtgatggtgatgatgacgatggtgattgtgatggtggtggtgatagtggtgatgatggtgatgatgatcatagtggtgttggtgatgataatggtggtggtgaatgtgacggtgtgatggtggtaatgagggtgatgttgttaccttgtagtagatttgaaaaagtggaatagagtggaattaaagaaaacactactgagttaataagaagaaaggtagggcgcaggaagtgtttgctaggaaatggaagagtccagcttattccagtatcagttgaatgcagcagactcatgaactttactgaaaccaaaatttaccgaagctgatgagaggatcatgatttcccagagtgtggactgaagcctccgggaggtgtcagagatgattttggagtagtgcttttcacaccctctgtaaaataggacccatttaaaaattttcaatctgttgcaaactgataatttcattaatgtgtagagaaacattttcacacttcacccctaagagaaggtttgtggactggtacctggaacagatacttatcttgtagctgccaccaagaaacactttccagatgggcaccgtagcaggacactgtgctaggacacgctttgagtagtgctgtttcagatgaaaatcacatcacatggggctttgaatttcacagaatcctgtggtcagctggttgctcccctgtgaattatctttcagttgtgtggttgtatatggaggagaaagttgtagtttgtggctcatgtgtcactgactggtgatgttggatgatttctcttttctaacaagcagagagcagcctcaggcacagaacccttgacgggcatggggtcttgccagaatggaattacactgacttgtttccattgcatttattttgtggccacttaatatttttggatgttgattctgattttcctattagagccaagatgtaaagtttctttaatagataatttaggtgcaaaaagtgagttgccttaaaacatagtgtacattatcatgcagctacgagtgaatatatgacaaaaatcatgaaagtggtacaagacaaatttgcagagaactctagtggaaggcaggatagaggagtgagaatagaccaaatggatgtttggggtcatttgggggccatgtaagcctctcccccttatccctggtggaacagcattaaggacatcctctccttcatcccaaacatctgctttatgggaaaccacaggactatattgttagtagtactgggaaagcctagtcggctttatcttttggattctgagaatgttgtcagtgatcatgtttctctcttcactggagttgctaggagttccagcatccaatttcagctccaacctccaatccttgcacagaaccctacagtacgtgttttgtgtattgaagccacagaagcatgtatttttcctcctcattctctccctgacctttttttgattttgttttttgtttttttttcttaactgcagttacatttttgtaagctgtgttacatcgttgtttggaacacagtgggggtaatgcataaatgctgaataaataaataatgatgaaactttttcctcaaactgtgagattggggccactccattgttagagttattttaatgtgatcaggacaaagaggccaagagtgttgtaggaagtaagctttgttctcgtgggcttgggctgggcaacgctgtggttgttgggaacgctaatttctgttatttggtggtgctcatatctcaggcctctgtttaagaaacaacatagattcctccaaggcacatatttgcatcctgtgtgggccgaggtgcctggcttcattctttctctagatacccacactatctcatgggtatttttaaatgcgtgtcttaagagccaacttctctgctgtgtgcaggcttttcatgatgccgggagagttgccacgtggatttgcaggcgctgagggcagaaacaaggaacaggcagcatcagctcaatgggtgggacccactgtcctttcagcccttggtggggcggccttggaggaagggtcattctccaagcagggcagaactcagttccaggttggccagaaggccaaatggactgtggggcaggtctgaggccaggtagtggggcgacccagaagcaggaagatggtgtgtcaaatgtagagtgagacagaaatggcaggggctgaggagttgttgagtcctgttttttcacacttgtgtggggatcttgaggagtttcgtagaggtgccgcagggtctgcctgttgaggagcaaaccaagctgaccgggttacaggtgccatccactgtcccctcccatctgattggtttggatactaggatgttgtgtggattctcctggagtccagacatagccagtgaaacaatattgaaccccctgcaatagtccagccccatcattccatttcataaaggaaactgaggccttgccagggatcccaaagtggtaatccctcttgtagagttccaggggagggcaccaacctctacctagctactgaagccagaaacctgggcattcacctgccctttccattttcctcctcatccccatccctgccacatccctgtatcctggcatctccagccttcagcacctctccaattcatctgcttctcattacccccagccacaccaggaaggtccaggcccccttgtctgtgcgctgggaggatacagatgcatcctgagccttccagcttcctctgttgggcccatctaattgggtttctgctgggcgatgggagtgatcatttgaaacttcaaatctcattatgacagtctatatcccttcctcaatgttcccatcttgtttcacatctttcagtggttgctcatggcttgtaaaatcaaaacaaaacaaaacaaaacacccaaattcctcaccaagccccctcctgcacctctggcctcatgatggcatgattctttgagtctggggacctgagcagatggtctgagctgtgctagaactctaacccacaccaccgcctaccatgcacaaacacagatgtttgctggctgactccagctcatcctctcatcttagcctcagcatcacttctgcaggaaggccccttccaatctcaccagggcccatcacgtcatcctgtctgatgccctttggcactctgggctaatcctttggggccctcagacgccgtccccactgtcttagttgtctggtttgctctctctcttcccctactggattgtcaacttcctgagagccaaggtcacatatagctttagcctgtgtcccaggccttcagcatggtgcttctttgggcacaggaggtgtgtgcagagtggaaggagaccttcatttggtggggagactgtattatagagaagtagtttcatgttccaaagaacaagcaggaaatatcttccttctcctcctctttctgctagtaaatcctccttcctcctcactggctggatgaagcatctcatggtggaatagtttcagatccagggttcccaggaaagggaaccacctccagttccccatcccctttcctttcctgggaggtctctggtgcttatgctactaataatgaacatttaactaatgagttgctacctgttcatattaccaaagcctccctgccaaaggccaccagagacattcctggggtcaaatcagattagatttatggagcttcctgcatcacagggtaacacagtattgagggccatgacaacatcccaatatacaggactgggagaggcttttttacagggcttgagtatgatctggatgattctagaagaaatgaaagaagcaagggccagctctatctgatactatcaagaaagaggcctcccactataggatatctcagtggtctttgttcaggaggttggaggaactagttgaggctgggtaagtgcaggatccctgcccgtggaggggacatcagtcacgtttgtagcttccatgtggcctcgggtgtcctggcggagaccttggctctcctgtcagaagcttcctctgattgtcaacagggatgattttattttactctttatgctttcatctttcatatttaaaactttgatcagtctagaatttcttttgatataaaatgtgagggacagagccaacctacttttctattttagattgccatcaattgtcccaactccatttattgaatgataatcgcttttctctgattttcttgcctcctttataaatatattagattctatacaattttgtgtctatttttggacttttcattttgtcccattgaattgtgtctatccttgcaacaaagccacattgttttaattattatcactatattatatgttttaataacagaagtccctttccctcataccttattcctcttgcagctttttctagttcttcttgtttattttttatataaattttatcttatttgctatatgtcttttaaatatctgataactttagcaggattttagttgtgtaagaattacagaattttaatcctggaaggatgctgaggaggtttctaactctctcattttctggagaggatatgattttatcaaagtgatgctgtgagtttatggcagtgagaaaccagggaatccccaaccctgaacccacctccagatccactcgccccaccaagcctccagcttttgaccctgcatatttttaggtacccagaaattacttaatatttagcttagtggactgccacgatttaaatttgaccttttaaatccaagcacctccttctgctatgttgcttttagaagaaaggacaaagctgaggaattcaacctttgtttccatttatctcttagccttccgagacaggacgcaatgtagccaacaccactcctttgtctccatggtcaaagtcggaaggaagttctttcagaggggttggcttcattgatcttgtggggaaaatcttacaagtacccagggcatggtgtttgataaggaagtgagtggtgtgaaatccaggctcaagaacaaaagccctacaagcctgtacccaacggggccactggcctagaatggtaataaatagaattgggtgacaaccttgaaggtcacccgtggttcagctctggaggtgtccttgtttgtactcactttgagtaaccatcaacttataaatagcctcaggccaattgcccagtgatgattttgactgtcgcttgccaggggcctgggcttgtggtttggttgtgagtctgtcatggtctctgtgacctcagaggaggaggaaggaagatgatgatggatgcttctagtgatgcaagcaacaaacatttttggacaatgtgcccaataccattctctgtactctgcatgagttaacccttcaggcttcaaacaacgctttgaggtaggtgaggagactgagcactaaaaaggtgaatgcggagccagtgtgagcacaaaaggcctggttccctgctagaccgtgcctcctcttggctggagctctatggaaagagttggaaccagggagccttggttaaaatatcagctccatcccttatgaccttgggcaacttacaaatctccaaatctgtattttcaccttttaactagaataatgtatgtcaattatagggtgttaggattaaatgagaaaatgtacataaaacttttggggcattgtctggcactgggtaagtactcaatgaaaaaaggtaatggttttttaacttgtttaatgtttctaagccttaggttttccacttataaaatgaaagcgtcattatatatggtgcgtggctgtcttctcttttggtttggttcggtttgaggatttgtcggggtcacattaccgtcatgaccacctgtgtgaccttgagcagattccttaacccctttatgttgcagttgcctccactctgaagtgggggtcctgatagtggctggctcagggttgtgtgataatcaaatgagagatgcttagagaataagcatcggcgtctggcacagacgtcctcatcctccaagatcctgtgacttgttgcatctatgtgcttgacttagcccacaatccgtccccatctcccttctcttctctttgttctgggaatctttaaaaacacttgttgagcttggggtcggtttgcagaatcatcacctacttttagggtagtctgtttcatttggggtaaacatttaggtttctaagacattgggacagtgatgtttgacttcacatctattcatgtgctctcactgagctctgaatatgatgtttccattcccccatctatcagagatgacacagaatcatttatatagactcaatagactcttaggggaggcaccagccctgtctgtagcttcactacttctgagactgaggtggtacctggtgtatcagttacctgtttctggcaacaaattattccagaatttagcttgtgattttgttgacaattaggctggacttagctgggtggttcttccaatcttggctgggcccctgcatgcatccgtattcaactgcaggctgggtataacactgtcagattttggtgtcagctgggataactgggatgactcaaccctcttctgtactcttcatcttggtcctgttcacatggtggaggcagagccccaggcaagagggaaatgtacaaagccccgttagtcctaggctcaaatcgggcccaccatctcttctgcaggcaattggcaacgtaagccccagtccagcccagattcaaaggaagggggcacacatcttctcttgatgggaagaacagagttcactgcagaggggcctagtctggggagatgaagaaatgtggccgtttttgcaatttgcctcactgaccacatagagggtgactggccctgtattttatgtcatatgtgactctatagaaatgtgtctcctagctgggctttgcagagatgcagactctatctgtctttctgttgtgggctttctaccttgtcatgaaaaggccagaaaattcctgaaatgagtgtccttttcagtccttcaggtgagaggctcctcagggatccacagaccattgttttggcttctgtctccctctgcttgtcacacagggatcacatacacaggtggaagtgaacttgtttgcttcccttcccaaactgtaagctctgtgaagacaggaatctccttgactcactattatatcattggcacctagtaggtcactgtaagtataaaatgaaagagggcaggaaggcaggaagggagtgaatgagttaggaagttaggcatctagataggaaggaaatgagagaaagcctcgatggaagaaggaaagaaagacactggaggtaaacagttgggaaagaaggaggtgaagagatataaggaatttaaattattcttcaacaagctaggtatggggcaaggcactggcctttctgaacctcattgactgcatctgtgtgatggagtaatagtagcacctacctggcttataatgaaataatacatagaagcttttagaatagggaccatcactgatggctgctctagttgttctagtttcagctgatgaaggcactaggatcctcagcatggaagacacagcagcagggacagggggaaatgctgtgggtccaaggagatagtgcaggtgctcagagggtcatggagagagagaagcagcccaatgattgccgggtgctatgccattcagtgcttcttctaggcatggctttgagcagcaattggccaggcttccagaaacttcagaacaagtggactgtgaactctctgcaaactagatgctgtgatatgcattttcataattcccccaaggatgtggacaggtggaaataaactcccagtcacacaaaaccccaccacccagagagcaatctggttgacatcctggctgagtttattaccataatttttcctacgggtacctgtgtaaatatagaaactgtagacaaaattggaattgtaccactgatatggtttggatttctgtccccatccaaatctcatgtcgaattgtaatccgtagtgttggaagaggggcctggtgggaggtgattggattctaggggtggatttccccttgctgttctcatgatagtgagtgtgttcttatgagatctgggtagcacctcctgcttcattctcttcctccttctccggctatgtcttgtgagatgtacctgcttcccctttgccttccgccgtgattataagtttcctgaggtctctacagtcgtgcttcctgtacagcctgtggaactgtgagtcaactaaaccttttttctttataaattacccagtctcaggtagttctttatagcaatccaagaatggactaatacaaccacttctgctgtatcttgggtttttaaaattcacattattttgtgagtattttctcactgcctgagaattttggggtcaggcatttttctcttcaccgcttagacactcaatttctgtttagaaaatggggagagtaagagtatctctctcctagaagttgtctattttttttttttatttgagatggagtctcactctgttgcccaggctggagtgcagaggcataatatcagctaactgcaatgtccacctctcgggttcaagcaattctcctgcctcagtctcctgagtagctgggactacaggctcacctcaccacatccagctaatttctgtatgtttactagatccagggtttctccatgttggccaggctggtctcaaactcctgacctcaagtgatccacccacctctgcctcccaaagtgctgggattacaaatgtgagccaccgcacccagactattttgttttgacctggggagagttaaatgagttaatatccttagcccagttccataacatccactgtaagcttttctatatgttcctttatttaggaagagtgaacatagtgccaagttttacttagagagcagtgctctgcatgctttggtgctagcacacaataaaattaaacggaggtcaaagcagagagcacttagggattcccaaagcgtccagaacaacagtagatggttataaaggacagcaatagtacaatgacgctgcctccaagacgaagtacagcattaattagtactgggcagtggatggccaggctctttcagggctttactgagagcctctgaagggtggcagtgatgaagagtggggccatgagtgaccatctcaggcccgtcgggaagatacttttcatgtggttgacccatggcagaaggaaggacctgtgtcatccctgagtgtctgagcatgttggggctgtgcttcgggacatggggtttttctccctggtctcgttgggatgctcttcacacctaagcagggtttgcacattcaaacatgggccgtttgtattccagccagcattgctgagaaggccggggagcagcttggtgcatactaaggagcagctcctgccctggctctgtccacaccaggctctctgggcagctgcccatggagaacacaagccagcaacctttgaggagagccaggccagcatttgaccatttgaggctgatggaccctgggtggcagggcctcggctctgcttttgggagaccttgaaggctgatgcatttcctccccagccccactcttactttacctggattgctgctgggactttgagacagtccacgctttcctattgtggaggctgtgccttgcctgggggatggagactgaatctattggtgatgatccagtaaagggtctcagagttcagcagagggtgctgggattcaccccaaatatttgggcagagggagagagacaggctgtgaaacagaatgaaataatgatgtgataggaagccctgcaagcattggcccctttaattctccctaggactctatgaggtaaggactgccccacttaccaggatatgaaacaaaggctcagaaggctcagaaggtggaaataaatctcccgggtttgaccaggagcccagcagcccttccccagagcctgttgacaaacagtgcaggcatgtgcctgtctcagggttatcttccgcctgctttcttctcagcatgcgattgcatcatattgtattgattgctactggaagactgaattcagaggcctcacagatctatatcatgactttacggaaatagaaaaagaaaaggtatttttcatggtggctcagacttacttcttatccccatccttgcaggcagaggcccctaacaaatgtcaaaggatgactgagggggctttggaagccaggagacttggctgtagatctcctctaccacttcttagccatgagaccattggtaactcatcgaaccttcctgaacctcaaatagctgctattgctatttgttacccatgagaccaaggaaatagtcttcatcatgaccaaggaatagtcatgttctagacagtgcacaagctaagaaaggagcagagattagaaggagaaaagaggaaaaaagaacaagcaggacatttttcacctaagagattgacaaaaaaatttaatttaatcaataaattacccagtcttgggtagttctttatggcaatccaagaatgaactaatgcaacaacttatgctgcatcctgtgttttattaactcacattattttgtgagcattttctcattgacaatatcaagtgttggcaaacacatgtggaaacagctcttacaagtctcagatataaattggtatggccatcttgcagacacagtttggcaatatcaagtaaaattggaaaaacaaatgctttgactgtccgtgactatttctaggtaaggaggcttggaccaggatgttcatcacaatatcaacattgtgtgtaattatgaaaaactgggaaaaaatcctaaatgaccattaacaggggactgaatacatcaaatgtggcatattcttacaatgggacacttggcaatagttaaaagtaatgaactaaatttctatgggaggaaaatgaagtggacagtataataccatgtttgtaaacctacccaccccaacaaaataatatcatatatagcatgtcaatgtgaaatgaaaaaaagactggatggagagagaggggcagggagatggagagacaaagacagagacagcaagcaagagaatgtgagagctgtaggtatcagactaaaaagacacataccaaatctctgataattgttccttctgggagtgttgaatgataaaaaaaaaaggatttcacctttatcaggaatgcttcattatatattataatagttatacatataaacacacaccagatgatagcttcaataccctccagttttgtgcatttgatatatgattccttgtgcttttaggttttcttaatgttactcaaagaaattggagaaataatttttaaaacaagagatttatttgaggagcttagagaaggggaaaagtttggatatctaatgatttttattttaaggtcaaggtatgatttgactttgctctgtaaagcaattttcttttctccgggagaatgtttgcagcaaacatttattaattagctaccatgttcatggcccacagaactctccatggtactagttctctaccaggcacacaaataaatcctcagctaagtaagtttatcttggatgactttttctctcagtttgataagaattcagcttgccatcctctggcctagctgagccacaggatgttgaaagaagatcaatgctgcctggtaagtacattcagaaacacaacttcccccagatattccagtgtttctgctgatgcccaaatccctaggtcatgtcagctatgaaaacatcagcaaatgtatggagtattaactggaaaggagtgttgttgcttcttactttttataagcccagaagattccaagaacagggaaaatatctaaaaccaagtcagaaaaggacgtaagtgcagagcccattggtgactgccgttatctgctttgaaaccccaggagttggcgatgttgtttgcaaggagacagctatgcttcctttcttgttttagtcttgggctgagacaaatatgacatttcctagatttggggcccagagctacagaaaacatggccccaaaccaaaaacttcaaattttaagtcattcatccttgaggaatatgctgatacctcatttaccccttgtgactcctaaaccctggacatacctttttatgctattaaaagaaggcttctagttttgtttactccagtctcctagatgttgtcattccccttgaatctcctgagaggctggagattatatttggtctggcaaatggttttctttctaccccctttctccttacatttattgtaaaaatattttaatagacaatacatgtatatggttacaaaattaagcagcatgaaaaggtgcacactgccatcatgaatactcttatcatcatcatcacctttattggatagtgaaaagtctgtggccgggcgcggtggctcacacctgtaatccaagcactttgggaggccgaggtgggtggatcatgaggtcaagagatcgagaccagcctggccaacatggtgaaaccccatctctactaaaaacacaaaaattagctggccatggtggcaggcacctgtaatcccagctactcaggaggctgaggcagaataatcatttgaacctgggaggtggaagttgcagtgagccaagatcgcgccactgcactccagcctggcaacagagcaaaactccgtcaaggaaaagaagatgagagaagagaagggaaaagttaagtttgcatactaaacttgctttctggttgaccagttctccttccctgaggcaaccactgttacaagtttctttttcatgatttcttgtggatttattcgtgttattcacgatatgtgtgtttgtcacatgaatgatggcaatctacacatactgttttgtaccttttcttactttgtaatatttcttggagatcatttcatggagatggatgttggtctttctcagttttttatgtgttgcctgataatctgtggaaaaggttcttctccactgccctgttggttgacactggggttgtttccaaacattcatcgatgaatcagtgctacctcgaataatcttttaaccatgtatgcatctttattttcaggtttgagtttatttgtaacatatgttctgatgactgcaactgcaagaccaaattatatgtgcattttaagtttgtctagatgtaaaacattggcctgcaaagatattatatcaacttataaaaagaaaaattaatggcagcactgtttgtcaatgccctcaccaaactaggtcattgacaattctaaaagatgggtctacaagggtagtgcttaaaaacatcatttttggtttaggttcaagccatgtttacacttgaaatggtatgatatcttacatggtatgagagtgagcaggtgggggcatatctggaaagagatcagtgtgctttggtagttgttgaagtgaagctgagtgatgagtgcatggtagttcacgtttccatgctctgtacttttgtaggtgcttactttttttgttttgtttttttgtttttgttttgagacaggggcttgctccatcatctaggcaggagtgcactggcacaattatggctctttgcagcctcgacctcctgggctcaagggatcctcccgcctcagcctcccaagtagctatgattacaggtgcaccacactatgtctggctaatttttaaaaaaattttttggcgacggggtctcactacattgcccaggctggtctcaaactcctgggctcatgtgatcctcctgcctcagcctcccaaaatgctgtaattacatgtgtgtaccattgcgtccagctctttttcctttttataacaggaatgtccaagccatatatgaaacagatccgacccacataataaaaatatggaccataaatcatcacgagttgttttctccttgtatttagcaaaagctcctcctgtgctcatggcaggctgagtgcctggcccgtgtcttcgtactctgcacagtatccttgtgaggctgagatcagtgtttttatttctgtctcacagatgagaaaacagtggtccagagagattaagtaggtagcagaaccagggaatgcagacttctcacaaagcaatacactgcttctgcctgaccatcactttgcctggctgctgcctctttggctaccatctgtctgccagtctctggggacactagttactctgacagtctagctaccagataggctccagtaagatgggaaagacctggatagaaataaaggcattctatgaacattacaccagcaactctttttaaaaaatagattttattttttagagctgttttaaatttacacaaaaatcttacaaaaagtgagttcccatatacctcctctccccttcccagtttctcctattattaacgtgttgcattgtgtgcacatttgttacaactgatcaacaaatgttgatgaattattaactcaagtccacagtttacatcagggcttacacttgctgtttacattctacgggttttgacaaatgcataatggaatgtattcaccattacagtatcatagaggatagtttcaccgaccccccaatcccctgtcctctgcttctgcagaacccctggcaaccacagatcttttggttgtcactatggttttgtcttttccaagatgtcatatagattgaatcatgcagtatgtggacttctcagactgtattctttgactaagcaagatgcctttaagtttcctccatgtctttcctgtctcgatagctcatttctttttattgttgcttaatagtccattgtcgggatgtaccccaatttgtttatccatttacctgtggaaggacatcttggcttcatcccattttttggcatatggtcatttttcagtattttccaaatggttagatttcatacgtgaatctcattgctcttagaaggtcattcagatgtgctcctgacctggacccaaatggcctggacccactgtcatcacctccctgtctggcctcttctcccactccatcttctttccccactctgcagaccctccagcctccttcctgttcttttgtgcaccatgttggatcctgcaccttcatccttttttcttctttttattcagaagactctcaccccaagtcttctcacatccagatctcagctgaaatgacacatcctctaagatgccctcctgacccccttactgaaagggttgcatgctgccaagcaaatgtccctcacagactgctctgggatttcctttactgcacttttcactctctgaagtggccttgcctgtttagctggccatcatctgtcccccacctctggaatgtcagcttcgcagagggagggaccacatctggcttatccctggctgtatcctagccctagaacagtgcctggggcctcacagaatatttgctggataagtaagtgatggattgattagtctgactactccagtgcttctcaagttgatggctttccatctacacatattgtattcatccgtgaaaagagagaagaaaccaggaaaagcacatctccaatgatgagggttatgtctctggcagcctgtattttggacctgggtgggatcatagtgtgtgttcttgtagcttttgcctgagtttcgtctacatggccctacttatggagtctaagatggagctgacagtgatgtatcattctaaacaagcgtgttgttgcaagaatccatttcaaagagatcctcttttaaatgctacttctctcccttcctcttcatctattctagcctttgaaaggtgtttatgttgattctgccattctccattcctgaggcacagataagcatcataaatatgttagttttgaacaggtcctgaaatttgccgacataattcccattttcttgtcagtacttccaagcatgaatagccttttttttcggtatggtgaattatctacagttagggatggtttaaaggtatttttatgaggacgtttagtcattgggatcacttgttcctgagtcatgcatttattttaagtctaagtcttttgaaaggtcatttagatttttcaaaaatagtagtcgtatcgttgtctcatattctttctccttgcccattttttgcttttaacaaaggaaattattttcaaggaaagcatcttcagataatgcacaaccagcccaggggaaacctagctttatagacacactagtgagatcgttgtgtaatttgatgggggaaggtttgtaaggtttgtgttctgtgtagaaaatggtgagattttaaaccaaagtttcattccagttatgaaaataagacatgtgcatgataaatattttcagatcagtgaaagaaataaaataatttttacccatagttcttctagatatcattaatattttggtgtatttccttggggtgtgtgtgtgtgagtgtgtgtgtgtgtaatttcatcagactggaaactctgagcagtcagagttcttgtctgtcgtcctcattgctctatagagagtactcctgagaagacactcagtgccaatttactgactgaatgaaagttaagtgtgtgtgtgtcacatatttcaaaacaaagtctagatagttctctatatttgattttgtgtccctccagcaatttctcatttttaaatttttctttgaaaacatgatttctaaatagtgggctgttatttcatgggatgaaaagttgtgttggaaagccccttcacactggaatctttgaaaccatcttcattcatttctttacaaaaaatctttagcagtgaaattcttgggttaaagggcctgaacactttaaagactttcatacatttttgctaagtaaccctccagagagaagggaacaagtggccttcccatcggcaaggaataaaatgacccatctttttatgttcccattaagagtggctttaagggttctcttgtaatgatgcatttttgttgtctacattagacttgttgtccctagtttcttagtagcattctgattttgctatggtatgttttcatgttcagaagtttgaaaaattgttaggtcaaatttagtatttttttctttaagacttcattaattgctcctatacttaagaaggtctccatcaccaagagaaagcaacctgctttctctcctggattattttcttctggctttcttgtaggttccttttctttccacttcagctcatgggaaatgcatttgaatgtgaggtgtagcttcctgatcattctgggtagcccagtcactcagcactctcctgagaatagtcttttttttttttttttttttttgccactgattggaaatgcacgtcttatagtattcccattttttacattatactaaattctctttctggactttttattttatttgtctggatctgccatgtcttcatgttaactgttttgataactacagctttattatatattctaatatccagccaaacacctcctttattatatttttttcaattttgagagccattctattatgtgtatgctacaagaagaatattatgagttatatcagatcagattataaaatacaatgagaattacataaaagttatacaatcattttggagaactgatatttttaccaaattgagtaatcccattcaaaagcctagtatgtctgtcctagtatttaagactttctcttttttttttttttttgagacagggtctcactctgtcgcccagactggagtgcagtggtgccatctgggctcactgcaacctccacctcctgggttcaagcaattctcctgcctcagccatccaagtagctgggattacaggtgtgcaccaccatacccagctaatttttgtatttttggtagacacgaggttttgccatgttgcccaggctggtctccaactcctgaacaaaaagtgatccgcccgcctcagcctcccaaagtgctggaattacaggcatgagccaccactcctggccagtatttgagaattttaaagtcaatataattctaagtttaaacgttatggtttcttcccagggagcacaacaatttattacgagttttatttctatgtgtttaatgttttgcattggttattgcagatgagatttttgttttcctgttaaactatctggtgattttgctaacactagaaaaaaatactaatttggattcattcattttgtaaccttaaaagagtgattcatcttactctcttagtatttatcttattacttattatttaatatttatgttaaataccctcttagtatttaaataaaatagttttcaagttggttctcttcagttctctgagtgtagattggttcatcagctgctcaaagggtgaacaatgaaaggggtgcttcctgtgaaatgttcccatggggctcatagtgcacctgagccgagacactcctggttcaagggcagttctgctgccctctgtctgtggagaaggcttgtctgttgaacctctcactgccatttcccttcctgcaggctgtgagcccaagaatgaagggctgctggatcactggtctttctgttttgctgtgagaggaattggtggtggccccctcatgcttggcctttgagcctgaggagggacgaggatctaccctgggtgtccagttactctttgagccaagtggtggatgaagactttgggggtgtggttgactcagaggccagagctgaagtgagcagaaagagcccacaccaccttccaaagcaccaattccaagtcagcaggtgaccttccagaagaattgtgcaataggctttaacttttattgtgcaaacaagtttctcacataattaactcaatggcctccagatgaaaacagtgacattaagaccccactggcttcctctgaattccctgacgaactcaaacttttcccatactggcctgtagtatctggatttctgcaaaagacaatagggttgattttggagtttcagactgtggaactctgtcctagttaatgagaagagtctgataaggccacccagagggcaagtgaggtctaggacgctgcataaacaaattaggaaatgacagagaggcaccaaaactgcagcacgtttcagctgtgtgttcctttctgtgtctctctgattcaatgtggccagtgttttctggagacttttgcaaaggtgggaatggggacacatggcactgtgaccccatctaggtggttgggcctggaggctactcatcaacccaccacccagagaacagaccatgcattcccagctcccaggagccagtgctgctcccggttcctgcctggatcacattagtgttcatggttgttaagcttgttcctataaagagagccctctccccaagagctggtaattggggaaagaagggctttttttctgctttgcttgttccaatcttgtgtttttgcttagaatatgaacacacatggtcacacacatacatgaaaagccagaacaaccagaggaccttctgtttgagcacccagactagacgcacagcagggaaaccatgcccagcctggttccctggggtctgggctcttggttctttcctttgcgattgaggaggaggcaacctgctttctctcctggatttaaaacaccctctacctctcaagtcctcacatcatctgtggaccttatcctcagtgcttctctagaaatgtcttattgttttctaactaaagagaatatgaaatttatttgcataaagaatcttttagtaatgagtacaggaaaaaaaatagtccgacttgagctggtgtaaatgaagagaggcattgattggttcaccgagctgaaaagctaagggcatcaggcaggtggctgcattcagtgatgtggaccacgccagcagggctctgctgtcttgtgcctggctctgtgtccatctgatttggcttcatcccccatcaggttctccccataagggaggaaatgactgtgtagagcccctgactcatattctcatagcttagcaatccttacttagtgatacggtttggaagtttgtccgctctaaatctcctgttgatttgtgatccccagtgttaaaggtggggcctagtggcttggggccctccccatggtgatgagttcctgacagctggtagctaaagagtctggggcctcccttcttctttctctctcttgctcccactctttttttttttttttttttttgaggcggagtctctctctgtctcccaggttggagtgcagtggcagtggcataatctcagctcactgcaacctctgcctcctgggttcaagtgattctcctgcttcagcctcccgagtggctgggactagggggcatgccaccaagcctggctaattttgtatttttagtagagacagggtttcactatgttgcccaggctggtcttgaactcctgagcaaaaaacgatcctcccacctcagcctcccaaagtgctgggattacaggcgtgagcccccttgcccagctcttgctccgactcttgccatcgaacgtgcctgctaccccttcaccttccaccatgagtggaacttcctgaggccctcaccagaagcagacatcagtgccgtatttcttgtacagtctgcagaaccatgagccaaataaacctcttttctttataaattacccattctcaagtgttcctttttaacaatgtgaaatggactaacctgggaaaacacatattttaaattttcctaacagttccagaaaaagtcctggaatggattctcattggcccagcctggtcacatgtccatcccctgaaccagtcatggtggccagtgaaatgtgatgctctgatttgattggccaggcctacctctgtctgtacagctgggtcactggggtgacagatgggagcatcagctccatccaagccaatggactgctgatggggacagggggagttcatcaggataagctgggcacgtgctactgtagtgatctgaacttttgaggggctcacaaccatggtgcctgtgtctctctaattcggcatgttgatcatgggatagcaaagggacgctgcttatggaagttctctgggcaccagctggaccgaggcaccacatccacatatcctccacaatcacagaggcaggaagggggaacatggagaaccgtgccctggctgggaaagcatccgcccagaaggggcagatgccacttgcactcctattcagttggccagaataagtcccatgtgcaggcctgggttctacaggtggggatgtgtaattccctcccgctgagaggcacagagcatttgtgagtcataatagagtctgctttcggttgccctgctggtccccagatatttaggtcctgcttcatgggagacagccccaaagtcccactcagtcactactcacagctcattgtctaggatctttgggtgatgaatcattatctttacatcgtgtttggacatggctcttctttattcagagacttatgacaagtgatctgcccccaccatcaaacacctaagatttaatcttgaaacagggataggataactgcagtaaacgttcagaaaagggacgatgaactgtcaaatgatcgctaccctgaagttctcccatgcaaatacagtgacattcccttctctgggggaaagagagttccttcattgagctggtttggctccatgggactaccttccagtcttcattggccttcttcattggctttagcgccacctttctgaagtcttccctttttggttatccttgctggcggaatcaaaagaagatattggaagacatgctcttcatagagtatgagcaggtgtctcagcctagaaaaatggagacccagggattattttctacaacgttcagtctcttttattcaatctggtgatggcttggacaataaaaatctctcaaaacttttttggtcccagttggcttcatctgccaaaacacacctacagtttttctgagatgtaccttttccatagatctaagaccctgatcttgtcaggctcccataaaagagctataaccatggtccctttgccaatgaattttgtcctagtttgctaacaccacataaatccatttgggatttttaaccacaggtgtgacagcagaccaattctaaaccaccctttgccagttaaaacctttttggctttcttttgttgcttttctcattggttctaagaagccagggttttttttccaatcttacaaaactttgaagttctagattctcttttatttttgccagaccctgttatctgcatagacactttcccagaagtactggttatattattgaataaagagagtagtttgttaccttcatcttaggaagggcaatttggtgacttcaaatgtgagagttagcacctacttgggagtaggaattgtccttagtatgttttaggaagaaattagatttttcatgccttgagcctcccctttgtccaggatgcatgaaggacctgatgggaattctgggtggtgttgggggagatggtgcaggtggaacactagtttcctgaggttgactcagcactttccattctgctgagtcagagtctcggtgccttccttgattaggtaaagccatcccttggcatctctgaagtgcagcttataggctacttgtagtgatatgggacatggtcttttatggggtcatgtgtattttgtcatctggtccttttgcagaacctgttgtgttctgacattcctgagttggcagaggaaaaaatcaggtctcagggaacatgttggtaagtggcaaagtcagggttgttgctcaggtcttcctggcttgaggtcttttcttctttctatttttgcagattggtttctggaaagatttatttaaatcctctctagttcacccctattcttgaatcaaaaggcttatcttaacaagcacaaaaagccccatttattcaggtattataaacaagaatggaaaagatagatgtggcctcatttactcatcccattctcctgctttttatcccacaccaggagtctaccaggctctaagcagacctcaggaaggatggggctgtcagatgtgagatgttagtggtcctcattggactgtgactgggtcctggtttttgaagcttgttttgtttcttgggaggcagcaataaggtcaagctggggctcaaagcatcatcgtaaccagcaaaatggggaccacagcagcgagttcactggctaggccctttaaaaggcaggcacacactttcaaatttcccactatttttaaccagcttgcttgcttgcttttaaattcatgtgtggttcctggaggcacttgacctctttctacagagccttcccctctgctattttaatgaacagctgcatcaatgactccctaaattccaactgcatcttcttcatcctcattaacctttaccttggcattcaagcctcttccaggcctcctcctcctttttcttcctcacctctcttaccatggctttccctcacccacttcttgatgttcctgcatcataccttcctttatgggaatgttctttgccacctgtcaggatcctacccacccctcaaggtctggttcaaatgctacaccttcagaaagattttgggggaaaaataaagtcttttttctttttgagtctaaaagtattgcacactcattatagaatatttataaataaaattaaagtcattcccagtcatatcaaccagttaatccctacaaatatttgcatattttcattcatctttcatgtatacatatatacagaaaatatttataatactgatgccatattgtatatataattacatatcccaattttaaatatagcatgtgtcttgaaaattttttggtatcattaaatgtttttcaaatacataattttcactggatacttgaaattctgttctacctctcttctacaattatgtaaacattcctcttactgtttggttgtttacattgttgtgcgtaaggctttgtctctatctctgattatgtatgtagaaatataagtatttttgaacagcgtaaacttttttaagctcttgacacacattgccaaacgttttctcagaaaggtggtatttgttttcactcccatatgtactgtaagctcatctttccaaatcttttccaatctgatgagttgatttttaagaaatcaactaccagtttggcaaaaatggaaactcattacagattcccctcaacttacagtagggttttgtcctgataaactcatcttaagttgacaatatcatgtcaaaaatgcatttaatatacctaatctactgaacatcatagcctcgcctgtcataaatgtgctcaaaacacttatgttagcctacatttaggcaaaaatcatctaccacagcctattttataataaaatatcaaatatctcatataatttatcaaatactgtttaccccgtcaaaattgcaatggtttcacgccattgtaaagttgaaaagtgttatgtagaaccatcgtaagtcagggatagtctgtatttaatttgtttcttttggggtaacttgtagagtttaattttcttttttaagttgtttactgctatattttttcttctgaaaacgattgaaaacatttgtactcttttcaatggggttaagagaagaggaagattttgtgcttcttgttcattttaaagaggtctttatatattaaggacttttttttcattgattgtgaatatattccagagttcattattttacttttttatatgaattttgaatgaaaagttttaaaaattcttatgtaatttggactagccattcttttgttcttgattggttctatttcttttaagcttaaaaattttatcttaaccctgaatcagtttttttccctagattttctacaactgtacttttcaaattaaactgaaatctatcttagtgggggtatgaaagatttccagtgtgacttttccccaaatatctgattatgattctgctatgcgttgcattgttgagaaatgcttttcccattggcttatggtgcttttgttcatcttgacctaacctatcccatatttcatgtagatgcaccccatgatctgagtaatgacacttccactgtggccatgcagttttgattattatagctttgagatgcatttccaggtctgttagatactcttccttgtcatttttttatactgtggtcccctcccagccataactttgcacactctcgagagttccagtgactgttgcaaatgcctttaactcttcagctcactgtgaacttcttgaggacgggactcaatttgtcctaatcaactacacatcctctgtatcatagcccatcatagcattggccagatagaattcactgaaaacacatttgttatgttgattgtgcaatttctttctggtcattttctgggtgacttgtatttttagaaaacctacaatcaggtgtattatttgattaaatttaggaaagaaatatatgctgtatttaattggcttgtgtttctcagcttcaacccaagttaattcaactttcagtgttgtttgtaattaccagacatttagtacattaatgaagacttctttccagtagcccatttatatttactcttgaaaaatgatttacttttgatttcaaaccaaaaacattatcattctaatttctggattctctcatttctattttcaacccaaaacattccgttgagatatgaaataatattggatcagcctggaaggagaccttgggtgaacaaagcgagtttgcctcatttctcacaacacggtctagggtctgagttctcattttgaatcagggtggaggtgggaaaacagctctcctgggtgcctgttgaatgtgtgcctttttgggcatctgtttacattcatgagggtccacagaggcccagagaaattccaactacttgagtttttttttctatctacattttaacacttaagtcgattcctggacatatctggtacttcttgtgttttctactaggcataggacattactttgcacagagcaggtgttcaatagacacgtttcttttaatgtaaaaaaatttattgaatatgaccctcacataacaaagcagcccagtagtccccttgtgtacccccacccaggtattcccagagagaaccactgtcttaatttacatcgtcttgattagttttacttgtttttgagtcttacataattggaactgaacaatatgtaatgttttgtatctgtcttcttttgttcaacattacatttctaagattggtccatgttaccgggtttgataatatttcatcattttctttgctgtatagtattccaatgtgtgaatatattctcaatttatccaatctactgttaataacatttgtgttatttctagtatttggctgttatgagtgatacctctggtaaccttcttgagctcgtttttgtcttttgctttttttttttctccttttttggtaaagaattgctgggtcatatggcttgcatatgtttggcattagtagatactgtgaaacagtattccaaaatgtttgaaccacggtcaactcccacagcagcatggaagttctagttgctctttaatctcccccacccacccttgatactgtcagctttttctaaacaattttagacatcatgatacttgtatggaaatattgcattgtggtttaattggtatttccttgaaaacgaatgaggttgagctcctttttattttttcatggctatttgtatgtcttctttatgaagtacctgttgagttttttgaaagttttaaaaattgaattctaggaatttaaaaaatatatattctggatatgagtctttggttgaagttcctcaatgtgctttgcctttacattcacttaattatatattttcaggaaaagaaatatttaattttaatgtaggtccatttagcaatcttttttcctttttgtatcttatgtaaggagtatttgcctacccacaaaccataaagcttttctcctgttttcttctagaagtgttatttgttttgctctgaaatttggaatcagaattaattttatgtatggtatgagggagggatcaggaatcaattttcccatatggatatcccattgatcctccaccatttggtgaaaggaccattcttttcctactgcacagctgtgttcttttctcataaatcagtcagtacactgcgtgggtctatttctgggctccatgttctgttccattggcctgtctgaacttgttccaatagcacatcatcataattgttggagatttaaaatcagtcatgatatctgatagtggaaatcctaccactttgttttttttcttcaagatcatcttagtcattcttggttctagacatttctatataaaaatttgaattaatttacacacatacacataaaccttttgtaagttggattggaattacattgaacttgtgggtcaatttaggaacaaataaaatctttaaaacattcagtaatttggtctgtgaacatggtatatcccaccttgtatttaggctatttttcttttttctcaataatgtattctatgtataggtcttatgcacatctttggctagatttattctggagtattttatgctgctttaatgacatttaagttatctcgtttaaatataattttctaattctttggttctggcatatagaaatacaatttatttttgtatatggacttcctatgtaagaaacttgctaaattattctaattaagattattttggattttctaaaaacatttctctggagaaaaaaaggaaagcttcattttttcctttccgatccttaaacattttattccttgttgttctggttaaaacctctaatacaattttaaataaagaccttcttgtctcattcccaatctcggagggaaagatttgaatatttcatccttaagtatgggtttgcaatagattttttgtatatattcctcatgaaattaaagaaatttccttttattcctaatctgctggcagtttctaatcataagtgtgttaggagttttatcaaatgctatctctgtatttgtggaagtgatcctataacttttctaatttattctgttaatgtggtgatttccactgattatttttaaatgtcaagctaatcttgcatttctagattaaacctaacttgttttccatgttttgtctttctgcatttctctgcctctggtttactaatgttttctttaggatttctgtatctatggtcacgaaagataggcctgtcattttcatttctagtgatgcccttttctggctttggtatgaaggttatgctggcctcttaaaattgattccctcatgttttttattctctctgacacttgtgtaagactggtattatttcttccttgagagcttggaggaatttactgtggggcccatacatccttcatcagatactcaaatgtttagaagaggtgacatcctttacgtgaggttccaagttaagaaaaaaaatgttaaaggtagaagcagaggtgcctgtccatattttctcctagtgggaatgattcatttgtatatttatttattcagcaaaaaatatcctaaatgtttgtagcacaccagacactgcagcagttaaggatacagcagaagtgaaacacacatgcctgccttctaggagttcacattctggaccaaggagtgttttctattccagtttgagagtgtgtgtccatgcacctggctgtgagctctgggtccctgtgtgctggccctgcccctcctctggctcatggtgctcactccactccagggctccaccccatgttttcagtctccacccagacattgcttcgggaccttcagcaatgaggttccctgcccctgctttgctcttcccttcaccctttgtgtgtgtgtgtgtgtgtgtgtgtgtgtgtgtgtgtgtgtgtgtgtgtgtgtgtgttgtgacagagtctcgttctgttgcccaggctggagtgcagtggtgcgatctcgatctcagctcactgcaacctctgcctcccaggttcaagcgattcttgtgcctcagcctcccaagaagctggaattataggtgtgtgccaccatacctgtctaattttcatatttttactagagacggggtttcaccatgttgcccaggctggtcttgaactcccaacctcagatgattcacacacctcagccacccagattacaggcatgatccactgcacccggccctcttcactcttcaactgagagtcctgctcattattaatgtcactttttttagagaggactttcttggtccctgggctaaaggagattctccagtcccctaagctcagagcccccatgctcttctctcctagcatttacatgttcataattcacacatttatctgtatgattatttttgttttaatgtcatttgttgtcaccaaattgcgggcttcatgatgaaaacagttgcacctcttctactcaccaatgatactcttgtgcccaatgcaaaaccaggcacacagtaggtgctcaataaatgcgccttgctctccttcctttctaaagggttccagaaggccattaataggcaaaaaacgcaagcgtgggtgaaggctgaatctatcatgctccctgatgggtccccatgcccagcactgggtgctctcttagtgttagtaaaatacatgaatgaatgaatgagtgaattaatggatggatgaagtgcaattgaaatttattatgctcataaacacaaaaattaaatagatttactgcattaagattattttaagaagttgttttattcctacattcattttgtttccaacacaaacagtacataaaaataattatttcttggattcatgaaaaattgaaagggcccttgagtgtttatttagtgtattctttttggcagaattaatgatcttaataatgaaaacagcactgggtgacttttttaaattgaagtttttattgagataattgtaaatgtgcatgcagctatgacaaatggcagggagatatcttgtgtaccctttcctcaattttcccccagtgctaaactagaatatacacacctaattgggatactgacacggatgaaatccactgaacttatcccactgtctaacttaattcacatttgcagcactgtgctgagtgctttatctcatttaactgtgacaacagccctgtaagggggatagcattatcactcaggttctagagcctgggacacccgtgctcagagaggtggagcaactcgctcacagcctggtgcatgctcaggggtggagctggaatccccactggaaacccaccccccagcccgtgttcttcctggtgctggcgtaaaccatgatatatagatctgttccttgttagagatctctaaagaagaaaactacttgcttaacaaaaatgactttgctatataaaggtgtggtttttttgactattcctccagaatggcattttttagaagtctgaagtctaagaaaacctctgcaaaaattcaaggcacttaaatctttgatgaagcactcaaatgtattcatttatcatccagtctttcagtttcattgtagacagatttatgtcctttgtgatggtagctccatgtcctggaatggacctcccatccaggttcacagatacagctaagaggctggaaaaggtcgcaagtggaaggaagcttgggtttgtagtttcctcacatattcttagaagctaggggctggggaaacccagaagttaggtggtcaagggcaaaaagattctcccttttctgtctttcttccccaaaccttgtcacatggaagatttgaaatggctcccccaggcctgagtcctgggcagctgtgtcactgttggtgcccacctcccaggctgcttgctctgccctgcttggagaatgacaacttcttaagttgccacacagtacccagagccaccagttcctctcctggttgctgtgtggctgagactgaccctggatcatgaggcatcctgctgcccagcccatcatttccatctggtcctgttggggaggaagaaaatgcagaggcaaatgcagatgcagtatctgtggctgggctccagcaagacccctccaaggtctctgaccccagggccagtggtttcacccacctggaccatctacaagggtcaaatccagtgtgtgcagtgcctggaattagaggaaagagacatgcaggtacagcatcgtgaaaggccccttttgatgctatagaaaaaaaaaaaacctccaaaataattttaatcatgttcctatctttgtttatatttcattatggaatgagatctggttttgacttatattaaggtgacctgtttgaaattgccaattttgtgggtcgatgacagctgaatattggcagttttaaatggttcaatctaatgcgagttaaattaaaaccttgaggaatatgcaacttttcactttacacggctctgttttaaaaagggtgtcaacatatttcagccttgcggagatggcggcgtatgtctatcctgtgttgcaagcagctgtgaatggttgcgtcgttttgcttggcctacgcatgggcgtgttgtcaccagaaagcgtctctgctcctccaagtggtggcaagcccctcctgagagccattcctcatccagacaagaatccatcagatcttatgaaaatttaatgtgtgaaagtgtacagttgcatgagggtttttttcttttaaataaattagtttgcagcccttgctaacaccagatgaatgaattaagaatgcacctcccccggggctgtcgggctgctaaactgcatgctggggcgaaattccctttctcttattcttagctttttctttttttttgaaacagaatctcactctgtccaccagactggagtgcagtggtgcgatctcagctcactataacttccacctcccgggttcaagcaattctctgcctcagcctcccgagtagctgggattacaggcgcctgccaccacacccggctaatttttgtatttttagtagagacagggttttaccatcttggccaggctggtcttgaactcctgaccttgtgatccacccacctcggcctcccaaagtgttgggattataggcatgagccaccgctcccggtctcttagcttattcttaaggggaatttcctaccttttatttttcttcttgagagagtttcaaatttgccagaacctgaagggttgttgtgctttcagccaaaaggatgtctcagtagcctttagcccaccttcccccagggcaatggtagcatggaacatgcaacccctagcttacttgaaagattggacttgaaaaaaatcagcagttccttctggaatctgcaaggattggggaatttgaaagattcaggggaattagttcggcttcccaaactagttggttttagtgaccccttcttcttcccgttgcatcactggtgtgactgatgttaacattattgttgccccgttttacaaatgatgaccctggaaaggcttggagggccctggggctgcctaaggtcataggccaggaagaaatggagcctgtccgagggcttgcgtctcctcattctgaagcccaggctttctccatgttttcaaaatgccagctggttgcattttgtttttccaaatgatattgtagatgccagaaagtggggcctgtgtttccatttcttggttttcctgcccttccagctctctcataggaggcatatgatgagcacagggaacaggcatctgtgctgggcagacctaaaacgaggaaggggcaccgtgaccagttaccttgcggtgtggcacagtgctatcttgaagaccataacatctctcgagcaggctagcatatctggtccgaaaagtcgccatttctttgggtgggcttgtacaaagtggtccacatctcacagggtggtctgctgggctctgcaggcccgtgttgtgtccataatacatgatcaataaacacaaaagctgcccatcaatgaatccaggtgttcacccggatgggcgtgggaaactcagacaggcagaggccacgggctcttctgtctctcaattcctgtcccctttgcatactgggggggcacttgctgggggtagtccagtaattttatctcatggtgctccaccagagaccatggtgctgatggcacctactaagcgcaacgctgtgcttgactctaccctctgagtgtgcccactcagggctggtctccctcatgcagcccgaggcctcctgccaaagtccacttcaaggggaagccgaaggtgcacacaatcccctacgtctcctttgatccaagtacatcagctcttccaaattgtgtttgccgtgcattttttttccagaatcctcttaagaaggatttaagaatcttgccaaagtggccacttctcctaaaaacatctaacccagtcctcgcagattccagaaggaactgctgattttttaatttatcttcagtcatttgctttcggaagggaacatttattgtgttgaaaattaaagacttgataaaaaatgtttgctttttgtggtgtccttgaaaatcgagtgattttcacccaggatttctgtagtgggtgtcaggcaccgtggatttctgtactgggtgtcagggaccgtggtacaccacggtgcttagaaaaatggatgatggaggtggtgctgtggctggctagcatttattaacattgttattgccaggcaccatgtcaaccctttcctatgcattagctcatttaattcttacagccactatttgtggcaggtactagtattatccccattgcacatgacaggaaacggaagctcagagaggttatgtaacttgcccaagtttgaacagttaataagagcttgcattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctgggtgagacatgatgatggggcgatggtgggggatgtggcagcacaaagcaactttgtccactgatgtcgggaacgccttttgaaggaagaaaagtgtaagttgttacccagagtagaagatggccaggccaggagttgggaagggggttctagaaggcaaagtgcgtgtaaagttcttgaaactagagatacctaaggaatctagatgaggccagtctggttggagcaaagggtgatgagtcgggaggctggagagtgacaaggaccagattgcgtggggaggatactgctgcctgggggcttcccatcctgagggcggaggaacttgaacacagtagttatttgctatcaactgaaatgtattgagcccctgctgctctgtgggcatacaatggttggacaaacagacaaagtccccgttctcaaggaacttgtattccaacagaaaagaaaagaaatacacaagacgacgtcaaagagtgacaagtggcccaaagaaagtaaaacaagggcccagtcagggtgactcacgcctgtaatcccagcactttgggaggccgatgcaggcagatcacaaggtcaggagatcgagaccatcctggctaacacagtgaaaccccatatctactaaaaaatacagaaaaattagccgggtgtggtggcgggcacctgtggtcccagctactcgggaggctgaggcaggagaatggtgtgaacctgggaggcggagcttgcagtgagccaagaacatgccactgcactccagcctgggcagcagagtgagactctgtctcaaaaaaaaaagtaaaacaaggtggcacctcagattgaactgaggaaggtacaggaagccactacagtgggtgggcagggtgggcacctctgtgcagtgggcattcaggggtgaggagtcagcactgtggcagtgttgggagaaggtattcctggcagagagggtggctgattggaaggccctgaggcagcaacaaacagggcacgatcagggacttccctgtgcagtcagcgtggctggaatggagggagcatgatggagaaggcaccaagtgaggccagaggctcctcagggggtttggattggatccttaatggaggggtgggaggatgccctggagggtttcagcacaggacggcaaggcctgctgtgcattgctggggatctctttgcttccataaggtcagtggaccgggaagtggccagaatggcagctgggatgggcaggggatgagggggacactcttgccatcatgcatgccacacatgatggggagtgggcttgaggggcagccatggcggaagaggagccctcaggggtttgggagaggttagcaaatactcatgcttgttttgggaggagcctctgctcacggtgggggcatgggggtggtggtgagcaccgcagcttgtaagaggcaagcttgtgtggctgctgggtcccacgtgctatcagatggactcctatatggtgtgctgggaaagacgccctgtggctctcaaccagctcagcctatggccctgagagaggatgtgggcaggccctgaccatcttggttttcttccctttttttcttttttatttatttctctttttctttctttctttctctttctttctttctttctttctttctttctttctttctttctttctttctttctttcttcagctttattgaactataattcacatattatacaattcacccttatacagttcacagttctgtggtttttgctacactcacgggtttgtgcaactgcaccacagtctaattttaaaacactttcatcatcccaagaggaaaccccatgtccattaagtgctccctccccacttcccctttccctacccctggcaaccgtgaatctactttctgtctctctggacacttcatacaaataggatcgtacagtgtggggtgtgctgtggcagggttgtttcacctaacaccgtgttttcaagttcacctgcattgcggcattgccagtttagggctgatagtattccatgatacatagaccatactctctttatccattcatccgttgatgggcatttgggtttctttcccactttgtgtctattatgagtagagctgctgtgcatattcacgtgcacatttttgtgtggacacctgttttcagttctacgggatctactcaggagtcagatggttatatggtgacccagtcttcggggcaagctcaggagcagaatcatcgtacggtgactcggtcattggggtctactgaggagtcgaatggtcatatggcgactcggtctttgggcaatggtaaggagtgagaatggtcatatggtgactcggtctctggggtgtggtcaggagtagaatgttcatggtgactcggtcctcaaggtctgctcaggagtagaatggttacatggcgactaggtctttgtggtctgctcaggagtagaatcactgtatggtgactcgatgttgaattatttgaggagttgccagactccttccatgttggctgcctggtctgcatcctccccactgtgtgtgaaggctctgatttctcacctccttgcccacaccttttattgagcctgaacacctttcacatggtcacacctgacctgagcagctgcccggccatagtgccaacacatccctggccacgagaggtggcgcctgggctggccaacgtgcaccctcagggtcgggatgtgatctagagcagggcttctctcattctgttcctgcccatgttcatttcaacccccaaaaggacttgagctctcaggcttaatttcatttacttaatgcatgaaggaggaaatgatttctgaggccaagaccggagtggtccccagggactccatttcaacagtgtatttaaaccaccacgtggaggttgcttgctaggctgggaactgtgatcaaagaacttccaatattttatgttcataaaggcagtttgagagtaatgttttttaaaaaggcatctgaatggggaggaataggatcattgtgaggtccacagtctctttgcctttgaagtttgcaagaagctactgaatgagttccatgctttgtaatactctggtctgggcaccctcaggcgtgcgtggccggcagggacctgtaggaatcctcttcacctggggagatttgaagcctagtgcatataaccagggccgtcacccaatgctgtgtgatcctgggccagtcagttagccttttgcagttagctgatcgttttcacctcagcttgaggcatctctttcaggaagtttctccagttccagtacacgctctcaagcgactctccccctctcctcaaaatgcttacctgcattttcatgatgcagctatgatgtgcaacattcactaattgatgtctgtgaaccctggtggctgtgtgccaggtaggtatgtgctcaggtgtgctgtgtgctcagtgaggctgtgaacccacgtgggtgtgagcccaggtaagctgtgtgctcaggaagctgtgagcctaggtgtgctctgtgcttagtgaggctgtgagcccaggtgggtttgagctcaggtatgttgagaggagggtggatgtgagcccaggtgtgctgtgtgctcagtgaggctgtgaacccaggtgtgctgtgtgctcagtaaggctgtgagcccaggtggatgtgagttcagtgaggctatgcactcaggtggctgcaagcccaggtgtgctgcgtgctcagtaaggctgtgaacccaggtgtgctgtgtgctcagtgaggttgtgagcccaggtgtcctgtgtgctcagtgaggttgtgagcccaggtgtcctgtgtgctcaggcagctgtgagtccaggtggatgtgagttcagtgaggctatgagctcaggtgggtgtgagcccaggtgtgccgtgagctcagtgagtccaggtgggctgtgtgcccaccgaggctgtgagcccagatcggtatgagcttaggtgggtgtgagctcaggtgggctgtgtgccttattgaggctgtgaacccaggtgggctgtgagctcagtgaggacagacaccacacctggttttgctcatgggtatcaccccagtacctggcccagagcagatgattgtcttgatttgggttttggggaggtgaccctggaatgaggatttgagagcaagtaatttataagaaagctgtcccaggagaagctggcaccagtgctgggaaagtggcacagggaggccaaggaggggtagtatcaggcacagctgtgcaggggcagttgcagcctgaccctgagggtactctgagcatgagtgtgtcagagtttgtctctgctgaggccaggggctaggctacattcttgccaccaccagtcattggctctcggctctgtgcaggaggacagagaggctgagaggctgggagttggcctgtaggggtgcccttaggggcaaaagcacatgggagctgggaggctccacagccttggactggaggggtgggcagagcactgacagtatccgcttggggtcaggccatgtggatccagtgttctactccgatcctctccgacaggccttccagaacagggtgtaccatgtgctccagcacgagggagacgtgcttctgatgtcagctatagcagtgcctccagggtcgatggcacgagcccagttgacaatccccacagccagatgctttgaaatatgtgatccttgataaatttttaatttagggtaattttaagtttgcatattgcatgagactttactgctctttgaaatctgcataaatcacagtcatgctgcatgtttgggttgtcacttggcatactggccagctttttgttggccccccaatcctacttctgctaagggctggcctggtgtgtgtgaccagaatgccaggcccagaagccaccagcactaagtcaatgggaagtgctttgctcagtgcagagctgctgctgctggaatcactgcaccacttattccccatgacactgggcctcctcgccaccaggtcaagccagactcaagacgcaggcaaacggaaaaatgcagaactgtttgctccttctccctccctggaaacccctgctcttataggttggctttgttggtccagccccagcttcttgacttggtagggagttccacaggatgaggacatgctttttgtgtttttctttgcactaaactatgtgtaacatcaaatttaccatttcaacccttttaaagggtacgattcatgtgtgccaatcatgctagatataatttgcattttcctgaatattaattagggggaacatcttttttatatgctgttgacggtttggatacctccttttggaaggtgttcccggactttgcatattttccacagggttatttgactttgttcatttgtgggagttcttttgatattctagaaactggactatgtccagttaaatatgttacaaacatcttttcctgcactgtgttttgtcttttcattttacagtgtttttgattaaattcttaatttaaataaccaaagagtacagttcagtgctctgtgcagtgagtgcagtcacattgttgcaaaaccatcactgctgtctaattccagaacctttcatcacctacaaggaaattgtgtgatactcctcattctcccctcctccaagcccctgataactacgcatctactttctgtctgtatgaattggtctgtgctgaacatttcatgtaaatggaatcatacgctgtacggacgctatatggacttttgtggccggctgtccccatgcagcatcatgttatcagggtccctccacactgtagcaggtgtccaggcctcattcccttttatggctggggaatgttccatggtctggatagactatacttgatgtgtccatttgtccgctgatggacatttgggctgtttttgctttaggtcatactttctgcctgatgtaaaagtgccagtcgtgtataaggactgtagtcagcgccaccatgccacagcttagagaagggatgggggaactactgggttgtcagaggcgccgttcttgaccctcagagactttctgtctcctggaggagaagtggctgtgttgggcaggtttgaatcttgagaattcacggtccctgggtttgaggcctcgctgtgccacttgatgccatgtgaccttgggcaagtcacctctccctctgagcctcacttttctcacctgttaaatgaggtacttataaagccgaatagcctaattcaaacattttaagtctgaaatgctctgaaattcgaaacttttttagtgttgacatgatgctcaaagaaaatattcatcagaacattttggatttcaaagttttggatgctcaactggtaatgcaaatattccaaaatcagaagaaatctgaaatccgaaacacttctggtcccaagtgtttcggatcaagaatactgcacctgtaacacctgcctccttagtggtgtgatgattgcgtggaatgagacatgaaaagggctcagcccaaaatcgtctggcaccaaatacccaatggataggggattttgtttattttgttgttactgttgttgaggtaaaattcatatagcacaaaattaactattttaaagtgtacaattcagtggcatttagtacattcatgatattggcatctgccacatgtgtctagttcccgaacattgtcacatcacatccaaaggagatcccatgcccattctcccctcccacatcccgcggcagccaccactctgccttgttgagtggtcttctgtgactggctcctttcgtttagcaccatgatcttgggggtcatctgtgctgcagtgggtgtcagtgctttcttcctggtaagagcgtaacatggtgcagtcattgtggaaaacaattgggtggttcttggaaatgtgaaatataggattactgtatgagctagcagctccacttccgggtatctaactaaaacaactgaaaacaggtattagggggaaaaaaacctgcacacgaatgtccaatagcagcactgttgttcacaatagccagtatgtggagacaacctaaatgcccatcgacagatcgatggattaacaatttccatacaatggactattaccttttgttattattattattattatagctttcttaactcctattgattttttcaaaagtgacctcagctgtcatctcttttccacaaagagtcttacctgagtctggagaccattcctttttctgaccacagaaccccgtcttaatctctgtcctgcctcttccactcattaattcattccctgattccttccaaagtatttgttgggtgcctgctatagacaaggtcactccagtggggagggaccgacaacaccaagtcagctgaaataacagcaccgtggagggagtgtgtgccatgcggagaattttgggttgggtgggagggtgcttggatgtctcactgttgctctgatggaccaggaggagatgtttgcaatgaaacccaagtgataagaaggaggcagctttgcaaaggtggaggagagcctcccttgaggggctgcttactaggatccggaggtggggatgagcctggggaggctgcagagaactgtgaggttggagctgctcacagggagaggtcacagggctttgagggccaaagggaggcctaactcctgtggaagccactggagggtttgaggcagggtaaggcggggtcaggggtgtatgccatgtgacccgaagggagggcattgcgggaacctgggagcgatgagggagacctgggccgggggagtcagggcagggcggatgtagcaaagtcacattgtcctgagtgaccattcacttggctgtccccgctcccaggcctcaggactgtgagggcaggcactgggtctcaggcccagagaagatgctcagaaaaggaaaaggagaccggggcacgagtgagccagtgcagtgtgcagagtgagggggcagtgggcaaagaaattgcatggcccagatcactcactggagaccagagacaccttagtgtcccaggatgatgaagagcgaggggccagagctaggggagttagtgatgcatctgctagccgggctggccctccctgtgggcacagagaaagtggttcctcaacagccatgggtgacctttaaggatgcccacagatggtgccatctcaggagaagggtcccagagggactggctctgtcacctgctgtcagctgctcccggaaagcccgcactgcatgacttgctggtttgttggaatggttccatcttgctgtgtcacttccatgacaatcaccagaggaaccaggcccaggcaaggggcctgtgatgaagcgagcagccctgatgacatcagaaatgcagacagttccagacattcaagcatgatgtccttggctcttgggtgaaaatcctcctcggtgtgtcagggaaagtcattgaattcacgttggacccggacttggtaaatcttcagaagcacgctctattctgcaggatttaagcttcagatgggcctagactggtatgcacaggtagggactgtgcacttgagcacagatggaccttcagcccatctccttttggttctcatatacttgttgagccctggctaggccctcctgagctctgtttcagggcctgcagaggctgctgtacaggtcacacttggtctctgctctcacggtcaagtagccaggatggacataaaactaatgaacacatacatcaagagctaattaaaaattgtgctgaaggccatggtggaaaaataacaggaaacctaacaggtgggtaggaagggtgagaccatgagggatgaataggagttcatcagagaaaagtgttgcctccagagggaatggcacagaaggcagccctattgtgggaaagcacttaatgagcgaggagggccatggtggtagagaagcttaagaaatggaggccagggctctggggttacagtgggggttttatatttcatcctaagagccactgtgatgtcatgtggggagcaatataaggccctgtttgcttgcttgcttgcggggtaggcaggagtggaagcgggaaaccagggcagaggctgcagaactgtacaggtgaaagtgatgctggactgcccccaggggttagaagtgaaatgaagataagagatcaggatccaaaaccatttattctctccctttttcttcttggggcacccagtagtattttttcccagaagacatttcttaaaggatcacttaagccaggaactgtcaaatgcacaaaccaaatgcactttctactagtttttgcaaataaagttttattgcaacatagccatgcccattaatttatgtcccatctgtggctgcttcacactacagcagcagagctgagtggcggcagcagagactgtgtggcccgcaaagcctcagagttttattatttggccccttacagaagacatttgccaattcctgacctaagcaaagtgagtgagggacgcattttcaaaacacaaatctgttggcttaaagtcttcctagcacttaaatgcatttaatccctctgaaaaatgctagagtagacacagtttttaaattgacttttgtttttctttaaccttttgctgatattatatataagaaactcaccttatgctttaggtttagaaagtcagggttggaactcagactttgaagatgttgtgtgatattatttctctaaatttctactacaatactaaagtctcctgatgtgttatttcactttttgtcctttctctgaaatgctcattttcctccttttctgtaaaatataatctcagggaagaagtttgtaaaagcagcttttagcctttgcaaagatataggtgggcctcttgtacaataatttttataagagtttgttctttgcaaatgcagatgcatcctactaagccacatacaaaaaaatcatcacaatgatgacaacaacaaagccaattttccagattccacctttctccttcctcatcctcttcatgtttgaatttgtgctgccaaattctatagagcattttcagatccacttgatttacagatttgagctgaatttcacttggaaaactgaccatatgtctggcaggcaccagcgaccattggcagtactatagggttgatactaaacagatgggctttctagttagatgtgctgttttttccacaatacatatgagaaagaaaagaagccactttaataatgtcttgatttttccactggtgtcagagtcatcaatgatgcccatttatgtagtcttaatttcagcatcattgcgtgcagggtgccttagacagctagaagaagcttaatgacttgggaaattttgaggcccaacttctgcctagatcttagagaatcttgttatctttggaatacagatagtggataaaagacttttatagtccaaaaataaattattaacactatttgtcaggaatacattcaaagttcttagtcctgggtttattgctcaaactatttgacagcttttgtggggttattgcagtctaggcagcaaggtgtaaatagcggttgtctgataggtctgtttaggaaaatctagctaaacaactgaatacgatttcttcctgcagaacttctcagagcctatactatgctaatatgcactggggctctcatgaagagggttttagtacagacagcattttctaactactttaatcctctcagcatctccctatgctagagttccatggaaaacactttgggaaacaccggtgtcatgcctagatggtaaactgaagagcagagaggctgcggcagacctgccatttaccagctgtgtgaccttgaacgagtgctttcgtgctctgagcctctactttttaaatgtaaaatggagctgaaaatataggccctgcctgttagggttgtttgcctggaatgaacatgcagaaggttttggtggcctccctttgggcattaaaatataagttctcctaaaattaagtatttattcaattcacaattttccaggggccaattattcactctgaagcttagccaggcttttgtcttttcttctctgtgcttcttagcacctccactaaccagtaaaggagagaaaggagatgccctttgagttaagggctgctgagggggcagccagaagaagccatggccaacatgaggtctagaggtggctcgggaattgcagttaccttccactgtcgggagtcagtgggacagctccaggccattgttaaaaaccattgccctgcatttgattctgcttccatttttgtatcatgggatcaatccactcattcatttattcactcgctcactcatttattcaacccacctgccaggcactgtgctaggtgccggaggaggaagcggaccctaagtctaggaattgcattgtgcagttgttgaggtctctgtttcccctatactggaaaagtcagcagttagtccatcaaacaagggctataatcagattacagattttgatgaatgaacttgcagggctgtagaaaaaagcctataagcttttaggaatagagccataggcatttagcagtattttcttcccttttttgaataaattcactcctttttttttttttttttgcatccctccctgccctccacccaacaccagcaagcagtttattcctccattataagcagtgtgactataagacacttgtcaaatggtctcactttgtccttggatggtatgacccttgttttgtttttattgatcagcacacccaaaatatcatgctcttcagtcattacttaggaattttctaggggtggaggaggtcaaaccaagaacttttacatttgggagattgaaatctatttctaaaacttgattttggaggttcagctccattctggtggtcactctctgaaaatgcccagcactttttctgtagatggctgtcaagccacatctcttgcagcctggccacaggcaattggattttcagtgctcagtgcttccgtgtgaggttattgtatgttgctttaaaggttaacttcttcctcctcccagccctatttctccttcctcctcccagatcttagacagcagtgttatcatctgctctgtgtcatctagcacaggactgggagaggggcggagttgtcaaagaggctgtggggttaagatcagggcttttacagcagatgacctgagttctaagctccactctgtcgctaactagcatgtgccctggggtaattatttcacatctgtgtgcctccattgtcctcatctgtaatgtaggtgatgaaaatagttcttcgcttgctagggtcttgatggaatacaatgagcaaattcatgccaggtgctcagcactgagcctgttgcacagcaaatgctcagtagatgcttccgttgctgatgacagtgatgacaaaaacaaaccttcgtattccttggctcttccatatgtgtgagtgcccccatcctctgccttcctgccttcagccttgttccccctacagtctgccatcctcaccgagattccacgtggtcttctcacaaggctgaacttgctccaggtccctcaatgactccacattgtccccaggactcttatcacagccacacagctcttcttggtcaggtccccacacgccttcctaagctcacctatgtcaactctgttccatagaccataagctccagcctaagggtcctcaagttccagtgcacagacccacaccagcaaattaagaacactaagagcaatgcagttgggttttcatttacgaatgtagaatcaattaatttttttaagagacagggtcttgctctgttgcccaggctggagcacagtggtgcaattcactgtaacctggaattcctgagctcaagcaatcctcctgcctcagcctcctgagttgctgggactacaggtgtgcataaccacaccgagctaatttttttttccttcgtttttgtagagacagggtctcactacgttgcccaggctgggcttgaactcatgccctcaagcagccctcctgcattggcttcccaagccactgagcccaggcctaaaaattctgtttgtttgtttttttctgagactatattttttctattatgtgtactaagttgtgatgaacatagatgattgctttgtgtagtgtgtgtgtgtgttggccattactgccataatgaacattagcatatctgtgtggatcccaattttatatgtggaaattttactgggtttctgagccttagagactggggacctcagacctagcttccccaaatgactccccattccccaaacaccatgtactgccatgcatttatgaatttgcacgttttactaaaatcctactcaacctctaatacccaactcaattatcactacctactacctcccctagcttctagtagccttcttagagttatcccaccctcaagcaggaaaagttgcttcctctgctattataatcctctttcttgattcttcctggtggttccaggtaccttagttttctcagtggtcactgagtcccccgggagagagggtacctagcaccactttgtccctcaggcctaacactgtgctttgttcaaagacaatggtctccacgtattggtgttacaggtaaggactcaaagaagaaatagaggtcatatctcagcttcttatttgcttctattgtggctcatgtcacattatgaggttgccttacactttctgtgttccttcttttctcctccataaatacatgagcttcatgcagcgggaaactgcaggcatgttgatggaatttactgctctgtcaaaactcagagcagtcctgacacacagcaggccctcagccgatatgatgaatgggtttgtgagtgaatgaataaaacaaacaaggaaaaaattattttgcaatattatctgatagagatggcacctttcttctctaagaaatcagccatgtagcacatggcactgagtacctgacctcactcccccagagatatggggctttccttccaatatgtttttggggaatttcgtgaagtggaaggataagataagatatcttagtggatgaaagatgaggatgaaaaaatacctgatgtcactaaagggtggacatcaaagtcagatggacgaggaacagaccctggctccagcgtttggcagccctgcactccggattcacagggtcgagcaggtgtttatttgggcagcccctgggtgccaggaaccagcaaagatgcgagacccagcaacaagcacgagagtgacggttctcattgtcatggagcttatgtttgttctcatgggaaatgcagatgacagtcaataaatagtgaatcccagggcacaatctgagagtaatcagagctaggatggaaggaaatgtgaataaagggattggccctgcaccaggcatggaaattagcctgtaagctccatgaggtcagtgttccgtcagtcctagaacagttcttgcctcatagctctgtgtggctgttgatgggggaaagggatggagttagttacccagggacaagtataccagctactgtgagcctgagagaggcctgggagagggctggctggagttgccaaagaggctggagcttgtcccttgagttgcaagcatgtgacatcagcaggggagggccagctgccccatccatcatctgaggactgaggctgtgtgtagcacttcctcacacagatgccaggtgtgacagacatttcccattaattaacctctaatgcctcagaggtggcagaggtgcagtggaacctggcactactgttattcagaggctggggggtggctgctaatgtgtttgcaccttccagagtctctccagtgtgagaaggcagttcctcaggaactgcagggagagacggggagagaattcctggagtggggggaggtgctcccatctgtcccttccctctgtggacaggtgtgcatgggccacatgcacccgcccacagatggcatcccacccatgcaggtgcacacccacccacgcccatgcacactggctccgcaggtgctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacacctgccccgctgtacacctgcagtgatgggctcatgtcctctgcccttggaggggtttgtaagtagttttctctgagcagcactattttgaagtttctcttcttgggcggagagtcatagctctcacaagccctcccctggcacagtcctgggcttgagccaccccagggaaggcagaggggagagggaatttcctcccaagggggatgcagagcagcacagcctggggcccctgggcatggggtcttcactcctctgatgacagttgagccccttgaggagctgcttagactaaggcatctgtcctggtcaatgcattggatttttggtttaggagcaaagggtcttttgagctgaagaccctctagtggctccctgctgaattctgaatcaggttcaagtccctgactacgaccctgcctgcctccccagcacatccacgcctctcaaccactgtttcctcctgtcttggacagcctgcccctttcccatcatagcccctgtcctgttccccactggggcggccctctggagcacccagtgctgaccctgtcacagtcggtcagtcgacacctgccctcgaggctccctgaggaggccctgggtcctgtccttcctcgcgtctgtggggatcctggttcagggctctctatgtccccctggcacgtgcctgagctgttgctggcactggagatacagctgcaaacatccatcaagggcctgcagtcaggagcttcagctcggggcatgggcaggaggagtggagacaactacaaacaggtaaacaaatgagtgtgtgcgtgcatgtgcgtgtgtgtgtgtctgtgtgcgtgcatgtgtgcgtgtatgtgtgtgcgtgcatgtgcatgtgtgtgtctctgtgtgcatgtgtgtgtgcgtgtgtgtgcatgcacaccagctgatacctgtgatgagaaaaataaagaggaaggcaagaaatagtgaggagtgccatcccacatggggtgagccaggactgtctaaattcatacctttattcattgttcatctcctgcaggtgagtacagccccacaaaggcaggcatcgtctcttttgttcacctctgcacaccctgtgcctattaggatacatggcacatggttggtgtcagtacgtatttgttgaaaggtggagtgagtgagtgagtgagtgagtgaattcttaaagggagagaggagtgcagtctcctcagtggccaaagtgctccctcgccagccctcagctctgctgtgaggaccactgtgtgtcagagacggggtgggaaccccagaacctgctccagccactagggcagaagtggggggaggcagctgattaaaatagtgcaggtagtgacggtggtcctggcagtgatggtggtagggagggggaggcgccactgcccctcctgcccaccttccaccagtggaagcagtcacatagccacagcaagaaggagacaccataccccccagcaaggccctggcaaaggggatgcagggagtcaatgcttcaacctcctgttagtaagtggcagggccaggaggggagcctggggtgcctggtcccagcccccatgttcttcacagctacgtcacactggcttccatggcacatggcaagcactaatgcacaataaggatgataataagggggagggagcagcagagcacagagagctgcacaagtttagtgattaacttggattttgtcctaaatgagaagggaagcgagcaggaagtgatagggttagagctctatttctaagacatcggatcacaggaagaccagttgctggggcagggatgctggtactggaccagggttgttatgatgcaggtggcaaagaaagttgggttcagggtctgatctgtagtttattctgtgtgctactccgttttgccttggctgctaggaagctcagggcacacaaataccctcctctggagcccgtgtggtgtctgtcgtggggacccacctaactccttgatgctgtggccctcagcagaccctgattcctccagatccttcctgacactcccttcatccttcagctgtgtatgtgtgtttctggtgattgctgccgatcctttgtgaaggaggtgagatataaataaagcaatgattatgctccatcctcgtctcctctgctcatccctggagatcttcgtcttcatcttcagctgagcttggaggcttggggagacctagcccatccttcccctcgtgcaaagcatgctcaggacagcaggctttcccagggccatgtggagtcacagtcttgctcccatctggtgtctgtaggtggaggaaggaaaggagaggatgagaacatggaatgcattgtctctgagaagagaaggatccctgtacatccctctgcctcccgtggccttggggagagggtggccgggaggatctgtggttaattggtgttctgcagctgccctggttccacacatttcctgggctcccactgggtaccaggcactaggtgctggggtcgcctcaaaaacacagtggaggatgccattgctgtagctcccttaatggtttgcagagcccagaatgtcaaacaagacattcctgggcttgtctttccccatggggctgctttgtggagcatctgtggacacagcacctagcacagttaacacttgtattagtccgttttcatactgctacaaagtgcccccgataaaacaaaaaagaactgcccaagactgcatgatttataaaagaaagaagtttaattggctcaaagtttagcatggttggggaagcctcagaaaacttacaatcatggcagaaggtgaaggggaagcaaggcaccttcttcacaaggcagcaggaaggagaagtgcagggcgaagggggaggagcctcccttataaaaccaacagatctcaagagaactcactcaatatcatgcggacagcatgggggaaaccacctccctgatccaatcacctccacctggtctttctcttgacacatggagattatggggattataattcaagatgagatttgggtggggacacaaagcctaaccatatcagcactctattagtaatgcctggagagaatgacctcatgccccaacccacctagggtgggcctggtttatcctcttgtcttggtgtcccatccttctgtgttctgctttgggtcccctcgatgcagctttggaaggtgagaggggcctctggagtcagggtgctcaaggtcctgccctgccacagcatttcccagctctgagaccaacaaaaaaatggctcagggctctgatcttcagtttgttcatctgtaaaatggatataaaatggaatgatctctagctcatagatttattgtgaaggtaaaataggacaatgccttaggatagtcctggccctgcacaggcagtgaccagcgtttactccatcatcattattctattgctcatatcatagaaattattataatataaattttgaccaaaagttacctgcactggcatggtatgttaatcagagtgatgataaagtctagacatatagataatattattttacatggatgataacatgaactattaataaactgtgtattgtggatgtttatctttgttttcagattgtttttcattttaatttttttttagagacagggtctctctctctgtagcccaggctggagtacaggtgcaaatcatagctcactgcagtcttgacctcctaggctcaagtgatcctcctgtctccgactcttaagtagcatgcaccaccatgcctggggaatttccaaaaatttttttgtagaggtggagtctctgtgttacccaggctggtctcaaactcttgggatcaagggatcctctagccttggcatcccaaagcattacgattacaggcatgagccactgtactggccttcccagaatttatgaccacactgagtcctcccctcaaccttacctatcagggatgattatcatggcatcttttttttttatcaacagatgtggaaaccgaggctccaaggggccgggtggcttactcaaaggccctgggttagagacaggtgcagccctttggaagccagaccccgtggaagctctagaggctgccaggcaggccgcctgtcactgggggcacagaggtcactgccatgtggggccttgggccctcgggtgctgcctcatatggctcttctcaggctgagctctgcagagcccagattcagagcaggccgtcctgggcctccttggggcagccagtggcatgcatgggtgccttaggtgggaaatgcgggagtgtgaccccttccctgggtctgaggggcctggcccatcataatccccggccccttggacactggtaatgccccttcccctcgaacactggtggtctccttccctgtcctctctgacaaaggtgacctccttcctcaggtgagcccttgtgttagccacaccgtccagcccttctccctgcatgtccatgcttcctggggctctgaggtctgcatcagcttagggctcccagccccttccacaggtaacaaggcaaattcacctgctggctgtggaactgaccacgcgctgaccatgggaggctgagccagctgtcggggagtgtgtatgttcgcagggcgaggggtcctggcagaggtctgggctcctgtggtagcagccgtgctggggagcaccccacgggtctgcgatcttcctcccccagcgacactgggaggttaaatcggagcctggttgggactcaggtccttgttgctgccagaagaaacgtcccttccctgtcccaggaggcatctggggcaatgtgctcatctattctcagtcctgcctgggtgacggcctgaactctgctctacactgtgaccctaggatggaggtgacgctggcttactttgtgagcttctctaactttaccattttgttagttgcattttgtttcattctaactaatctttcctactaagggacacacggcttgtgctacaaaaacagcctgtgaagcacatctccctctctcccccgcctgccaacagccagggctccccatttctttctttctttttttttttttttcttctttttttgagacagagtctcaccctgtcacccaggctggagtacaatggtgtgatcttggctcactgcaacctttgcctcccgggttgaaacaattatcctgtctcagcctcctgagtagctgggattacaggtacccgccaccacactcagctaatttttgtatttttagtagagacgggatttcaccatgtcggtcaggctggtctcgaactcctgaccttgtgatctgcctgcctgggcctcccaaagtgctgggattataggcgtaagccactgtgcccagccccggggttccccatttctttggagggcccacagacattttctctccacacaccagtgtgtgcctgtataccacccctgttcgcacactggtggcgtgtgcgtgtgaatttgtgcgctggggttttctttggcctgattatctcagatcagtttcctgtccgtgcttggagatccactttctttctttctgcatctgcacacaggtggttgacaggacagacgatgacttacccagtccccctgtggacgggtatgtaggtcggtatgagtctcttttacaacaaacagcactgccatgagcttcctaggacgttcatcttcacgtgtcccagagtctacaaacatggccgtttcatggacaaggaaggggtccaggagcactgcttcctctgcctgctcacagacgtgctcacagacgtgctcactctgcagccgtttgctcagaattctcaccggcctggctctgcgttgggttccaaggctgccccaggcctgggctctaccctagaagaggtggcagcctggtgggagggcaggcaggcagaggtctttgcggctcattggtgcctgcataggtagcttcatgggcgtaagacaagggagtgaccctgtctgggacaagaggaaggtaaagactctggacaaagtcctattcaatggaggagctgaagtttatgaggcagagaagcggctgggagggagagcagcgtgggtggagggcagagcacgagcaagggtcctgggcaggcagcgtttcatgctggaattaggaacatcttcacacgtggcgcgtcatatggcggaaggcgaaggcttctggtggccgtgagtgggtcgcaggagggagggtctcacagagggaaattcagcgcacgctgctgagctgctgcggccactgtgggtgcactgctggacaaccatcctggggtccaggctttggggggatcactggtgaccccttagggtgagaggtcatcaccttgggcccccaggagtcacataggtttggtggccacttgaggacccccttggttttcgtcttccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcaggtaaaggcctggtgacaggcgcgggcaggctgtggctgggaccagcgtccttggcatggtgctgcggcccctgctgatctgtgacttcctggcccctacacaggaggggcagatgtgcttcatggcctgtgatggccaggagccatgcaagttaccccgctggcccctccagggcccacctggcctccctgaagccctggggtggagttggcaccaggcaccccatgtgggacgctctgcccagaccctaaggtgcccacaagtccactgggaccttgttaaaaacgaagcctctgatttacttagggctgggttgggccgagacactggctttggagcaaggtctcacttgctggcttcacctgggtggtgagcccccagcccacgcgactcccgcaccacctcacctcccacacctgcaatctcacttggaggatgctggggcctgggtcgtacccccacagatgcaggtttagttggccaagagcctcctgggtgactcagggttgaggccgtcggtttggctttgacacctctgggcctctcttcttcctgaaagacagaggctgctcccctgctcctaagctgtctcagtgtgccttccctacaccctcccaccaaagcatccagaaggttcctccactcacctcctgctgccccctcacaccctgccagccctggctctgtgggaagcgggattgcgatggctggtcccgttgcccccgcctcctcggaatccagcttgggaactgcagccatgaggctgaaccacagacagggtggacacaggcagtgatgacgggacaagcagccgtaaggcacataacggcagaacacggccccccagcatttggcatggaggagccaactcaaccctcagaacctcctgctaggccagcactcccgcaggatcctgccccatcggaagggatggggaacaggcccagaaagggaaatcactcacccagggtcacacagccagcaggtggcggggctgaggcttggaccctggcagccgggtgtggtggctcgtcagcctgggctctgcagatggcagtgttctgagaagagagcccggaggaggccgcatctccaccccagggccccgcctccagccacatgcctgtgagccacacctaaaaacaattagtgagggagctgctgctgtggaatcagtcccaggcctcaggaaccagccctggcgagtgcccgtctcaggctgttgcctcggggggtccctggggtcccatttcctttccagctctgaagaggcgcaggctccagggctttgaggatggtggagacgaaggccaggtgttacagcgcccaggcccacagcaggggaggcggccaacaccgacagcaggccctccactcatgcttttctgtgtgctttacaaaattattattattatttttaccaaccaagaagttgatagatgaattcttgttgaagtggaaacagaacaagcatcatcattcggcagatcttgagcacctcctgtgtgcccagtaccaacaggaggggcccaggccctgcccacccagagctttccgcagagtagggagtcgagtgacaaagtgtggaagccaccaagtgaaccagcacgtgagtcgattgcagactccggcgaggctgcaaggcagcctccctcactggatgctaggctcagctaggtgggcgggttccatttgttcccctgcatctggcagggccccttgcacacacacggcactaatgggctcttagtgatccaggcttaatggcaggatcacggagcaggccctggggggtggaaatgagcagggcgggcactgctttgggcccagtggtccgagaagacccaggtgaggaggctgcattgagctgagatgtaattggttcattgagaaaggcagggaagagcatggcagcagtgggaacagccctcgaaaaggcagcgagctggggaaggcacgtctgtgcagcagtgaaaggccgggggactagagcagagtgacctccgtgacctcaggggggtctctgacattctccaggcctgctgaccccagcagtggaactggaaggctgaggtttgtcttctgaggactctgggctctttggcctactccaagctgtgccgtgtgagttcaccagcaagatgctctggggaccctgcaagggcattggaggtctcgaggtttttacctgcagcatccccaccttcaggaccgccattcgggcatctggaaattcgaggaacagtgctgcattttgtttacttattccaaaccactattttcctttaaagcagggggtgttatttgtttcagcatatcaaattcctgatttcacgggcatcacgggttaggatgagttgaagtgaatgcaaagatgattgaaagagaaatatgtagcaaacagtggttttggtaggcgaggctgggggaaccggctgaagatggctctcaggggctgcagggtggaccagcatctcagtccatgcctgccctggcaggtggctcagatccactcagccatttacacactgtaccaccttcacaagctgcaccaccactgacgtccccatccccgagagggggagggtagagcctcgcagctgcatctttgggtcatcgggaagtccttgagtcagtgcaggcaaagacctgtgatgtctgaggctagccaccatgagcaccgcctggtgccggcctggggacggggtccacacagagctcgaggcctccacccctgttcttcttatctgctttgtgagcctggctgcagcctctttgctgacacctcccaaggtcagcattcactttgtcaattttatccacaattctggcacctggaaattggcttggaaattgggaccacagaaaggaaattctgttttctctgcccaaaaatgtccccaccctgctgtgtttgggtttcccttttcatcctttggctttagggtaaatatcctcagggaagccacccgggaggtcaaggatgggatgggtttccccagacaactgccccccagtcagtcccccgccccaggcctgacttattcctcctcgcccacttctagacacttgccatctgtcctcccacctgtgctggcatcaggcagaggctgtgcctgtcttgctcatggcagaatctcctgtgcctgacatggtgcctggcacacagtaggtgctcagtaaatgtgtaaggggtttccatagattgaacacctgatcaccatggcctgttcccccagtggagccccacctgtgaaggctgcagggcttctgccctccgtgactccccagcacccagctcagcacttggcacatagcaggtgctcaggaaatgcttttgagtaagtgaaataattccattgccagtgcctgtttgtcatctgcctccccaactagacattaagctaagccaggtgggctgactctgtctgttccccggcagctggcagggccccctgcacacacagaacactgatggactctctgtgatccagggttaatggcaggatcacggagcaggccctggggtggaaatgagcagggcgggcactgctttgggcccagtggtcggagaagacccaggtgaggaggctgcattgagctgagatgtaattggttcattgggaaaggcggggaaatcatcacagcagtggaaacagcccttgcaaagctgcatctttcaaagaaagggttgaggtggttatgtagtcttgtatttggaaattggggctcacctgtaggcaaacagttttcctgacggaaggaagaagatgattgtggagcagcccgaggcctgcctgtgaaagaagggagaatgggacaaggtggtggccgtcgctcaagagtgttttgctccgggaaggggaggcagaaagggctattctgaaggcggaattgacaaagatttggcaaattaggcttggtggaaggggactgggggctggcctcctcccttcctgtccatctggtagactggaagcttttaacctgggtttattggaagaagctctagtgggagagccgcacaggagaatctcatctgtgagtggatgttaagagcggccaggaggcacttcgcaaaggcgaacaggaaccacggaaaggagcccggggtgttggcggcagagggagggcactttccttggttggtaatttagggaacatttggtgaagggcaggaatggctggtgagagctagcttagagaggggcgttatatgtgcaggggctttccagataaatcacagaaatgatcgctgtagaatatctactgcgtgcactgctctttagctgtggtttatgcacattgcttagcagcactcttggtaagaaagttgggcctcgccagtggactaggccccctaaccccgaggcgcctgctagctcagtgtttttggtctgtaaacttgagcctggcattggctgtggcttggacagggcccagtgacacctttgcctgagactcacctgtgtgtttgtgtgttgggcagcgctggagaagaagatggccggcaggcaaggccgagaggagctcatcaagaaggggctgctggagatgatggagcagggtaagtgggacccgtccctggcttggaagggcacggtgctgggaatgcagaatggaaagtctcacatgagcccaggaagcccatcagaaacagtgtagaatccaaggagggccgtgttcagatgaagcctgcaaggttggagagacaccccatgtcaggagccattccattggtccagcccccaggggcacgggagaccccattactgagctgaagagctccccctcatggcaccactcctctctggggaatgtctaacagagctgggtgtgcatgaatctggtggtttatcccaattcctttaaagtggtagcagtggttttttcagcattaatttttttttcatattcacatttcagtcctccatttgggcaaattatttttaattccactattacctactccccctaccaccatgtaggaagcattcaggacatgctggggcggggtgggatattgtgcacgccctgtctcattggtcttcccagcatccctggggagagaggcagcggctatcccacttgcagacgaggcgtgggagggtctgggtggtgactgccccaagtcattgcagcctgagagcagagacacagaacaaatcctgatctcttggtctctggtctagagagcttaatctcagtggggtctacataatcatctttgtttccatctttcagaaaggccagttattatcactcatgcaattaactgaacagagttctttaattcccaagtctttctctttgtgatggattcctggaggtgtgaggcccaggacttagatgctgacactagcccttggtgccttccggttccctgagaggctaaatcttggttaggaggtttcacaacacctcactgcctctggaagactctctggagctggaccaagctctggcctgctgatttgaggaatctggccatgcatagccagtttcctgaggcttgcatggatatattgaattcctctctccccacttcagccttaaaatattactagtgtctttgtaatttggcccaaatatcaggaattaggaaggaagctcatgaaataaacgaatccagattttatgcagccgggcctgtcagcacacaaacccgattgtgggcccaggcttttgtcattgtttcctctctttagactcgaagagtgaagtattttgatgatgctatttttaggggaaatctacatgggaaattgcttcatagtgataataaaaccttacatgtgcgaggaaagcttggtgtcaagtcccgtggcactcagatggttaacgccgtcgtgacgctcggatttggcggaatgcggttgctgagctagaaatctggaggattttcactgggatgggacaaaaaagtgtcaaactccggcattttgaatatgttgccaacaagcatacctttggatcttagggaaggagaaaggaagatgaaaacaatgctaaggccttttctcatctattctaaaaaaaacactacttttgttgagtaaagagtaagtatatagatttggttcctctcaaaaatgaagctatagtttgactaattaaaggggaaaacttctaggagcgttggcttttttccactctgaatttttgcaagatgactttgtctgatgaagtcatagcagaggctggagacgaatgcttggccgcggccaggctgacagtgtggctctcaccctgctgccgtgggagcctggtctctggcttccgtgcctctgacggcgacatcacacacccgcaggcttacagaatcactttagatcagggtcggcaaaccttttctggagagggtcagatagtgcatatttcagggggacgtgcagtctctgttgcaactacttgtctctgcttttgtagcgcaaaggcagccggagacaaaacatgcatgagagggcatggctgtgtcccaagaaaactttatttatggccactggcctttgaattttatataattttcatgtgccacaaactattatttttcttttgatttttttttcttttgtcaaccatttaaagatgtcaaatccaggtgggggagctggattggtccccacattgtggtttgctcatctctaccttccatactctctctcttgctaaatgattgtggaccagggactagagtggcctgaaacacagtctctttccttgagagggaaaatgcactcctaaattgatgccatgacattttattgagggcccactctgtgtcagggtctgtgctagctgctgaggacacaggtgagcaaaatactgttctgaacgcacatccagtggggccattaggtaatcccacaaaaagccggcaactcacgaccacagtgagtgcagtgaaggatgcagcaccctaagatcatgagacaggacctgacctggttctcggggggccgggagatgtttgagtcaggtccaaaggtgggcaggaggacctaggctggttctcagagtctgttgcatattaggatcacctggagagatttaataaccctccaccgctcaggcagcagttaaattagatgcgctgggcgtgggacccaggcagcagtgcttcctcatcctccacagctgattccgactttgatgcaggaaggttgaaaagccaagagacagaaggaagcggggagtgacttccagcccacaggagcagcaagcacaagtccccgcggtggaagggaccttgagatggtgggttgggttggaggaaaggaggaaggaggaagcaggaaagggagaggggcttgggtcaagacgcctcccgtcttccctgcccacacaccggctggggtggcagaggcatgaccacgctgctgcgggagcctggggcggccacagtgcgagtgggtgggatctgcgaggagcccgagtgtctctgcagggaaatatcagggaccgggcagcaggggttgctctgggaggggacttggacttgcttttcgcagtcgactcttctgtgctgcttgaatcctttactgtgtgccacctgtaatcaacctgtaatcaacgtgctgtaataacgggatccacgcagatgcttggccacaggctcccggctaaatccttccctgcaccgcagtttccgtcctgcactagcttcaaaaatgtcttttctcactgggtcgacctgaggtcagaccctgtctgtccctaatcctcctggtgctgggtcaccgggtcctcttgcaggatgactggaattgttggcggtggctgtgcacctgccctctccggctcaggggaggatcaggcttgagggctgttgctctggggtaggcacgcagtgccgccgcctctgctgtggatgtgaggactctccagggtgaggagcagaggcgctttcctggctttggggttaaggaaccggcttcagggttaaggaaccggcttcagccaccgccttccactgctggcagggacgaatctgcagccgggggcgccctcctgtggccggccaggctcatgagcctccctgcaaggtggacgggacttcatgcaggacaggccctgtgaggctgtgggagtggattgtcagggactccagagcctcatttgagccccctcgaaactcacatttgaacttccttggccaggacaaaccccaggattgccctctgccctgcacacgcgcatgtatgcacacacacatgtacatacacattggacaccctggagcttgccctgaagcaggtgggcagcctggtggagtgagccggactctgggcagggccagcagaagagagcccgccagctcccgggggtgaggcagcatccagggcatgagtttgctccctctggggtgttactttatgatcgatggtctgttttatgaaccactgtgaccccctcccctctcgttcctgtgactctagtcgccagcttggacctaggaaggaccctgctggtggcgttattacatgactagatgtgtgcagtggagcccgttgtgccctggggagggcagaggggacccctctgatctcttcagtgctccttccaccctcgtctcggatatccgtgactaagtgaggccagaccaaatctctggtacaaggggtccccttccccagcccccttgccctggtccccagcccacgtttctctgtgctagacactgtttatgttctgaatgactttcctccatctccctgtatgcgttgacttggcattttcttaaataatttaaggaatttcctaccccgtcattgggtataaaagaagagagtttattactctgtgctgtgttcagtgacttgagattgactaggcattctttcctcagggaattggacagtgacaaatcaagtctatctggtttccatgtggtaggaacgccgggggacacatgtctgcacgtgtgcacacacatgcacgtgcacctgtgtgcacccacctgtgcttgcactgtgcacatgtgccacgacacacgtgtgtgcctgcgtgtgcatctgtgagtgtgtgtgcatgtctgcaacacgttccctctcactgtggctgctcaggtgcactgccccgcgctcccctctgcagccctcagaaggagagtggccgggcggaggctggccttccagcgagaggagcagggcctgggctcccaccgctcccccaacccctccccaaccagcgtttcttagcaacggccctgccaccagggctattttgggaactgaaacttttcactgaacatgattatgagctggagctctgaccgcagcccagagaagtcctgcaagaagtccttgcagaaaacctgcaagaaagcaggggaaggttcaaagactgtggaggggcatggtgcttttctgagtctggagacctctgggccttccaggttctatgttctgacctttttatagtggcagttgtgatgattttgatgatgacgatggaggcatccttattattaacagcagtgacagtcatggcagcaaaagacctgtgcattctaaggtttggtgtccataactgcaagtggtgggtggcagccttgcctgtcacatagggtaggtgtgaagctcaagctggcagagccctgtgctcccctacgccagctctcacattccctgtgtgttgccaggggctgggtaagctgtgctgtcacggttgcacgtcaaatgcgagtaagtcggtcacgagaaggggctggtttcagttttcagctttgtgacctctaattttgtctactcggtgagctctcttggcttgtatctgggttggtgggctgttatagccaagggtcaaatgtggctcaggacctgtttttatgtggtctttgagctaagaatgctttttaaatagaaaagactttcataaaaattaaaaaaaaaaaatcaagggttgcagcacgggggatacagcacgtggcccacagagcccgtcacaatggccatctgcgccttatgggaagagcctgccagcctcgcctggacctctgggcaactgacgcggctgcatggatgagatcgtccagccctaaatctccagacttctggcatggctgaccttttcattctccccggaggagacgtgtgcggcagagggaatatgatcagcagcgatgacaagctcaaatctcttccagggtcccaggcaggaaatgggtctggcatgagtcctgggtgtggtgaggactctggagggagaaacggttctgtcctaagcctgctgttagcagatgggcccaaaggtgcagaccaaggggccagatcactcttgtcaccctcctcttctcgttgtcagaaaccatcaccaacaacaatgacagaaagcacatgtaaagtgcctaccttatgccagacacattccataccctagctccgttaattctcactatgttgccatgaagcaagcagaaatattatccccattttatagataaggaaattgagatccagaggaatttgctatttgggcacaaaacaccgtttgcaggtggtgggacgcatgatggggtgactgtatactgtttgtccaaacaggacacttttaggagtgaaagggacactgttgaaggacacagggatggcaggtaggaatcgggactgaccaggtcctatggaccctgaccctgaagtaaatgttgcctcctccttccactgccaggatgggacgtgtgtggaaggaggtcagcgtaggctagcatccccaaacggccacctcgtggctgtgtcgacatgtgcaggtcacactgccctctgcaccgggcctccaggaactgctgtagagattgagaggagtcctgcagggctatgtggaggctttgtgcatggggctgtaacgtgcatctcagtgacgtgactgtgacttgctggccgagggccctgccatcctgcagttgggtaactgagccatttattttgctctccaagtgctgagcccctcagcattaaggtgcaaacccagggatggcaagtgaagggccagaccctcagaggctgcagcagccgagcttcaagagacggaaagcaccaggtccttccttatgccctgctagtgcctcctcttctgggaaggctgcctgtcagacctagggacccccggctctgtggcccctccatccatgggtgtgccccgttcctgggctcacggtgccatgtgtggtcatctgcgtggcttcctcagagtgtgagacccctgggggcaaggactgtatcttactaacctccaccttgccagggtttattacagtgccagacacgtagccggtgatcagtaaacacctgtttaatgcctggctgagggtcaaacggtgggtgcagaggtgagttggttctctgcagccatgacaacccctgcatctcagagacctacagcaatcaccgtttgttgtcccctgtctgggttggcctgtgatctgccccgtgggtctgctgactccagccagctgctgggcatgtcttcaggacaaaggtccagggaaacaggagggacgagcagggatgtgcaagcacttctcatgccagtgctgcatcatacccactgtgtcccatcgaccaaagcaagctccagggcagaggccggggtcagagtggggctactgcaaaggtgcacggcagtgggtgtggacgtggctcaggggcactgcagtctcccacaggtgtcggaggaagagtgcacacagggagtggagtgtaagagcagaaaccaggctagggtgtgctgaggtgcccagggctcccctggaaagtccagacttggagagggactcctagggtgtgtggtgagggggagaggggtgggggaccacccagagcctagaatggatacttctcagaaagactcttgggacgacggaagggatgaaggaagggaggtgcaggcccagctgacagctacatttccttgtagatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggtactggctggagaccacgcgaagttgagctgctcctagaatggccatacgtccccactgttgtccttggctatagcttaggcaacagccctcgtagaacattgttctccagagagctgggcccgtgctctaagcgctgccatgctgtgctgcctggctgggttgaagtgtttgctggggcacttttctctactgtctctttccaagtctggcacggctgataagtgaaggtacttaacgatgttcatctccctggcacacctaccccccctcccagggcgtctttgtgtttccctgggaacttctaggcaggaaagtgctctctggaggggcaagtgcccagtggggggattttagtgaccctaaaagggtaggaggtagggttgagggacttttctgtggccgaaatcctgccacagggggcctcttggcctaagagatgctgaagtccctgcatgtgtgcatgcctgggagctggtcggtgctgatgcagtctcagcatgctgcagcctatgtggggctcttccgctgcttcttgaggggaggtgggcttggtgccttgctccaagcctcagtttccctctgttaaatgggaaaagtaatggacctacatcagggttgtttggagggtgggaggaacttagcagtgtctgacgtgtagagtgactattatcaaaggcagtaggggctttgcgtagtggtggtggtttttattttaattgaatagaccagggcgcttcccaaggataggggagaagggaggaaggatagaggggaggaaagcaggaactggccacagacacctgcagatgcttcaccagctcctcctcctcctgcccacctggcagagtgattcttacggagcttcactgttgacttggaatcctgatgtctcgtaaaatttcaagctataagcgagtctcacacggtttgggggtgggaaggtgaacgcgtctctccgtgagtgtgggaggttggaaatccaggccccaggacagcctgctgggcttctgcttcagagcgggtggacacctggtcctccgtgcccgggacttccttctgccacacaagggtggcaccacacactcgcaggccgcccgtccacaacgcccctgcagcgctagcggcacctgcccagaggcatgctcagccctcttcgggggtggccgtgtctctccagtttcacttggcttggaatttggggtctgagagttgtgacttctggagggtcccagctctcacgcagaggccccctccacacacacaggtctctgtgtgccccaggcatctgactttggggctggcgtggttctttttttttttaatactttaagttctagggtacatgtgcacaacgtgcaggtttgttacatatgtatacatgtgccacgttggtgtgctgcacccattaactcgtcatttacattaggtatatctcctaatgctttccctccccctccccccaccaagcaatggcaacaaaagccaaaattgacaaatgggatctaaactaaagagcttctttgcagcaaaagaaactcccattggagtgaacagacaacctacagaatgggggaacatttttgcaatctactcatctgacaaagggctaatatccagaatctacgaagaattcaaacaaattgataagaaaaaaaccccaccacaaagtgggtgaaggatatgaacagacacttctcaaaagaagatatttatgcaacccgctggcatggttcttaaggctgagcagagcctggccttcctgccgtggtgtggtccccacagcccagcccttgtgtgtggcctgtgagcctccccaagggaggcagggctgctgctcccagcccttgatgggggtcacgcttctccttggcagtgatttctgtagctcagctcagggcctgtgcctgctcccctcagtgccctcttctgacctcagacacgctcccgctctctctccagatgctgggtgtgcggatgggttcctgagagcagagtgggtctgttgagattacacatttgtatcagggaccctctcctgagtgaggcctgagggaggagtgggaatcagctgggcagagagcgaggtgcagagcatcccagaaaggggaatgacatgcaaagacaggggacaggaacacacacgttttctgtaaagggccagagaggaaagagcatgagctctgcaggctggaggtgtctgacacagccactcgcctctgccccctggtagcacaaaagcagcgtcggtggtgaaagggtggggctcttgtcggtggaactttagtgattaaaaacaatccagggcccggtgaggtgggtcacacctatcattccagcactttgggaagccaagacaggagaatcacttgaacctaggagttcaaagtcatcctggacagcatagcatgacgccatctctacaaaaaagttttgttttttgtttttggttttaattagctgagtgtgtgggcacacacctgtagtcctagctactcacgaagctgaggcgggaggatagcctgagcccgggaggtcaaggctgcagtgagctgtgatcacaccactgcactccagtctgggcgacagagccagaccctgcttcaaaaaaaattcaaaataaacagcccacagaatggagagagagaagagacctggcaggttatccctgagggcagctggaaccccccagggatggagagtcgatgggatttgccttgtaggaagcgctctgctggtgacccagcaagacctgggggagactggagccgtgcatggttccctggggacttgtctcattcccagcttccccagtgtgggtcttgtgctcctgggatttgtgagatgacttcttgtgaatggcatgtggacagacaatgagaaaacattattaatgttcaattaataatgaaaaagtttaaacattaataatgaaaatacttttcagtaattagggcaagtagtattggcttctcattttgggcaatgatagagatttgctttttcttataaacagagataaaaatataaattcacttaaagtaaaatatagcaaacaaaagtatagaaagtacagaggaatgtccaaaatgtctaaagcaggagccacaagtctgatttaagaaagaccattccattccctagggatgcagctggcttattagcagttagtgacatttgtcatcatgctggggataacaagaggtgacacaagtggctgcctgcatgcagggttggggagcgtgctctactaatgactgcacattcatttagcttacttagccctggaagcagcccccggagatctcacgcccatgatgaaatgctggcacaaaagtcgaataactggtccaaatgactggaaacagagggcaatgtctttgacatcaggccgacctgggtttgagacacacggctgaactccttactgagctgtgggaccatgggcaagtgacttaacctttctgattatgtttgatcaactgtaaaatgaggatagtagtcacactgacctcccagggtcgctaaaattaaattaagtgatccccaggaaagacttatctccctcctaacccacaccgagcacttggaaagtgtctgctgctgctactgtagcatcactgttactctcaccatcatcgttgtcatcgtcattgtcatctgttgtcttcattgtcaaaaacaacccttggaaagggacgcactaacacgcattatttagctgcctacagatgctcccagagaggccatctctctggtagcatgtgtgttttgggatgtggggccacctgcagtttgctatggctgggacaaccccgaggcctcatccagccctgcaggcctgggatcctgcgccagggaccctgcgccagggacatcggtcacctccacaacaccaggtcaatgttcagaagcttggccatgagcaacatccctataaacggggtataacttaacacagggacattaaatgcactggttaaaaatttgcaagccaatgtttaaaaatcaggagtgttcacagaaatccagatgtgcagtttcttttcagtcatcaaagttcaggcctccggatccctgttcccacacagccagggtcgctggagctgaacagagtctgtccctgtagatgggtgttggagtttgcaaccctttccatgaaggttaagagcctagtctttggagccaatccctgtgttactgacttaatcttctgctttgggccccagtattttgtgatagaaggagttaaagcttgaggccactgtgaggcaacgtggtcctaggtctccggtttctactgcagagctcagggggaccagctgttagatgctgtgtgtctgatgctgtctgttctcttcccacattctgcacctcagcacccaagggaactgcccacatctgggcccagtcgctctgtgttgtgggtaattccatgacagacagatgtcatctaatggcagacaaagccagatcctcaagtggcaaatgtgtcacgtgagtgctggaacctgggacctgcttctctccttgaccttggacaagttcagggaaacctcatgggggcccagaacatggtgccccgtgggtgatggtctacacctgcaggagcccctggggtgtctgcagtggtgctcattgctgtcctgaaaggtcagctgctttctcttaaaaagcaaacctcccatgagctttgctgggggtcggggagaggggtcatcaaaaagcacaaggggctgtcctgggtcactcctggcatccaggtggcaacatccaggactggagttgcagcttccccgtgccccaaccatgatgagtgtgggtgtcaggggatacatctgaatattgcaaatctctcaggaggaggacactgtcaatgattttgaccattattttccttgagcctttggtttggtgatttgggttgactttgggcttttgtgtttggggcgactttgcttttcctggttttgtttggatggtgcccgatatggtttggctgtgtccgcacccaaatctcatcttgaattgtagctcccataattcccacgtgtggtgggagggacctggtgggagatcattgaatcatgggggtggtttccccagtactgttctcatggtagtgaataagcctcatgagatctgatggttttataagggaaaaccccttttgcttcgttctcattctcttttgtctgccaccatgtaagatgtgcgtttcgccttccgccatgattgtgaggcctccccagctatatggaactatgagtccattaaacttctttttctttataaattactcagtctcaggtatgtctttatcagcagcatgaaaacggactaataagtgccacaccagcaacagagcattccctacaaagcccagaaggatccggtgttttgacacaaatgggaacagggtcctcttcagtgtttctactatgggacaggggctgagttctggccttcccacaagtgcactaattaaaaaggagagtgacactcagggagcgtgttctgtgtgcactctattatcttataacagcctcatatttttggatgagaaaacagagcccagagaggttaagtcactttcccaggccatagagcataaaaacagatcaaacccagtggcaggactgggtttgatcttcaccataacagtctacagcctaaactctagagccaaacaggagacaaacatttcttctgcttctggaatgttctggaatgtgagtctagaacaaggactgtcaaattgcaggcttcaggtcagatactgcccatgtctgtgtctgcatggctgtggagcactgctctagtgggccggtcctgggagccagggagggaggggtgcctccctccctgtgccctgctcctgtcttcctagctggtggctgcccttaaccactgcctggggcctatgctggtcccagctacccctggggcctgggctctgggcaactgctgggcaccgagtggaggaacctcatctgggagttggtgagccacctggcccacagccagctgcccaagctgagaccaaggttgtgctgggtgtacgggggtggagtacaagtgaccatggctcaccacatccatccttgggctggccacccttgaactccagaatgtcttcagtgggtggtaactggctgcaaagtgtgtcccctgccctggtagccctcttgaggcaagtggcagggcagagtttttcctcttgtttaagttcctacataatattcttgattttgcctcttagcctggaaagacaaaaatgtttactatctgcatctgaacagaaaaggtttatcagcccctgctctggaaaataagtggggattacacagaagggtgtcagtggaacatgctcagcaaagaggtaccagtaagtcatgaacttgtggcgctgtggttgagcttcaggtatttccattcctagccctgacccctgcattggggtttgtacagtgtagaagcttctggttgagactgcatttggtaagagggagcctctgctggtccagccccaagggagcggtcccccaaatgcagggaaccagtgtcttcttccactttttaaaaaattgattcagcacttgagatgttaacagatgttgcaatttcagttttgacaagattccaaaatacaacggtggctgcacactcacgtgagatgcagagggcggtgtcagagaggagagggaagatggggaggagggagggagagaggagatgctgaaaaccgtctcctgtccttagagccatcaggcaggctaaggatgtgagggttcagtgtgtggtgaggatggatgttttgggggagactttggaggagggttttggtcagcgtagctggtgtggtgagtctcatggccatcagggtgaagggtggggaacccatagtcccaccttgggcaggtggaatgaggggacctcagagacttaccctttaccctgtgccttaaggcagtggcactatgaccattgactcagtcctgggaaatccagagctcccctgtccagtgcagtagccactagccatgtgactgtttgaaataattaaaatttaagcttgtttttcactccagccgcttgtccagtgttcagtggtcatgagggtctagtggccaccatatggacaaggaagaaatgtgtccatcatctcagaaagtgctactgggtagtaccgagggtcagggtggctgcacatctactttgctgtgaaacaagggcagatgtagtttggattggctagccttccagagttctccatactaacagagactgtaatagcaacagaggccacatggcccaagctggaaatattttctacctggccctctgcagaaaaggcctgccaaaccctggtttggagaatgggtttccactggggtgggaagcattgccaggagctgggaggctggtgaggaggcccaggcagaagttctgacagctcacactgggaaacacgtgggtatttctgagaaatattttcgaagtagagttcgtgagacttgcctgtgaattagatacaaggggtgggtacagggtggagaggacaagagaaggatggcgtggggcatctggtctggctggacagctggtgggtcatggaacactgaacctggtgaaagtaggtgatatggtttcgctgtgtccccacccaaaatctcatcttgaattataatccccacaatccccataatctccacgtgtcaagggagaggccaggtggaggcaattgaatcacaggggggcagtttcctccatgctattctcacaatagtgagttctcacaagatctgatggttttataagagactcttcccccttcacttggtacatgtccttcctgccgccttgtgaagaaggtgcttacttctcctttgccttctgccatgattgtaagtttcctgaggcctccccagccatgctgaactgtgagccaattaaacctcttttctttataagttactcagtcttgggcagttatttttagcagtgtaagaagagactaatacagtagggatctgtctggattagtgccatgtccacagcttctagaatagtgcctggaacccatggttgttcaataacatttgcaagatgggttgatggttgaatgagcaagagggaagggaaggctcaggagaattttttgtggggaccaagattcaagtttggatgtgattggcctccagatggagatgccagtgtggccaactggtaacatatgagtctggagctcagagaaatggtccagggttaacagagaaatggaatcagttctgaagccaaaggagtggatgagaatgacctgtgagaaggttagacagggaagaggacctaggccttcatcctggggcagcccaggtggacattcagatgcaggaggtgggacctgccagagaggctgagcagaggtggccagagctccaggggagaaccaggagagtatgtgtcgggaagccagaggggaaagtgttaaagatggtggatggctgagtggggtggccctggctcagtgagggggccaggccttgctgggtggagatgcagtgttaaaggtcatctttcataagtttatttttcaaaggagcagataattgtaactaagctgggagtatacatgaggtcaagactgtttggtttggttttgggtagaatattttagatcttgttgggatcctgaaaagaaggataagtcagtgatgcaggccaagcgggacaacctgtcaatagctcagagggatgtggaactggcccaagtcagtgcttatctagtgaagtcttatgtggagatcagacatagaagatagatccagatgattggctggggctgacccagaagtgaggacactgaccccaggctgcccttcctccctggtatgaggacactgaccccaggctgcccttcctccctggtatgaggacactgaccccaggctgcccttcctccctggtaatgcttcctttggtggcacctctgagcagacccttggagcctggttcagacgctggccacattgtcctggaggagatgagtcagaggagtgctgagtagctctagacaaaccttccccaccatggtttcatgttggcctttccatacttgtagtgggcaggttcgggtattttatacagattattgtacagatgaggagactgagactcactaagcaaggtggaggccaaagtcactcgtctgtaaataggtcaaacgtatggaggaagggggcggatgctggatactggtgtaattgaggccgggtgagccagttccgtgacatctctgtctcccaaaagcaggactttggaaatgtgctgggtgaccagtaccctgagagcgtaacccattcacaaagaagcgttcaggaacaagaagtcctgtaaacccaaacaatcaaagcagggtgtggatgcaaggaccatattaaaggacttcagaataatagatgtgtgaatatctgaaaaggggtgggacccccccaggaagaaacttcctagaagaaaactaggcctgggctggctactgagagctcaccccatgcctggtggtcttggccaggaacttggctgccgaggaaatgggctgtgaagtgtggtgtcccaagaatgagggtgtccacttgcctgtgctgatttacacaagacagaaaactccacaaagttataactggaacctacatagagaaaatgggcatttctgtgcttacctgtggcttaacaaggacacctcacaactatttttacctagaaagcataaaatatttactttgatgttgttatcagggcaaaacttactaagtgaaacaactaatcagagttgtagactcttagacattataggttacaagtcagatgacataatgacagtctcaaagcataggagtcttaaaccctttttaacaagtaacacttttgaggacagtttaatgtaacaagaaaaataaaatgaaaacagcattttcatgtgggtatccatgcagaacaagagtatagagccagttgtaatggttgttctcagttcaggccaacttcataacacagagctgagtctgccgtctgcagctggagtatgtgttgttgagggagaacaacacatactccatctctgctttcagagattttgttctccaggcattaggagggctggcctttctgagataaggactccattgtcatgaacttaacataagaaagggctgggaatgagagtttaaaacttccaacatagccaataaaggaacggaaactaatgatagctaatgggatacaaggagcgtgcaatatttgcatctggtgtttagctggaggctctctgcaggcaggaattaggcctgttgtaacaccccctccctgaccactgtgttttcagcaccatggacagcacccaacagctcttgggtacctccagaaacagcagctgatagatgaatgaaccccataggagctaacacagtgacccaaggacaagccccagctccactaggcttttcccttagacatacagtggggagagtgttcgtgtgttcttcattgggtagttgtaaaaactgaataagatgatgtatgccaggtgccttccacaggccttagcactcaagagtgtgctgagagggcaggaagtgagggagtgctggtcccagggagaccatctctcttggatcagagggaaggaagaatagagatgctggggacagcagtttgcatttgagtcagaaatccaagaggagccccggtctgatgacctcagtttcccctgtaaagctggaggtgaagctgtgtggtgggagcaggcaaaggtgggaagctggaggtggggaagggacagaaagggcttgagcagtcatgcagagcacctgcaggaggaagctcctggccacgggtcctgcagagtgacagttcttcctgaagtggactccgtaggctcttcctcctgcaatagtaggcaagggcaggagcagacaagtggcagcttaatccccagatgaaacttttccagagagttaaatggaaaggaatccaggcaaaggacttagggactgttggtccgattgttgttgaaataatggatgatggaacccaagccaggcaaaaagagaaataagaaagggaaggattgataggttgagggaaagctggggatgggcaggctgaggggtggttgtgaaggaggtggatggagcctgaatcagcagctagaaagggagggatgagggttctgggtggcctgacccttcctccaagtcgatccttcctatcctcactcccactctaggctggcatgccagatgttagggctgctgcaaacagacaaataagaatgagagctgctggactggagggttacactgtgtcatggccacttcttgcttaaactgagaaacaatcctgtgagggactattgttaacacaatgccatgcatgagtaaatggagttttggagagatttagtaacttaaggtccaagagtaaattcagagaccacttgagcctgggtgtgtctgactccaaaacctggcatggtgaacactgctcctaggtgaggtgggagctgtggcatggacctctcatgtggaaaaaagaatggaatccctcatactattgaaatgacttccctctctccatattcctctctctgcttccgatggttctattgagagttgaacttgcaggaagtcaagtgcctgtgtgaggtcactgctctgtatgctcttcacgatcccatcccaccaaaccctcttgctttgctctcttacttccactgctgtcagaggaaacatgtttttaactctctgctttgcctttgaaccagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggtgggtccacatgcatcctgcccattctatttcctttctctgccccatccatccatctatcctacattcatccacccatccatcatctatctatttattcacccattcactcatccatccatccataccttcaaccagtcttgattgggcaccaactgtgggctggttctcatcattagcttctgtgactggggctcagggcaggcccagaggagtagatcttaccaaggaaactgtggttggcaggagtagactgcctaggctccctcaagcaaacaggggagtctctttgcaggagtcaaaggggggatcttccaggacctgaatgcaagaggtgcagccagttcccaggatggggcttggctttagcttggcttggcttttctttttcttttttcttttcctttccattctgttcctttccattccattccattcctttcctttccattcctttctgttccattccattctgttctgttccattccattctttctggatgctcatgtgtctgtctttctctttgtgcttctctctgagtctcagtctctttcagtcagtctctctcccttcctccctccctctctctgctggtctctgttttgctgtttcactttccagtgagttctgtccagcaaggcagagccaggagtaaacagcagacattggtggtcagataggggtgcacagctggacagaggcccccacagtcatacacttatgtagcttttgtcacactggcagaataatcctagcaagtagagataattactttgcaagcttaggtattttttatctggaattgactgctacaaacaggacacattgatggtctcagggaaaaagtaggctgttgatcaagagataatgacttttcagagtaaagccttgcgtgctgtctttgaaggctgtgggcgtgaaacatgatgcatagcagggtttgacagttttgttacaatcacctaaccagtgattaaccaccatcaataattgccatttgctgggtaggcacgaggtgccccatttatggttgagaaaacaggctcaggaaactccagtaacttgtcccaggtcctggaaatgattgagacttttgaacccagtttttgggcccaaagcttgttgctaccacacgtgtggccaggggctggtgccctcccctctgcgatctcacctaatcctcattgtgcttcttcccagttttcatgaaagagggaactgccaccttttggaagaggtgtcagctgctgagacaaggagagcccgggcatgagctcgggagggctgggtcccagcccttggctcttttctggggaccttactgccccttatggggtgaatgttcaatctggaggggactcttgggtggaaaatgctttcagtggggcattttccttgtacacctaacacgaattaagtattccagtctaactgatgattctcagccagataccacagaaacggaggaggtgagatgcaccccacagggggcctctttagctgggactgcagatgtcctggatgggttagatgtggggctgtggtgccctgtggttccccaagtagtattggtttgtgggagaatgtgctgctgggtgggtggagggatgagtgagggggcgcccccgccaccccaccaccctgagacttggccccagctgttctccctgacagaacattctcccttcctgctttgcctggtcagtacctttgcatgcttgggaccacagctcaagctgtttctcctccaggggagccagccctgacccttgacctcatagcaccatgcgccccatcttccagcatttaccacattgccccaccttgtttagtgggttgaatggtgtcaccccaaaattcccatccacctggaacctcagaacatgaccttgtttggaataagggtctctcaactgccattaagttaaagatcaagctgagctcatgctggattcggttaggccctgaatccaatgacagtgtccatgtgacaggcaggacaggacacacagggatgggactgatgcatccacagaacgccaagaattttccgggggagaggcctgggacggcatctccctcacagcctcagaaggaaccaacgctgccagcatcttgatttcagacttctggtctccaaaactgtgagagttgttctgttgctttgggctgcccaaggagccatacacgccttgtctgttggatggtttgcctctctctaaccacctgccccccagacagtagtccctgagagacggccacacgtctgtgttcactgtcaaatccaagtgcaggcatagtacagggcatacagcaggcactcagcaagtgcagatgatggttggatggatgaatgaatgagtgaatgaatgcatgcgtgctctgaaccctgtctgtctgctttctgcatctttctacatctctgtagatgaatccaaatattcagtctttatgcaacatggccacataaattacagtacaaagtttgaggcaaaactgtgctactttgcattttgttattgtctttgtgatagctccctttttcctccattgaaacctaaaaccatttaaagtccattcaattagccaccatccacctcattttattctggcgaatgtataatttgttcctggccctcaataacttggtaacccagagagtttcctgcctctcccaagcttgggaaggtcgagcctcagatggcacaggtcttcattctgactccacacgccctaaattctggcgttctgtccccagtctgcggacacttctggcttccgccctgccctcagttgcaaggacatcaggggatactctgacacttatgcgtttccatagggactgaattgagactgggaggtggaggagggtagttccgagctatgggtcctggcctggcttcttcctgcacagactacattttggtgactttgatttaattttctcagttcctctttttccttttcctttgggaaaaggttcatgtgcttcagcatgtgaacactagatggtagcaaagaagaaagtctccttacctgggcttcccttgctgcaggagggaccctggcccaactgagtctccacccaaggcaggactgcaggtgtcttagttcatctgagtgacttataaaccacagaaatttattcgtcactcttctagaggctggaagtccaagatcagggtgccggcagatttggtgtctctgatgagggcttgcttcctggttcataggccaaattcctggactttcttgaaaagtcttcatctctgatcaccctctgagtcactacaggcccattaaggtgggcaggttctcctctgtgtgctgtggtccccaccctgcccccatggagaaattgcaggaggtcctttgcattcctgggtttcacctgcctggtccctggagatgcgtttacccctctcccttttacctctcctttacccctgctgtcacctggtccagttggtaacgctcaactctgcgggatgggagtcccacagcctctgccaagtgtaagtggagctgggtgcgatgtgctgttctcagcccccaccttttcctggcagcctgcccctgaggtggcttctgaacctcagcttcctcatctgtgaaatgggggtgacaagtggtcccctgcacaagctgggtggggcgagccaggcaaagctctatgggggccgtgggggcagtgctggttgtcacatctgtgattgacagtggggcagagacctgggtgggatcccagctccaccaagctgagcgagagcaggcaaaccacgctgcctcagtttccctatttgtacaagagggctagtgattccttcctcatggggctggggtgagaagtagaggcaatgatggttagagacagaggggctgggggatgctgcgtgtcacctgcgtgtgctcaggagtggggcactgtcctgagcaggagcagcctggggaggctgaggccagtggggagaggacagcgcagtgtgcagaagctggggatgggtctccctgcagcccctgccctgcctggccacttcttgcatggctggctccttgtcatttctcaggtctcagctcaaagtttccctctgcagagcagcctttcctgacctccctctcccaaaccagctaccacctccccccgaccagcccagtactctcagcccacctgcgtggtgccctctcgcccccctccctccaccactctctctcccagcccttttctctccctctccttctgtctccttctctattctacaatcatctgctctctttctgtctgcctggcctctgtctgtctccaccagctgacggcagggcctggcccgtttccctgtggcctggccttgtgtggccaagcaggtgcttgtagagaaagcgaaataactaaagtcctccacgaggtttacagtttccttttgggttttgaggaatactttttattgatgctgtccacatcccaggattgtattggaagtttgtttctggtttttagggaatggggtagtttagatctggttgttttgctggtgggattaaagggatctggtgtttgcaccagtcctgccaggacgcttttggaatgagagtttgtgctgaacacctaagagcttctgggcctgtgccagctgctaggctcctgaaaaggagctgatggtctcattttacaggcaagtaggctaagcctttgagagcttcagtgacttgcccagagtcttgcatactgggaaatggcagatcaagaccagaggccaaatctgcagaagacaaagcccatgctctctgctcttccgggcacctgacaccctgctggcccggagcacatgcaggagactgtcattgatggaaggagggggtgtcccactcatttagacttgaatgagcaaagcctgtttagaatcatcttcaaagtcatttcatgtacacaagtgtttattgcccgtgttttaagtgccaggcctggggaaactgtaggaaggaaggtggacacaggcctgcccaggagcaagaaacagactgggcagcgtgattcactccaagtaagaggaaaagtgtcagggcaggctcaggtcccaggggacaggagacgagggatctgatcatggcctctctaaggaaatggtattctagcagaggagcggggaagcatttcaggcagaaagaacagcccatgcaaagactcaggttggacggagtgtggtgccttcaaagacgggagagatcttcacatgctggagtgaagagagtgaggtggagatgcagctagggagccgagtggggccacccccaggggccttgagactgggccatgagttcgaatcatgtcctaaggaagatgggagagtgatccaattcaccttctggggtgatcctcctggcagagatacagggagagggttggagcccagaaatttattccttactgttctgggggctggaagtgcaagcccaaggtgctggaatagatgctgtggggagggcagagcggaccatggtgctcatccaggctgaagggtggctgcacagattcttccgggtttcccaagaacaagaagcagcttcaggaagctgaattcatagcagagaagcaggaaggaggcttttctaagcccagcgccctgcagggaggatgctggtgctggtgtctgcaaggcttggcccctaacagggtttgccctacagatggagcagaactggacagagatgcaccctggcctctagctttgggagcagggatcccggtccagcatcttggcattagttggggcccctcctggaggtgcaggggagcgtcctttccgctcatggtccccagtctcagcaaaacccttggtcccagctcctgaagacctatgttcttgctgcttcctcccacaccccaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacaggtgaggccctgccccatgagggagacctgtgctgccagaatccctgcctggccagcctcaggctgtgcagctcatgccacgcccagggccttggctgggtgtcccgttctacagtcactttctgaacaaggaagtcacattttcattttgcacctcgctctgcagattgcatagctgatcttggttcccacattctgggacggggtgcacagtgaatgtgcactatgggaacctggccacaaagtcctgtgcgtgagcccctcaggacccagggtggggtgggagctttgcaggagagactgacttagagaaaagtggccgttccactttgtcccaggacactgagggcttcatagttgtcactgggcaagagtgtaaggcagcctgtgcctgcagcttactcttattttggatcacatgtgtctcatggactgtgaaagattagaggtaaaataggtaataggagacagtatgggttggaggaatattagacaaacaaaatgtccttctcagtttttgtgaagtcctcgccctgaacattgattgcatgtattttggcaggttttattacttgcatgttctgtgcttttcaaaacagcatgttgtaaacagccatttgccttgaactcaaatcctcatgctccttctggtgtgtccaggataaaaaccaagaggtcacatgcattttggggctgcctctgtgatattcattataagctccaaagtcaatcgtgctgggtttctgggtgaagggggtgacctataacctgaaccatctttctggtttagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggtgaggaaaggatggcccattaagtgtggggatctcggccagaggtctagtgtcaccagggggtcgaggacagagctcgtgcctgggggaggaacaggtcgaggggctgcacctggggagaaacaagaggggggctgtgtcctctggaaatgagcttctcctgaaacaagctggggtgggggtgcacagccaggcttagagcaaggaactagaaaataccccggtgaaattgttttgagagttgcatattagttttcatgtgtatgtgaaaaaaaaaaacaacataaaagtggtgaagcaagtgacttagagaatgccacccctgaggatgctgtggcgaacagtatatagttggtgtacagatgctcagtgtacagaagttatagcaaaaacaaaaacaaaaaaaaactgtaacaagtaaagcaggacgagatggaagcagggggagagggaggaagagagattgctctattgatctcaaatggccgtctcagaagtgctgtggatgggacaggcagcatacgcttgtttgggagcagatgctcacagggtccttggaagccagctccgtatttgtcctcatggtgcgttctcccatgaggtaattgctccatcctacccttgaggactccggggctcgggacgatagaggcctgcagaccaccctgtgatgaagggagaaggaggctcaggccaggaggaggaagtgctgagggggtttccctcccagctggtactggctgtgcggggccctctgattagtcccaggaaggtccagggcggccgtggtgtttggcctgcaagggaaggatcaggaagcgtccgttgctgttcttcctggaagcatctcatggtgactgttgcgggcatgggcaaagctcaggccacgtctccctgggtgtctgtggggagcaggaaagggcatcagatgtcggtgctgaccctggctggtactgaaggcatgcggtgggtactgtgatgggtggatagaccggcagcccagggctccatagcctcccgcttcctgctgctttggagcctttccaccgggtccgaggaagcaattctgagtatgtggctgcacaacatgaaaggggtgggggtgctgtcacctgtgcgtttggaggaggctgactgccaccgcggaaccagtgtctttgtggcagaaactaggagctggtcactggcctgagggcaccaacctctctgaagaggctggagcctgtggtgttcccaaactcgttaggccctggaatccttgcccttaaacacctgtgagcctccagcaggagggtgctatgagggtgcacttctgagtagagctggtgttgggatggtcaagggctagagcacggtccctcagcctcagcgctggtggcaagaggccaggcgattctctgctggggagggggctgtcctggacacattaggatatcctgcagcatccctggcctctccacactggattcccccagtgaagacaatctaaaatgtctccagacttggccagatgcccctgaggggcagaatcacccccagctgagaatcactggcatagtctgtgcccttggtttgggggtgcccttccataagtcccttatccactccaggacacaatgctttcattggtgaagagggagatgggaactgcttcctcttgacattgacaatgtcagcagccagggccccttaccgggtgtttcttgtgtccgggatgctggtctaaggttgtgacaagaaaggttttatcctcacaggagccccatgaggctatgacatcatagtccttattttacagatgtgtaaactgaggcatagggaggccatgtaactggccatggtcatgcagctcgttggtgccaggctgggacttgaacccaggctgccagcgccagctttccgctctgtgctagaccctctctgaggatgagtggattaatccatgtcagcccttggcacagggcctggctcagggtgcacctcggagagcacttcttcctgtcctcaccagccacacggggaggatagcccctggggaggacagcccctggggaggagagcctctggcccagaagggtctcccggcttgactttcctttagggcattgttaggccatccagatgcagtgtcctcacgcctggcgttaaaggtataatgcagtcattttatttaaacacagaagaggatgggaatctgcatttcacctctcgggagcctcaggcctggcccggatatgacctcaaaaccctctgtggcagcgtggttgagccagcagcgtggttgagacacagagtttctgcactggagacggcatcaaagcacatctagcagcacccttggctcccacctctgtccctcccgcccagtgccttccttctctgattgagtgctctgcacagggacgcctcctgctcagccaggtggcctggtcacagccagctgtgttagcctcttgtggctgttgtaacaccttatcatctgctgggtgacttatgaccacagaatttactcttctgcagttctagaagctagaaatccaaaatcaaagtgtgggtagggtcgtgctccctgcgagtgctccaaggaggagccattctcttccagtttctggtggttcctgcattcttggcctgagaatcccagccctgcctccgtgggcacatagctgcctcctctccctccttcctctccccttcatatgaggatagtagtattgcaggcagggcccatctggataatcctggatgatctcctcatctagagattaacttaattacttctgcaaagatccgatttccaaataaggtcactttcacaggttctggggatttggacttggcacatcttttagagaaccccctttcaaccccctgattccactcctcttggttaactcgttcctcttctcattgagctaaagctaggctctgggatttgacccacaaagtcccctccatccctgagatctctgtggctgggccggtccatggcctccaacagaatgtgctgtgaagcttggacttggccctgggcaggtccctcccctgtccctgccccatttccttgttgtcagacgaaggccctcattgttggcttctatgacaacactgaaccttccttcctagctgggacacagttgcagattcacactaattcttgtcattctctattctctgtctctttgctacctatcaattacttattgttgactgtctaattttgtctgtatgagggatcatgctggtatctgtctgtgtcccgtggtgtgtccatcatcccagggtacctggttctaagagtcagtaagcacctgttggttgtgtggctttaaacacatctgtgaccctgatgaatctgatttgtccctccagccgatggcccctgagctccagggtgtctctgtggactctacgcatgcgtccacgtggggactggtgtgcattgcatagcttacatctccagatctcggttcccatctgcgccctgtgctgggactcttctccatttcaatcaatacatctaagcctcctgtgaagcttttggctttgtgctgatgtccggatgaccctgaagtcctctctgttccccttggagcagttcgcgggtccagccaactccctcttctctggcaatggtttgctgtgctctcctgcctggacttggcctccaggcggtctctctgtgccaccattgccccatttctagttcattctccacacaggtggccacaggaccagggtctcatagaagttggataatgtcacctcttgctcaaatccctccagtggctccctgaggcactgaatgccacatcctccctagtgcctgtggccccaccccatgtggcctgcctccctctcccggctcgcctctcccttggacccagcccatgggcctctttgatggtcctcacaccccaaccacagcccctgagactcttgctgtccctggaggtgtgcaaggctccaccgcgtttaaaacatcgctcagtgcaggaagccacctggccgctgtgtggcaacacttggccccttcttctcacccaaccttatttcccctacggcagcgtccctgacgccaataccattggctttgcccatgcagcctctctaccagcacatgggctccgcgagaccaagtcttcgcctctgtagttcttactgtgcgcacagctcacgagtgctaagtgcaaaataaatatcagttacatgaatgagccagaatgggccaatgggggattagagaagccagtgcctgtaaagtactaacaggtgccaggtccagggagccctcatccctggactgtttctcccatggcgtggctcagacctgagcctcttgttatttgttctcgaaacccagtgtctgtaagtgaacacggattttgagctggggtctgagagtgggggaaggtagcactcattgtagaaactcattctggaaactgctgtcgtgaacgtggcccaggcccaccgctgtctgcaccgtgcaatgtgttacatggggtgtcatctgcaagccctgggtgaggccccctttcctccatgggccttttgtgggccaaggtcaggattcctgtctgaccctgagaaactccttgttgagggctgggctcattgcacaaactggcaggtatgtctgaggtgcaacctccagccatttgcaaattgaggcttctgtgtgctggtcccagggtatagagtctagggtccctgaagccctgaaatcaagtgcagaaagcagtgctttgcttttgtcacattctcaactgtgtccccaatgctccagaagtgatagatctctgagataaaatgctgtgggaaaattcaatattggtcatacagaaagtatataaatgttgctttttggggggaaaattactcacagtaggaaaggcctgtaagagtattttgctttgcctggtgcagacaatggtgaataatggttgttatttgcttctctctgcagtgtgttgagttcaaaccccattcccactgtctcgcctgatacattgttttcacatctccatggggtgaaagcagaaagcaccaggcagcaaattaatcaattattaatcgcaacaactactattttattcatttattcatttattctccctctctccctctctttcccctgttgagggaggtttggcagacgttgtcttatcccatgtgaaaaagaaaatttttgttatcaaacgtttttgtgaacttcagttctctattagaatggagaatgcatctgcatgagaatttaatttttggaaatggtggaggccctatgcccacatgcacatgcgtgcccacacacacaggcttgcacatggggtgccttcgtgggtatgcctggtcagcggtgggtgagcagggccttgcgctcattctccagtcatcaaaagcgaattttatgagaaacagtctttgtgttgtcactgccccaagatttaagttttaaaacctgtcaagaaaaagatgtttgtgttttgtcttttctctgtgctgaacccaagagtcatgaccacacctgtctggtttttcacagtgtcccagctctgggcgcagtagaaacacgtgatgagggggagcgagggactgaggggctgctatgggaatccgggctgcaagggaagaacctactgatggaaggaagctgacttctccagagccccccagctgcctgtgctgctgctcctcctgcagacagcttctcccaggtgctcatgacagcaaggctgcaggctaggactcaccactgtgtctcacctgggcccatgtaaggacagcacaggccctccacttcatccatgctgtagtcttagtccctttgagctgtcataacaaaatccctagactgggtgtcttataaacaacagaaattcattcctcacagttccagagacagggaagtccaagatcaaggttctgacacgtggggtttggcaaggccccactttctcataggtggtgccttctatgtgtcctcacatggcagaaggggccacagagctctctaaggcccctttcctaagggtaccaatcccattggtgagggttccacctaatgatctaatcaccttccaagaccctaccccccgaataccatcacattggggttaggcttcaacataggaattttgggggacacaaacatctggcccctggcattgggaatgtcacagggagggctgtctgtgcagctgggtgggcctccgtctctggggcttactctgcgtagagagacttgctgcaggatttgaccaccccacgtgcctcgacatgtttctttctagctctgtgaccttggaaaagtttcttaacctctctgtgcttcagttctatcccttgtaaatgggggtgacaagaaagttcttatgaaggtcaacaggggtgctcaccgaagtatagctttgtctcattgtgctcagtgagcgttctggttgccgtggtaatcagcactgtcaccctcatcatcactgtggttaaggagcatataggaacaaggaagcactgggcatccaccgctcatcaaaatactgcctcacaggcatgaagcaaagtttagctcccagtttgtcaatgttccgtagctgatttgtgctattcctcattcctcggccaattcatcagtgagagtgttgatgtccctgccgctgcataggtacatctgttctccatccagacatgcagttacatgtgtttgtgtaactggctgtggttttgcttgcctgcttagcaagggacaagggcaaggggaattaatcaccggggtctatgtgccaggacaggctggcggggacctttgggttggtcaggagaaacaagcctcaagaaggcctctcgatggcacctgccatgagccacccgtcccagaccaggttgggtaacccacggcgcccagcctcagattactctgcccattgggatgaccctgggcaggtggtggcacatctgggccctggctgcctttcggtagctcacaggtgatgtcagtgacccccttgtcaggttgtcctgggggcggatgagacaacgctcatggagggcctggcctgtgtgggcacatggcgctcacgtggtagccctgctgccaaggttttctgagggtgtgtcccagcggcaaaagaaaaaaatctgatatttgtacattatttatttataaactatacattaggggtaccatgctaatatactgtgtactttataaaatatacatgcaagatagtaataaaaggtgacccgagagagtgactatgtacatattaatatgttctagcacagcctgccccactgtgtcctaggagtaaggccctaggaagtatatttcagcaagcacaggggggttctagtgctggtgcaggagtgaaagagtaaatcctagcccccacaatcccatgagtcaattccagtcagctaggcggtacaagagtaaagggacatacgggatttcccggctttatagattttttttaaagcttcttaagacacacccttgctatgtattcagcaagtactatatgtcccaatctaggcctcaaggattctaaggagaaactagacacagtctccaaccctctaggagctcatgactgaccttaaaagctgatgttcaccataaactcaacaacgcaaaagagggctgggtcgggagttgaaaggtgtattagtccgttttcacactgctgataaaaacatacctgagactgggtaatttataaggaaaaagaggtggttgtttttttcattttgttttgctttgttttttgttttgttttttctaagacagagtcttgctctgttgcccaggctggagtatcgtggcacgatcttggctcactgcaacctccacctccggagttcaaacaattctcctgccccagcctcccaagtagctgggattacaggtgcataccaccatgcctggctaatttttgtatttttagtagaggcagagtttcaccatgttggccaggctggtctggaactcctgacctcaggtgatccacccacctcggcctctcaaagtgctgggattacaggtgtgagccaccacacccagccagaaaaagaggtttaatggacttacagttgcacctgcctggggaggcctcacaatcatggtggcaggcaagagagaatgagaaccacgcaaaaggagttttccctcataaaaccaccagatctcatgagacttattcactaccacgagaaaagtatgggggaaaccacccccatgattcaattatctcccattgggtccctcccacaacacttgggaattatgggagctacaattcaagatgagatttgggtggggacacagccaaaccatatcaaaatcctaagacaaatgtgtgacgccaagaatgtggtgacacgggcatttgatgacatggagaacgttacacggagagaggcaacactcaggcagttcctggtactgtctaaatgtaaagaaagccttctttgcaggctccgggatcctttccccagtagacatacttgtaaaaagtgaatgctaacgtgttatttgaatgccattttaagtgtggggagggtgtactgaaaggcttcgtgcagtgtatgcttctgtaaagtgaagagccacctgcagcgagtgaggactcccccacagtcgtctccatggtgacttcacagaacagcaggcagcccctgccttttcttgaaagttggggctagagatttgaaaggctgtggaaacccagccactccctgcactgacaccagatggcgctggagatgctcgctgggatgcaggatgcttgtgagaacctggtctcaggacgacctggtgggcgtcttgcagcggaggcaggtctggcccagggtggttctggctgagcaccaagcagcagagctctcagagtgggaacgcacagccccagtgacaatcagctgaaacagggctgccccccgccccgccccaccccggcccttttttttgtttgagctattatttcccatcaagtaccttgataagcacttttcatgcattttattgcctaagtcccttgacaaggtgataagacagctgctattaccgctttttttgtttgtttgtttgttaacagtagaggaaaatgaggcaaagagaggggatgaaacttgcccattttgaatccagggctttccagctccacagcacatgactgtagcctactgttcgtccaatgcgtaagcacatcataggtgccaggcactgccctgggtgctgtggacacagtgatacaagccagggtcccagcccgcaggtgcctgcagcaagggggaggcaggagcccccaggaggtgatttcaagattggggcatgagcaccagatggacacaggcaaagagtactctgtgatttgtgcatctgaaagcagctgttctgggccagccgtgtgctcttaaaagcattggtaggaactgtatccgtctccctggggcctgggcctctgcactttgcaggctccgcaagggtgaaggtcaatcttgtgtgtcctcttggctgagctgttccacccagctattgaaatgctagtctgcatgttgctgtgaaggtattttgtagatgtggttgtcacctgcagtcggtgactttaaggggctttgagtggccctctccagtcagttaaaggtttgagaataaattggagtttcccagagaagaggaaatcttgcctcaagactgcggaatccactccagccgctggcctgccctccaaatccaggactgtacagcccccgcaatcgcatgagtcaattccttaaaataaatgtcttaaaacacacacatatgcacatatatgtgtgtgtgtggatgtatatatatatatatgtgtatatatagaatgtgtatgtacaaacatgtatgtgtatgcatatgtatatgtgtgtgtggtgtgtgtctatcccattgcttctgtgtctctggagagccctgacccaaacaccaggtgactctcaagagctgccagggtggagaaccaaagctttaaaatgaggagtcctggtcatcaaggtaaaggctttccacatagggacagcttgagcctgggcgtggagatgagacgcgtgaggtgcacagggtagcgtggttgttgcatagcccagtgtgagacctagggactggccagggagagagacctttattcaccctgtaaagaaagctggaattcaaaagacaccaaagtgtgaagcctctgagggttgtcccaagtcactcacctcctggctatgtggccttgggctacactgtgggacgttgtcatctgcaaaataggaaaactaaatcctagcacctgccttatagggctgcggggagatgacatgggaaacgcattcaaaggctgcctctgggcctggcataccgcaagggctcattcaatcttggctgctcttgctgccactggtgggaagcagtgtgggatctcctgcagctgaactgatctttctggagtgcagacctgatgccgtctgtcatgattcaagccttggaaagggccccaggactttccgagggtgggagggtgggctccagagaaaagacagggaggggccatgaggaggctcaggcaggaggggatggggtctgcagggagtgtcagagtcagctccagctgccgtaacaggataccacagagtggatgcctgaaacgacagacgtttgttttcttaccattctggaggctgaaagtccaagaacaaggtgatttccagtgaggcctctctctgtgtctttatagggccgttcccctgtgtgctggttggtgagagtgggtgatgagtactctggcctctgtttcctctacagggacaccagttccatcagatcagggccccgctcttgcaacctcctttaaccttagttacctccttacaggccctacccacaaatacagtcacattgtgggtcaaagcttcaacttgtgaattctggggcagagcggtggtacacaggtgaatcataatgtgggagactgaggcagagaggagaaactggcaggagctggggagtggggatggtgctgctggactccattcttgcagctgtgggcccctggctgcaagagaaagcgcagaggggaggaagcgggagatgattcgccagcgacctgagttgactagagaggggccctgcccagctccacgctgacagggaccatatagtcagtcaagagcgtttattgagcacctcctgcatgcactgtgaggaaagccaagtcacatccacagaggaaggccgtggtcagcagcaccagcatctgtccagtgggtgtgtccctggcatgttgcaccagcacagcgtgtgaggtccgatccttaaagctgcttcattttgttttccagcagccctctgcatcccctgcttctgcatcccctacttcattttgttttccaacggccctctgcatcccctgcttctggttttccaacggccctctgcctcccctgcatccccaggtagcactagacttttctgtttatttgcaggtagtgaactgccactgagtctgagtcgtaaacactgtttggattcagaggtcagaatatccttcccctgtgatgctcaaacttctgagtcagttcggtgttttgccagctccctcctcaactgagcccctctgtggcaggaggcctggggctgggatcctcccctttgccctgctcattccccagcttctgcgtgtgtgcccccagggagtgcaggctagcctggtgtctgggggccttggctgggctctgagctctgtgtggccattcagtttgcccacttgggtcccagtctgtggggctggcacctgctggaggttcaatttcccttcaaaaaaggtcatggtgatccctctgagaattactttgagaacctgacaactcaatgatgtgagattgcctactccaaggcccttctgtgggggacagcgagggctgctgtggcctcctgctcctctctctttaagatgagcaggtccatccacagcagcccagggagcagccctgggggcagagccatcaaggacctggtggagccatcctgaaacttcaacaggtcagggtggccattgtgcgcggcatggcacttagcacagctgagcagttaaaggggtatatggagggccctctgtgcagttgacaggtgtctgtggagcactctctgtgccattgacgggtgtccatggagcgctgtctgtgcagctgacaggtctccacagagcactctctgtgcagttgacgggtgtccatggagctctttctgtgcagttgacagatgtccgtggagctctctctgtgcagttgacaggtgtttacagaagtctttttctgtgcagttgacgggtgtccatggagcgctctctgtgtagttaacaggtatttacagaagtctctttctgtgctgcttgtagaagtcctcaacaatggtgatcttcactaatcactatttttttttcaggaagtatgcaggacttttgcaatccaacgtgcgtgtgttattttaaatttcatggctatggtggcagtggtgtcagagtaagggaaatcatgcagagtggaagcaagaggaaaccctgtcacttgtgccctattctgttgcaaaaccatgtcccagtgctggcctagacacacggggtaggaaaatagacaccacgtttttgtaggaagattggagaatagtggtctccttgcacttgacctgctgtgaagagttgatgttaacttcttggtgagtatgtaaattacatccatgggcacaggcgttctcgcagaggatgccccatccaggcctgtgatgcaactgcagtgccctggcaagtgcactggcttccggggctgggctggggagggcactgagctgagatccagaggaggagcagaggtgggagggtctcacaggctcagaagctccagggtggaaggaagcccagcctttgagggacgaaagggaagaagacaggcagagatcattctggagaagccagtaggggagtggccatgtgcagccttgtctactatgccagtgatctcactctttatataaagaaaatgcacaagagatatagggacatctttgtggctgttgttctgccaacaaccgtggcacacacaaaaaccctcacagcaggagcccaggaggagaagagagtccccattccactccttagacagcccctctggccaggagctggagaggagagtttccagtgccattccttagtcaggcgccctgggctagagctcaggctttcagacagagcctgacttttccacacccacttcctactggtttacagctactgtataaagcaaagcaccctcactttcctctttgtgacaggtagtgatgctttttacagaaactagactttatagaagcctggaggtgtggaatggtagagatccacaggactctgtagtgaacatgcaacaccagctcccatctgaaatacacacccacagatgcatttttccgttttattttatttcttccataagttattggggtacaggtggtatttgcttatgtgagtaagttatttgtgagatccttgtgcactcatcacccaagcagtaaacactgcaccatatttgtttgtcttttatcctttgcccccctcccactcttctccccaagaccccaatgtccattgtatcattcttatgcctttgcattctcatagcttagctcccacacataagtgagaacatacgatgtttggttttccattcctgagttacttcacttagaataatagcctccaatctcatccacgtcatcgtacagatgcgtttttctctagagaaagttcatcagcccagaaggcctgcctgggcgcttccctttcagactgagggatagtgacacttcccttaccctcaggcacccattgcagggtctggatgccccccacgcctggcagcccctcctcccccattgttggctccctcctctcattaacctccaaccctgctctctccctggctcccaggacaccatccctgcctttcttcctgccatcctggcccctcttccctgacccgcccctaaaggtgagcaggcccaagcttcctggctccttcctttgctggctctgtgctctctcttgaggctcaacctcacatctgtccccatatgtggatcgtcacaaatctccatccctggctccagctctttctgatgctaaaacctcacatgtccatttgtccactgtccctgcagaggccctgatgcaccctgagttcagcagagccaaagctaaccttgtcctctttcccgggaaacccgctcaacttcccagatcctcatactcagctaatgtcatctccatgtttccacatcaaagcccaggcagtcccctcctccaacatcacagccccactcattcagaaaagatgtgccatgatgtatgtgtcaggcatggcagggagagtttgccctcaagacccccagagtctggtgtcggcatctataacagtgtcactgttgtttcagaaaacgtcaggcacttctgcctctggccatgatgaagcgatggtagctgccctcccactaaaatcaaacgagagactggacaaaatgaatgagaggactgtttcgaggcattgaacagaaacagtacatgcctgttatccttgagagagtggagacccctgggttagcccataattgatctccctggtttctgggggaggcatcttcctgcagggtgcagggaggtggcctctgagcagagtggtgatctcaccgagatgaggaggcagagactggagtctgggctactgaaacagctggagtttgtaggacaggaaggagctatgtaacgggttctgtgcagatccagttggccatagcctgggctatgcctatatgcagaattctacagacttagcagagattgcctgtgagcatgacagctgaaggtcagggggtgctaggagatgttgggagttcagctcaaacagaatgaagagatcttgatgaatgcaacagacttgaaatcccacaaagaccaagacttaggagtaaggggcataccttaaggctttgttcaaaaccaaaatggacctgcagttattataaatatgttagaggtcttagagtgtcaacaaaatgatcacaatgaatgaccagatggagaatcttagcagagaaacagaaacaaaaagaaaaccaaatggaagttctagaattaaaaggtacaatatctgaaaatgtcactgcttgtgcaaaacagactccaggactgttctcacacaggggcttataaagccaggacataggccaggctgggaggagttggggaatccctgccaccctcctctttcctgggattcattactccctctacccaaatgccaaagcctcatgcacatcaattcatgcagcctgaacccagcaggatccacgactgccaatcctggcttgcagtttgtgctgggaaatggctgcattagcaacgtggagacatacttccttgtaactaagactttgtgcatctctgtaattatgtccttaggataaattccaacatgcaggctaattgagaaaaagatatctcatcatgagtttattttaactccaaagcctctttgccttatgttcttatttatatacatttcctttttttctcttttttaaaatttaactttaaagttcaggggtacatgtgcaggtttgttatatagataaacttgtgtcatgagggtttgttgtacagattatttcgtcacccaggtattaatcttagtacccattagttagttttcctgatcctctcccttctcccaccacattggcatcctttttcttctctagagagtatctgagactggttctaaaagcagtagccagcccggtgatacagggagaaatagccaaaagagctcctgccaaaacctacagtaatcagaaactttgactcaggaattctcccctttctagggatcaagctgatggaaatattcatatgcatgcagagaaatgcaggaatgaggacattttctgcggctttggttagaagtagaaaaacaaacactaacctaagtgtccattcatggtgagctggaccaataaatgatgggattatgtgatgttcacactgtggggttattaacagctattgaaagagctggattaaaacaccctgctttggaaccaggaccagctgtggtgtggaggaaacagcatattgcaaagtagtgtgtatggtatgatcctacttttgtaagacatcagaattaagtgggagtctgtaaattgttaattgtgtagaagtaggtctggaagtagatactgcaaaatgttagcagtcgctttttttagaggtgagatgtgggcagagaaaggaatactatctttccttaatactattaggcttaagttgtttgcaacgagcatacattatttttgtagctgaggaagagaacatagttctttgagctttgctgggaggcagtcagctctctggtctcagctatgacctgggacaactcatatctccatgaactttggtgttcttttcattaattcaccagggaggtgagggtagaaggagagcctggtgagcacctttcagctccaccatggtatgaatgtttgtctcctccaaaactcatgttgaaatttaattgccattataacagtattaagaggtgggacttctaaaaggtgattgggccatgagagctccgccatcatggatgggattaatgctggtataaaagagtctgtctggccctctctcagcctctctttgcccttctgttatgttatgacataacaagaaggccccttgttatgctggtaccttgctgttggacttcccagcctccaaaactgtgagccaataaatttctgttcaatgtaaattacccagtcttgggtattctgttatagcagcatgaaacaaactaagatgggctctaattctgatggtcagagcaagctccctggtaggttgaagggtggctctgactgggactccccattgggaagcaaatcaccctacagccttgtcctctgggaagtcctgacctcaaggagcactgcccagaggagtggctagagggtcactctggagaagcatgtgagcacttttcttttttctttttttttttttaactgaagttttagggtacatgtgcacagtgctggtttgttacatatgtgtacatgtgccatgttggtgtgctgcacccattaactcgtcatttacattaggcatatcttctaatgctatccctcccccaccccccaccccacaacaggccccggtgtgtgatggtcctgttcctgtgtccatgtgttctcattgtttcatactgattgtatttctatttatttttgcaaacaggtggtatactcagtatacattgctcaaaggagccccagtgctactggtttcttatctgtcccattggggctgttttatgcttatacaagcgaagatacattaatatatgttaagcttttccatcttggagattaggtatcagggagaagactgatgtgagatctgcctcctcttctttgtccctttcctgtctccccactcacctaggaatagaagggaggattctgacgactagtcttagagccaggcacctctcttcactctagagagggcagctcttcctgggatcaaagtgccatgtgtggtcttcttggagtggggctatcaggaacagctgggaacaaatgaggggccttggaagcatcaaccaggtctcatctgttgatggacatatgggttgtttttagttattacaaataaatctgtgatcagcatttgtgtacaagtctttgtgtggacatatgctttcacttatcttggataaatagctagaagtggaatggctgagtcatgtggtaggtttttaactttttaataaccggaaaaatgtgaagtgatcctgccatttagagtggtcctctgatatattctcaccatcaaggtattagagtttcagttcctccacatcctctccaatacttgatgtggtcagtctttttaatttcatgtaaagaactctgtgcagatccagttggccaagggctgggctatgcctatatgcagaattccacagacttagcagagagttagaatttaatttttaattctagtgggtgtgttgtggtgtcttattatggttttaatttgcattttttctaataattaatgatgttgagcattttttcatatacttatcaccatatctttgttgggaaaatatctattaaaatcttcccatttttcaaaattaggtcaattgatttttatgtttgagagtttcattggtctgtgtgtctgtttttatgctgctttagttattataccaaaatattgtttggtaccatgctgttttggttactatagctttgtagtatatctatttattttattttatttttttagagacagggtctcactctgttgtccaggctggagtgcagtggtataaccacagctcactgaagccttgacctcttgggctcaagtgatcctcaaacattggctttctgagtagccgagactatagacatgtaccaccacacccagttaatttttgtattttttttttgtagagacgaggtctcactatgttttccagggtgctcttgaactcttgagctcaagcatttctcccaccttggcctctcaaagtgttgggattacaggtgtgagcccctgcacccagcctatagtagtatatcttgaagtcaggtagtgttgtgcctccagcttcgttcttgctcaagattgctgtaaatattcagtgtcttttgtggctccataccaattttagattcattgttttcctatttttatgaataatgtcattggtattttgataaagattgcattgaatctgtgtatcactttggataatatgggcattttagcaatgtttattcttcccagccatggacaaaggatattttttcatttatttgtgtcatcttcaatttctttcaatgattcataattttcagaatacagatctttcatctccttggttatatttattcccattttacttttttgtagctattgtgaatgggattattttcttgatttctttttcagatagtttgctattgctgtacagaaacagtagggatttttgtatgttgatttttgtatcctgcaactttatggaatttgtttattttaacagttttttggtgaggtctttagggttttctatatagaagttcatgtcatctgcagacaggaacaatttagcttttcctttctaatttggatgccttttttttttctgtagcctaattgctctggctaggacttctagtattttgttgaatgaaagtagtaaaagtgggcatccttagctgggcatggtggctcatgcctgtaatcccagcactttgggagggtgagacaggtggattacttgaggataaagagttcaagaccagcctggccaacacaaagaaacctcatttctactaaaaatacaaaaaattagccaggtgtgctggtgcatacctgtaatcccagctactcgggaggctgaggcaggaggatcacttgaacctgggaggccgaggttgcagtgagccaagattgtgccactgcactccagcctgggcaacagaacaagactccatctcaaaaaaaaaaaaaaaaaaaagagtggtcatccttgtcttgtttcagatcctggaggaaagactttcaattttcctccttcaaaatgatgttaactatggatttgtcatatatggcctttattatattgagttacaattcttctaaactgacttcattaagaggttttattatgaagtgatgttgaattttgtcaaatgctttttctgcatctatgatttaacatattaatttttacatattgaaccatgcttgcatccctgggataaattccacctgatcatgttgaaggatctttttaaatgtgttgttgaatctagtttgctattattttgttgaggatttttatatctatgttcatcagggatgctggcctatagttttctttttttgtgtccttatctggtcttagtaacaggtaatgctggccttgtagaatagtttggaaatactccttccttttcaatattttagaatagtttaggaagaactgatattagttccttaaatgtttggtggaattcagaagtgaagcagtcaagtcctggactttcctttgatgggagattttttagtactgactcaatctccttactcattattggtctgttctgattttctatttcttcataagtaaatcttggtaggctgtacgtgtccaggaaatgatccatttcttctaggttatccaattgttcgtactgtgcattgtgcaggtaattgttcataatagtgtcttatgattccttctgtggtatctaatgttccatttttcatctctgattttccttcatttcttagtctaaagatttgtcagctttgtcttttcaaaaaaacctcatttgttaatcttttgtattttctagtctttattttatttctgctctaacctttatttttttttccttctactaattttgggttgagtttggtcttttcctggtttcttgaggtatagtgttaggttgtttatttcacatcttattttttgatgtaggcaattgttgttgcatgcttccttgttacaactgcttttgctgtatctcatagggtttggtatgtttttacttttgtttgtctaaagatactttctaatttcccttttaattttgttgttgactccttggttattcaggagcatgatgttttatttcctcatatttgaaaagtttctgaagttcctcctgttactaatttctggctttatacctttgtagtcaaagaagatacttgatatgatttttatcttcttaaatttgttaagatttgttttctggcctaatatattatctaggagaatgttccatgtgcaattgagaagaatgtgtattctgcagctgctggatagaatgttctgtaaatgtacattatgtctgttttgtctaaagtacactttaaatccaatatttctctgttcattttttgactggatgatctgtccattgctgaagtaaggtgttgatatcacctgctattattgtgttgcaatttatgtcttcatttagatctaataatatgtgctttatatatttaggtacaaatttgtatgcatatatatttacaatggtaacatcctcttgttgaattgatttcatcattgtataatgaccttttacagtttttgacttaaactctaatttatcagatataagcatagctactcctgcttttctttgggtttcaatttgcatggagtatttttgtccttcccttcactttcagtctgtgtgtgtccttagaggtgaagtgaatctcttataggcagcatacaattaggtcttgtttttaaaaatctatttagccactctctattttagctggagactttattcatttatattcaaagttagtattgatgggtaaatactcctgccattttgttagttgttttctggttattttatagatcttttgatcctcttttcctctgttgttgtttacctttgtggtttgatggttttctgtagtgcaaagctttgattctttccttgttctcatttgtgtatctgctgtaatttttttgttaccatggggcttatataaaaaattataaagttataatacactattttaagtagaaaacaatgtaactctggtcacatacaaatactctagacttttaccttaccccactcccacagtttttaattatgctgccttaatttacatctttttaattttgtatgtttcttaacaacttattgtagctatagttatttttgaccattttgattttttaatcttcatactagagatttgaaagatttacctacaccattatcataatgtagattctgaagttgattatgaatttgcgtctaccagtgagttttatactttcacatgttttcatgatagtaattattgtcctttcacttctggttgaagtactctcttgagcatttcttgtaaaggcaatctagtggtaatgaatttcctcagcttattcttgcctgggaaagattgtatttcctccatttctcaaggatagctttgctggatataatattcttggttagtagagatttttttccccctctcttatcatcccattctctccaggcctgacaggtttctgctgagaagtttgctcatagactaatggggattcccctatatgtgactttgttatttttatttccttctgcttttagaatcttttcttgttttcaccttttggtggtttgattatgatgtatctgagagaggacttctttgagttaaagttatttggggatgtttgagtttcatggatctggatgtccatctctctgccaacacatgggaatttttcacctgtagttttgttaaataagttttctgtgtttttatctgtcttctttgaaaatttcataatgcaaacatttgtttacttaatggtgtctcataagtcccataggttttcttcattttttaatcctttgctctctctcttttcccctctggatgggttattttgagttcagaagttcattttgcttgatctagtctgttgttgaagctctcaatttaaaaaaattatttattgaattcttcagctacaagatttctgtttgttcctttttaaatgatgactctttgttgactttcttattcagatcataaattgttttcctgatttcattgaattttctactgtattctcttgtatcttgctaaggtttcttaaggtcattattttgaatttcttctcatgcgattcataaagttttatttctttagggtcagttactggagaattattgtggttttttttttggcagcatcatgtttccttgctttcttgtttcttgtgtccatgcattggtatctgcacatattgtggtacaatcacctcttctaattttacagattggcatattttgggaaaaacttttacctatagatgggacctagggtgtcagtagggtagagtacattgccctttgttccaggtgggtgcagtaatatagtctctgtgcaggtttttcagctgtaatcaatgtcagcaatgcctgtgagtacctctgttgcctagtctgcagaagtctgtggcaatagtggtagcaagctatagtgttagtttcctcattggctgccaaatactttttctatgtacattgaggtaattgtgtgctttccttttttcagtttgtgaattttggtaaattacactgttgctttttgagcgataaactaatcttgccttcctgaaataaaaactccacttggtcatggtgtatcacaatttttataaattgttgggtttgatttgcttttttttttagagttttacatcagtgtttttcaggaatattggtctttcattttcttttcttggaatattttctagttttactttgtcagagtaaattctggcttcacagaattatttgtagtctctcctgtcttagtttattcatgctgctataacaaaataccacagacaaggtggtaataaataacacaaatttatttttcccagttctggaggctaggagttcaagaagctggcaagttcaatgtctggtgagaacccattcttcataggtggcaccatctaggtgtccttacatgacaagagatggaaggacaaaaagatgtgaactattgtgaagcccttttttaagggccttaaatccattcattatggaggagccctcaagccattcatgatggaggagacctcctgaccctaatcacttgcaaaagtccctgtctgttaacactattacattggagattaagtttcaacatgaattttggaagggacacaaacattcaaaccataaaaacttcctttcacttttttgaaataatttacataaaattagtattattctctaaatgttttgtagaactcatcagtgcatgtgtctgagactgcagtgtgtatgtgcatgaagatttttaattagaaattctatttttaataaatataggtccattctggttacatatttcttcttaagtgaggtttggtagtttgtgttttttcaaggaagttgttcattttatatcaattgtcaaatttattagcatgaagtgattcactatattttttatatcttcttaacatctgtagaattagatgatgtcagtgtcacctctccagtttctgatataggtaatttgtgtgttcccttaccatctctttttccttcttcttcctgatgaattattttctttattattttttaaatttcattggtttctgctttgatccttattatctttttcttctactcttgtggtttattttgttcttctttgtctaggttcctaagatggaacctgatatcatcgatttgagacctttcttcttttttaatattggcatttaatgttataaatttccctgttaccattattttgatatattgtattttcatttgtttcaaaacactttcaaatttcccttttgatttcttattggagccatgaattattcaggaatttaatttagtttccaaatatgtgggtttttttagaggtatttttttttgttattgattgccaatttatttccactctggtcagagaacatacttggtatgactgagtcctttggcatttattgaagcttatttctggtccaaatatgtccaatcttggtaaatgttttgtgtgtacttgaaaagaatgcgtgctcttctgttgtttggtatagtgctttataagtgttagatcaaattggtcgataatgtcattcatgtcttcagtagccttacaagttttctatttattctatgaattatttagagaggggttttgaaatctccaagaaatgatgtgtggatttctttatttctttcctcaattctgtcactttttgctttaggtattttaaagctcacataggtttgtcaatatttagtatcattgtgctctcctgatgaaggtatctctttaccattataagatgacccttttcaaagaacctgatgaggtttcttgctctgaattctaccttgcttgacattaatgtgcccatttcagctctgtttgattagtgtcagaatggtacatcttttttaagattttatttttaatctatttgtaactttatatatagttttgttgttctttataggttctttatatataagacttgttggcagcacatagttttgtctcatgttttaatccattctgaaaatttttgccattaattagggtattctgaccatttgcacttaatgattattttattaggtttaactctaccgtctggcaatttattttctatttgttccatctagttttttccatcttttctatctttctgctttcttttggattgagtgattcttttattccactttatctcctctgttggcttattagctatatacctctttgactatttccatagttataatggttgctttagtggttatagcatacctctcttatcttatcactgcctacctcaagcaatagtatgctaattcacttttagtctcatgacctcaccagagtatacttctgttctcctttcccaacatttgttctattgttgttgtccattccactcatgttataaacctcatactactttatttttagtatcaaagtcagttttcttttaaagataaataataagaaaacaattatatatttacacttgtggttaccatttctattactcttctttccttggtatagattcaggtttctattggctatcatcttccttttgcctaaaggatttcctttgtcatttcttataatgcaggtctgctggtgatgaaatcttccagcttttttatgtccaagaaggtacttattttgtctttattttgaaagatagtttttccaagtatggaattccgagttgtctggggttttttttctttcattactttgtaattgttgctccactgtcttgtcatccacattgtttctcttgagacatctgctgtcattctctttgttactctatacagtgaatacagataatgtctttttatttctgtacacttttaatattttctcatggttatagattttgattaccatggcccagacacagttttctttatgtttcatgcataaagttcactgagccttttcctgcttctttgcaggcatggtaattttttattggatgacacatgtgaattttaccttcttgggtgttggatgttttttgtattcctataaatactcttgagttttgttctgggaagcagttaagttacttgaaaatagtctaattcatgccaggttttgctttaacatttgttagatagaaccagagcagtgctcaattattgagttagctcaacagctaactcccattccagaggcagaaccccgtgtactctattcaatgtctgtacaccatgaagttttctgtctggctgatgggaaccggccctccgtctagtgccatgtgtgcaccgggcactgctatctcatcatttcagaggattctttcctcagagtcacatattaatccactgagggttcaagggaccctctgcagatctttggatcttcttactatgcaactctctcctctccaggtctctttcacgctaactctggctgccctgatccccttggcctctcaggttcatattctcaactctgggagttttccaggctcttcctggattccccctccctggattgtggcctggcaactctctagaggcagtagctggccagtcatgggcctactccatttgattctcatttttcaagaatcactgtcttctgttgctgatttctagcacgttgaaaactacggttttatacattttgactttgtgtttgaggtttgagtgaggaagacaattcagtccatgtttgtccaccttggtcagaagcagaagttaatgtcatagctttttactttgaagactcagacaagttttcacaacacattccttctagagaataaagttaggctctgctattgggtgtccccagatgggaaccccacttatttttaggcttcagctcagacgctacttccttcagaagtccctttctggcacactaccttcctcatgtggcttatttgttcctcttgcaccagatcactccgcagcttttgagtttgtatatggcaacaatgaacaaggtataatcctcgctgtagataaactcatcatatttgtttttctccatggagtgaaaatgttttaagctcatataatgactatggtcagggaaaaagccacacaaataattaggatatgttgtgacagtgcacaaatagaaacacacataatgtgcttgagaacatgataaatgccggttttacctttccttccctcacctgaccaagcttagcgagacgtgtggcatcttcctcatctttgctcttcagtgccaggtatggaataggtccattatggacaggtgccttattgaactgagcagagccacgaatgtcaggctgggagtgtggtcgctggagtcaggccttggtttacatcctggttctgcttcttaaccactctgtgcttcgacaggagagcaggaggtcctacttagttttggacgtgctaagtttgggatgcctgctagagatctgggggaagcatggtgaagaaagctgaatgtgcaagcctggagttcaggagggaggtggtgtctggagatggaaatctcgagccagtagcagttggttcttagtgtcatgggacacaggaggtcatataggaagcaaatgtggacagagagtgaaggggtttgaggattgggtcctgggcacatccacctctggaggtaggggagatgatgaagagccagcaaagtaaactgagacataatcattgaggcaggaggatagcaggctagggcagagacctgcaaggagagagaagagagcctttcacaaagaagggagtgaccgatggtgtccatgcttctgtgtgcttgagtacagagtctgggattctcctgagcatcctttgctccactgggatggaagatgggacctgatgagaccggggctaggggaatgtcctgagccccacacgtttgtgtctgtgtgcagggagcgtggaaggcagttcctgcttggtgaggtggagctgagagcggtgccacttagcagctatctgtgccactctggtatccggagagaaggagccggcatttgcccatccttcctcctaagccctgtcagttgtgattggaacgatgcccccgcccaccacatttgctggagttggactagagctggtaatatcagggttttactttttagtttaatttcttgcacaatgcatggatgtttattgagttttgccaataaagagttccatagggtattactgagcaggactggtctgaagataaatgaaagttgtgtacttggaaagacaatgctgtattattttcaaacccccttgagaaaaaggccttttgcactgggtgagctctggatcaggtccaatacagacagccttgcaaaagtggtgtttcagggaacacaagatgggtcaaatgatgacagtttggggggaatgagtctttgaagagctctagccctgttcttttccctcggtggctgccaggcagctggtcttcactacaaatgcagactgtcacatgtcaagactactgcagagttgaagaatggggcacaggactggaaaaggtgaaacattcttctcaaaattccaccaatttttctggaataaacattccttgttttgctgtaaacatgtggttaatttcaagaattgtgaaaaaattgactgcaatctttttttgccagttttctctttgcttttacaaaggagagattttttttttgtcattttctgtgatgttacctaacaatgttctttctaagcaatgacttctttttttataaggaaactatataaaaaataaaatacagtaaccaaaattaagtaaaatgatcaattcttggcttttatttgccaatttattttaatatatatttacaaaattggacacatacacatatatattttggcatataatatgcatactttctgtcatttgctttccttagcaatatatagtgactatcttttgtcattccgtaacatatacgccaccatttttaataggtacacaatattcagatggaacagatgcatcgtaatttaacaggcatcctctgactggatgtttacgttgtgttcaatttcttacttttatgaaaaagtccgggatgaacatcctttcatgtactttttatgtgtttgtcccaatcattttaggagacagactcctagaagtgggatttccagatcaaaggttaggatgagaaagtaagcgtgtttgggggcatttggggagggtgatgtctgtcacacaatctagactgaaagctctccgtccgtccctgcacctgtttctcagcttctacctcctgctcagtgctaggcagcctgctctgggaaggcatgctcatttagattaattcaatcagtgggtagaagggtcactcaaatccatgaaaagtcctcattttaagctatgtcttttggaaatttcctcttttggcttttaagtagcaaaacctggtaaccttctgataccttggtgaagatcagtcagatctgtaagtttttgttgtggtcctactgtgtatccttgctgtgttcatagaggccggattaataagtaaatgagaatgacttgctcctagcacagatttcacacagagtgagttttcatttatgtctagaaatctgcaaagaagggaactttttctcggttaagagcaaatacgattgaaagtatgtgatgataagcctgagacatttgcaatgggcttaaggacttggttcatcaaaagctgaaaagattaaaccacgttcagtatagttttatgtttaagcataccatagttctctgaaaatggcagttccttttcctgtattagtcccttagcattatgaaggaatctgtcccgagacctttgagacttcctgcattcatgaatgtcaccgtcgcattcagtctctctcataacatgcagtaaaggccaactgaaaaatgcctgcaactcctccaggctcctgaggagactataaatacaagactgcagtcatttataaagctattaaaacaaagtggggcctgagcccttgctgaaatgattttcagagttgttttctctctaaaacacatggcaaacaatcgcatgttagaaattcaagacttggctgagttccactttttgtatcttactttatcccaaacttctgtgaaacgaccatgttgttcaactgactttcttgctttctattcccgcctccacactaggagttgacttccttttaggtaccatgtttcttaagaaataaaacctgccttcatctatggaagtgatcatattggataacaacttgagcccccaggaattaaatcccggcccaaaaaaactgcaaaaccacagactgcaaaactgcaacctacatcgcatgtagatactctggagttacttgcaggcagcagcatctgcagtggcagggcaggtggggactgtgctgttcggaaagctgaattaactagcacccacatttcctagtgcactaaggaatgacactctgcctgcgaaagagctaaaccccatctctgctcctaagtaaatataaacattccattccctaataccttcctctcatgctgttaacttcactcagctgattccagacacacatagaacacaagggctggcctagcagacctggagtcagcccaccgttaagttcacgcaacagtattcaccaatgatctgccatctccacaccctgctaggacatgggcgggtgggggaaaggctgtcacttaaagtctctgcaggagacagatggtaaacaaactgaaaagatatcagttggttggggggaattaagataagtggagtggtggtgattgaaggctcagagggtttctgaggacctgggtccaaccctggatggtcctggcaaggctgtgcggtaggcagaggaaggagatgacatggagaccctagcgtgggatatctagaaactgaaggaagagccatgtggctggggggacagtgggcagggagaaagtgcagggaccatgtggagctgggtgggggcagtggccaccatggggaaagtcactgtgtcatttttggtccaaactcagacgtttttgaaagaaaaatgtaggtgctattagtaatcatctgggacagcaggtgtcagccgggactgtacctggaaacccatgagtagggggcttagcggacagagatggtgacatcaccttacccctgtgttgcccactgttccactggaaagtgccgcaagctggcgagcgtgtgtcctctcagttctagccaccatcaccctggtctggagtccttcctctggcaggtgggcggctccattgacaagccagccctccgctaagacctgtctcctttgttcccttctctcctcttgccctggatggggcttttaggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaagtaagtggcagcttgcgggcacagccgggcctgtgctctggccttgcaggcggagcccctctgagatcccacatcctgggtgtgccaggccgggacgcacaacccaccgtctgcagcaggtctcttgaccccgccaccgttgacgtttggggccgtgtggaggccctttcctgtgggggctgtcccgtgcatgctcagatgtttagcggcattctcggcctctacacactacacctcccgtgacaatcaaaactgtccctggacatcatcaaatgcctcctggagggtgaattgctccactggcctgtagcagccaggcaaggactgggccaaactgatgaggacatggcttgtcagtgttagagacaggggcagtctctgttcacctctatctgatcattttcctgcaagaaggtggatccagtgttgccagatcttctaaatttgtcaagtaaagctacccccccacccacatacacacagttatgcagtcacgtgtcacttaatgacaggatacattctgagaaatgcgtcattaggagattttgttgttgtgggaacatcacagagcgcactacacaaacccagagggcgcggtctgcagcacgcctggctccacgctgtagctgatggctccgaggctacaaacccgtacagcacatgactctaccatatactgtaggcaattctagcacgttatggtatagaaacatttctcaacatagaaaaggtacagtaaaaatatgacatacaaaatacaaaatgtcacctctgtatagagcacttaccatgaatggagcttgcaggcctggaagttgctctgggtgagtcccgagtgagcagtgagtgaacgggaaggctagcacgcgaccgtgcacctccgcagacttcagaatcactgcacacttaggctacgctaaatttacataaactttttttttctttaatagtaactttttactggataaactttaactttcggactcttataataacacttagcacaaaacacaaattatacagctgtataaaagtaatttctctttacccttattctacaagctttttatatttttcaattttttaactttttaaatgttttattaaaaattaaaacacaaatgccgcattagcctaggcctgcacagggtcagaaccatcaatcactgtcatcttcctcctccacagcttgtcccactggaagatcttcaggggcagtaacatgcgtagagctgtcatctcctatgagaacagtgccttctggattccttctgagggacctgctggaggctgctttacagttaacttttttttaataagtaggagtacactctaaaataatcattaaaattatagtgactacatacagcagtaacatagtcctttcatatcatgatcacgtgtgatgtactgcacggttacacgcactagactttgagaggccttggcagcacagtaggttttttcacaccagcatcgccacacacgttaggaacgccttacaccacgatgtcatatgacagcaacaatgtcacgaggcataaggaattttacagctccattttcatcttctgggacaactatcttatatgtgtcgtatatgtcgtgtatcattgaaatgtcatgaggtgcatgtctgtgcatatatacacatacaggtatatccacatacgcatcattttctggacaatatgtgcaccaagtccacccatctgccgtctggctgtgacccagagccacgggtgggcaccttctgtgttgcacccccataagtttccctgggtggtccctgctgtctgctgggctggagttggactgtctcatggggcaggacagagtggagctgctgcgtcttgctggttgaggtctgaagggatccagtcatgcccctgagacagaatgggggccttcttttggaaggcaaggctaccatgagccgggtggagctgacttgtgtggctttccaggatcgggcacctccctagttgctttccacattccagagccactggagttcagaacccctcggagcttgctgcgtaccccagtttgcgcccacggacactgcccaaaggtgccaagagccactgagcaggcatcggtgggctttcagaggaaagtcatgccattctggcagggtgggcctctgtttcccctttcaccaggccagatggcaggctaacgtgtctcgtgtgcggtaggagaggaaattctgataaagctcaggtgcaccgtcccaggagccacagtccacatctcctgcccaccctgtgaggtgtgagtcagtctgtgtagggctgggcttggtagacagtgccctggacagcccctagtccgctccttccctctttaaacctcaaaagccaacccttccctggagggagagacagtgccccaggggtgaggggaaccagctcccggagcgccagtgcctctgttggtttgctctgcacccttgctgtccccaggcccctgagtcactggagaccctgggaaaatgcaggttctgatgctgcaggtgcagggaggcctgagaatctgcatttctagcaagcttctagggctgccgacactgctcgctgctgggctgcaggccacactttgagaagcgagggtctacagcagggtccccagccagggaaccattgatgtttgggcccagatcgttctccgtggaggggccgtcccgtgtgtgtagtgtgttagcagcattcctcccgccttccactagatactagtagtacaccctccgcttctgaccaccaaacgtgtcccagacaccgcccaacgtcccctgaggtcagagacaacagaacgctccccgggtgagaatccatgatctgaatgttggactcccgctctgggcagattttcctctgagcagtggggcttttcatttcgaggaagggttgtttctggtctccgctggggagcttgagccccagtgttcccaactcccaccaaaatccttacttgagtgttttcacggtggagggccgtgaacgtaagcaggtgaggccggcccggggtggggctgtggatagagcacgaggtcctacccttccaggtgttacagagttgtgcttggggcgcaggtgcaggttgcatttctaccagcggttgggacagccctgccgctcggcctctgcatcgtggtgtcgtcatcccaggctttcatttctgcaagtctcagtgatgggacgtgtgttcctaaggcttggtttcctgtttctctgatttctggtgaggttgagcattattttcagcgtttatcagctttttggtttcttctttatgtactttgcctgaagttttctttatcttaatgatttttaggagtttacttttgaagatgtagcttctaatccttccccattttgagttacatgattcttctctctggggcttgtattttcagttttaaaatacttttctttgaggcacaaaagttttgatttttaaggctgtcagattgctgatcataaacttgaggagctcacagcctttttctgtgaggaccaagttgtcagtactttgaggtttgtgagccaggctgtccccgccacccctactcagttcaggcgctgtagtgatgaagtagctgtagacaatctgaggatgaaggggcatggctgtgtgtcaataaaactttatttacaaaaatagccagcggtccattgggtccagctggcactttgctgacccctgatgtgctttatggttcgcactatttgtaccgtgtttaaaaatcctccccagcctagaggtcatcagaattttattcacttctgttatttgcggttgcctttacctgtaccagttaataatggttttctatttgatagtcaaaccaagttctttcaaattaaaatactaagtgaattgatctaaacaacaaaaaaaaaggtaagtaatggaagatagtacatgtggttcaaaaaacaacaaaaattatggtggggcttggaatgagagatgcctggggtccccaccgccgactgtgaaggttgagaggaagttgggagaaggttgggctgccggggataccccaaacgcccccctatgtaagaagtaccaaaaacatgggccctgtggcttgtttttactccattacttactgaatctggaactaattttaaaccttggactggaatgtagtagctccctgctatttgtcaccatgtttaaaaacctggaattagacacagagaaaacagcagcggagtagcagcatcccaggaggtcagacatggcttcctggaggcgccatttgttttccctacagcagtggcttaattggtctccctttgtctctgctctgcctcctttcagagattcctccaccgtctcttgctaagtaattcagcctctggttgccatggcaacgtgccatctactgtatcccaaagaacatttgcgatttcctttttttaatttccagaaccttcatattttatcttctgagtgttcctgggccttttcctggtgaagcagtcactgctccccacggctaccccagaacacatccgtgtgcttggtctgggacccccaggaaagtcagggtcccatttgaaagagtgaagctctatgctgattttcacccctctctgtgtaggagctcagcttacctttaaaacctgtgtggatgcatcagcagagtatgagaggcccgcagctcctgcacggtaggtgtgcactggaaattatgcacagaggcacgggctgttttgcctccatcctgtctacagccaccatctaaggagagcagtgggaagcacctgctgccggctttcagcataggtgccggcgatgtgcttgacgtctgccttactttctttcatttatctagtcttcacagtaacccagtaaagcaggtggtactatcatctccattttacagatgagaaaattaagccttggtgagaaggtaactggcccagggccacgtagcttgcagaagctgccgtgcagtgagataggccatttgttagagccctagccctgggcctgggagaagcattctagacacgaaagcactgtggctccttgtttatcttaggcatggctttgaattttcttatattggtttggctttgatcagggtatcagctggcaactgggcaatgcaccaggtgtctcgggcaaaggacttcacacttgctctaaagcagtgcagaatgttggccgggtccggtggctcatgcctgtaatcccagcactttgggaggctgaggcaggcagatcacttgaggtcaggagttcgagaccagcctggccaatatggtgaaacctcgtctctactgaaaatacaaaaattagccaggcgtggtggcaggtgcctgtagtccaagctactcaggaggctgaggcaggagaatcgcttgaacctgggaggcagagtttgcagtgagccaagatcatgctattgtactccagcctgggcaacagggcaaagacaggggggttgggggtggtggcagtgcagactgtcaacacagcatggagcagtggggggttggacatcctcagggggaacatatagaaagagacactgcccagcaagggctctggaacagtgcagcaagcaggctagagccccagccgtctttgtctcagctgcgtgagataggccagcaccagtgtctcagaatctctctccttgtttgtgaaatggggatggtggcaatacctgcctcagggccctctggaagattccacattggtccctgaagaaagtcataaaagcacattctcagcagggggtgctggggccagagctgctgctgtcacagtcaaggctggatgcactcctgggcgagctgtcacctgcacggggcagaggccagcagcaggccttgtggcaggatgaaatgaatgctgctgcatgaacagcggtcacgatgctagtgggccagggagtgcaggagcattgctgttgatggggcttgagtgtcattcccattcgtgactgttgtgtaattttgcccgaagagagaggaatagggtaggcacctcctaagtcatgcacaaactgtcattccccttggggcgttctttgctcccaggaacgtgtgtgagaagctgattaatgctcagtagcatctttcaggagggggcacttagcatgttcatacagcagttagcggatctctgagtggcttctctgcacgttttgtcctgtggcctccagaacacgctgcaccctcaggtgtcctcccgggctgtggcctcccactcctgctctgtctgcaggagcaggacacagcgtgcagcgagtttagacgctccctcctctagatgtgctttaggcaaggcaggcctatttttggtcctggagacagaacgcacagaaatgtggagacagacagtgtccccgcagaggctgtggtttgggctgcaaggcggaaaccgtgcctggccagccaggggaccagcctgtctcaatggggccttcgttctgctgtgagcttttacctgaaactgcatggacggaaattttcacttccacagaaatggtgtttggtaaatttcagacacgtggaagcgggggaggaatcagcttccaatgccagccttcataatgacaccactaatagcatctgagagggtctgccgtgacgctgggcaggtgcagtgctgattgcctgtgatgccgagcagggaccatcatccctgctctgcagatgaggagactgggcagagaggctaagcagtgtccctgggtctcacagttcatgaatggccaggctgtgggctccagggccctcgctcccagccactgagccttgctgcctgaggccaagcatccggctcacaccttgtggacagggccgggaagctgatgatacactatagctaaaggccagtttccggtgaatgtttgtgttaatgaggtggttatggtccacgttcactgggctgagtcctttgcccgctgatgtctgcaaccctgaagttctgtgctcggtatggtgtgggtgctgcacacaggctccttcatggatcttactaccttccccaagaccctcactgaggagcgaacacacctgacatgggtcactcccggagcagggctgagctgccgcaagcgctgacggtttctcttgtcacagttatcattgccgccctgaaaaggctgcaaagtttgccttctgcctcagggttaatccatggctgctgggatggaaggtagcatttgaaattacctacagggggaggctgcacctgcagaacgggcccagttgatcctgtcacatccaatgtcattgcccatctcttggggtgcttaccccccaattacagagatttcgaattcatgtagcgtgcacgtgctaggcgctggggtgcagagatgaaaagatgcactcacaggtgataaattattgtgtctggtgaaagatgtacagagatagatgtgtggaccagcttcaggagggagggtgagggtgtcccaggcagaccagccagtgagagctcgaaggtgggaagcagcaccgccttcccaggactaccctgggggctgagaaggttcagggctgggtgagggtggcagggcagagggagaagactggaggggccatgggtccaggtggtggaggctcctgtgctgcccgctatgggttcccaatccacacagacctcctcttgtcattctgggctcagctcagatgtcaccttcctgaccatctcccagtggcacagcctcgccattaccctgtgtcacatcgtcccctgctgtgtttttagccacttccacagctgctgaaagtgccgtttactcatctgttctgttcgcctcttcagggtgtgcccactggcgtggcggggccctgctctgctcttctgtgagggccttgcccaccaaggaggcgctggctaagctggtgggaaatggcagatgaggaggcctggctctcccgagaagcagccagggctccctgggggtcaggagcgagggcatgtctgggaaacgcccctctgctgcagtgcagggctggtttgggagagcaaggctagagctgggtggggagacaagggtttctcacatgctacaggcccaggagccagcaccatcctggggacgcggggctgcagagaggacggcagagctggtgaggatgaacggcaggcctgtggctgagggaggagggcctgccagcctaggggtgggtggatctgcaatggtggagagggaatccaggaagaaggcaggcagacacaggggaaaggttatatgtccaaagggtccctatgccgtcaggtgcctggggtttttggcagtgcttccatccacttgtgcaggtgagactgcccaaggagcacagggactggaacgggagactgcccggtccatgctggacttgctgatctcagctgaggtcgagggtattcagagcccgtcgtggtgttttatacggtcctgtacttcctgttatccttggtccattttcttctacactatcttccctccagtttcacacacttggacagaagggagtggttgtttttcactgaccgccaggaaccacaacaggcttctgtgtgttccagtgaaataagccctatctgtctctcgggaatggagcagtgttaagctttttttaaaagcacaatctgaagacactggggtctggaaacccattttttcttgttctgaagcctgtggggcctccgcggttgggccttgctgaataatttggggttttaggttgggtacatcaagggtaaagggcttctgtttggatcaaacaggaggtggggggagggtgagattccctcatattgctgagaagggagttgggggctgagttccccgacttcagaggtgagacatctcacaagccagaccttgggactgtccctgtggacccaggctggactgggaagttcagggaaccctcgactcgaagagggttcttgttaatgaacagtcttcaaggagcaaagcccagactgttctcccagtgtggtgtacacatgaggagggacctcatcggggggaatttggcttcctgatattcaaaagcacatttgtctgctcagtctctgaaattgccagtgggacaatttccaaagggatcaccagaaagaaggtaaatgcagagacgaacaaggaactcatcatacccaggatcgttcttgatcaaaatgccaacagctgggcatcttcagccaaaagaaatgcagttgtggcaggaaagactcagctgtacttggggttctggtttttttttttttgtttttttttttgagatggactctcactctgtctccaggctggagtgcagtggcgtgatctcggctcactgtaacctctgccttctgggttcaagcgattctcctgcctcagcctcccaattagctgggattacaggtgtgcaccaccatgcccagctaacttttgtatttttagtagaaacagtgtttcaccatgttggccaggatggtcttgatctcttgacctcatgatccgcctgccttggcctcccaaagtgctgggattgcaggcgtaagccaccacgcctggcttgggtttcctgttttatagtgaaccccaaggttgcaaaacaggcgatgaggcttgtgatcatttatctttatggatcatgggtctgcgaactggatgagagttttaagcatgtcaggtgtgcaaacatctcctatggttgtgggaatttctccttgcatagccaccattgtctagagcagcagtccccatccatttttgtaccaggaaccagtttcatggaagacagtttttccatggaccagggaggaggatggttttgggatgattcaagcacattacctttattgtacagtttatctctattattattacattgtaatatataatgaagttattatacaactcactgtaatatagaatcagtgggagccctgagcttgttttcctgcaactagatggtcccatctggaggtgatgggaaacagggatggatcatcaggcattagattctcataagaagtgtgcaacccagatccctcatatgcgtagttcacaatctgctgagaatcgaatgctgctgctgatctgacaggaggtggagctaaggcagtaatgcttgctcgccactactcacctcctgctgtgtggccaggttcctaataggctaggttgccccagatgggtactggggttgggacccctgttctagagcagtctgcacgctggggactctgggtccatgacagtatttccttcctgtgtgataggcctcacagcctccactttgcatgtgaggaaatggaggctcagaattgttagtagccagtgagtagctgagtgaggacatgaacctgagtctttccagctcaaagtccttttccttagcctatttcacaactccctggaactcatccatggccatcctctggttcaaattatcctccacctaggcagtagactttcctttaaggaaggaagaaacttcttcaatgttttatcctcagtgcctggtacacagtaggctcccagctaattactgttgaatggatggttggttagatggatagatggatgattgtatgattggataggtgggtggttgggtagttagatggatggccatctggatggtgggatgattgaacaggttaatggctgctggggtaattgcattataagatgcatgagtataggtagatggagagacagctggatgaataggtagatgggtggataagtggtgggatgttgtgtagttagatggatgaggaggtgaatggagacattgttgaactaaatggcatcctattcactgtgcttgatgtaccctaatatctgtccatccatccatgcaactgtctcagcacgcacagtgggttagatggaatttcctaagagtttatttcaataaaataagagtttagttcagtacaataagtgtttattgaatgaatatctctctttgcatagtgggctctttggatacatttaagcaatgattccatttactacattgattataaccaacctattcagaagtgtatttgtgaatagtgtgagccctcaggacctcagtggccattgccaattttggagactggttctgtgctgtctccaggccagggtctgcatacgcttctggcgacaccactgccgtctggctgctgaccagcctgggctatttctgagctgcaggtccttaggccctcaggtgaggatactccagaagcctccacttcaccctcactggaaggaagtctctggtggaaacaagctactcctaaagctttctgagcacttgtcaggaggaataggagagaaagctttatcggaatgagtaagaccaatagtattaacccatgactcgccacaggaggcgggtgggggatggtgtcttcacagctcattcaacagagtagaagtcacagacccaaatgctccataagtgacctgggccaggcagggctgtggcatcctggggagtgtgcactcttgctcaagagggcagctgtcactcagatcctgtgggccatcacccctggccacatgtcaggccattgtggccagaatttccaagagaaaccgaagatttgatttttttggtgaaatagccttcatgtaaatgttgagagcctcttcctatttttaaaagcaatgtgtgcacccagaaaacatatttgtggaccagatttggcccgggaccacccactggccacctctgatgtgaagtcacttatgcacttgtattgggagaagtacatgtttctttacactgaggttaaggggattttcaactcttgagttagcagggaaaataaatgggtcatcctgtaaagtgactgtcagcagcggaagcctccagggctaccactgtcagtatcctagggagcctcagcgaacctgtctccttcctcgcatatgtgagggggcccttgtgtgcggccctctcagctccacccttgctctaaggaagccgcacagtgcaccgctgagaagtcaggatggacagaatgcctcggttcccagccagctctgcagttttccagcatgtgggcatggggaagtcacctcctgacatgcgccttactttcctcctctgtaaaagggatgtgactacaacagagcctgtcttttggggccacgggaaggatgcaatgagccgtcacacgtagaatgcctggaatcatgcctggcagagaggaagctctccaggaagaaaaggaagaaatctgagttccatgaggatagggaatttgtctctttcagttttaacagctttgttgagacataattcacacaccacatgcttcacgcactttaagtgtccaattcagggcttccaacatactcatagagttgtatttccatcagcacaatcgattttaagatattttcctcactccaaaaagaagcctctccctctcagctgtatctccagtccctagaatggtactgagtcctgtgggtactcggtgattttgcagctactgctgcagggacgaaggggaaactgcatgggaaggcatctcctaaacatgaccagttattggtgtcaccattccctttgcttcaccaacttgatcttcttcagatccttttcttctgcttcggcatcttttcattgtcatcattttatcttcatcactatcatcaccttcactgcttgtttatcatcatctttgtcattttcatctttttcttcctcattatctttccatcatctttagcaacaactttgtcaacatttttatcctcatcatcattttcatcatttccataatcacgaatttgccccatctttgctccctaggagacactcggggaacttgggctctcaatccccttgacgtctgggggcttggcctatgaagggaatgaagcccacatctaaagcaggttccggagcctctgctgagtctgatcgtgcctggagtgaagaggactcttgagaatggtgggggctgggcgcagtggctcattcccgcaatcccagaactttgggaagccgaggcaggagaatcgcttgagtccaggatcacttgctgtgttgcccaggctggtcaccagacctgggtgcccacaggcagataagaggaaggtgcctgagtcaccaactgcccacgggactgaggcacctccctcttatcttcctgctattttccagatcagcctgggcaacacagccagactccatctctacaaaaaatagaaatttaaaaacagctaggcatggtggtgcacacctgtgatctcagctacttgggaggctcaggagggagagaggatggcttgagcctaggagttagaggctgcagtgaactatgatggtgccattgcactccagcccgggcaacagattgagaccctgtcgttaaaaaaaaaaaaaaaaagaaaacaaaatggtgggaaggtgagtctgagccgggaccctgcagatcccacaggtccagctcaggttgccacccccgtgtgtggcctggttgggccggtgctgtcccagtactggccacccgtcaactgaggcacctggttgggccagtgctgtcccagtactggccacccgtcaactgaggcacctgattgggccggtgctgtcccggtactggccacccgtcagctgaggcacctggctgggccggtgctgtcccggtactggccacccatcaactgaggcacctggttgggccggtgctgtaccggtactggccacacgtcagctgaggcatgcagggctctgccatctatagccttctttggattccgagatcccaagaacagaagctgttggcatttagcaatttatgattttcttcctttttttgatgctgcagatttatccgactgactttcccagccctccagggggaccgttgctggggcttccggtctctctttgtttagaaatctcagggcaagtggagatcaggtctgttctgcacagatgcaccttcctgagctcttggcgtggcaccacctcctgcttcaccactgtggtgaggggtctgcctgtgaacactgcagagcctccaaggtcaagaagaccaccaagatttatgagggcactttcaaggatttgttgcaaaaatgcgaaggagctcacgaggcagtgctgtgagcaggctctgtgtggtattgtgggcagaaatcaacctcagccctaaagggaggggcctggtagtcctgcaaaggccggggcaggcaaggccagcacggatcaggcaaaatggtggctatcatgtatggatcttgtacgttctgcttttagatggaggtagctaagcaacagaacacacagcttccaaattgggacaagtttaaactggcaaatctcagccccagaggatataaatatgacgcttcatcgtcttgggtggaagtccccgtgtacagggagggaaagcccatctgtgtgtggcatgcagggtacagggagtgggtcccgagtcccatcctgtgcaggggagaggctcaggccccttctgtgcagtgtcaatatgaagtggccctgtccctgctgagggctccagggagggtcagctgctgtttgttttccttggttgcttgggaatctgtagaggatggtacagcatgttttgtaagaaaatgcaaaacaacatcaacccccattcagtgtcaataaaacatgattcccaaaccagggagcaggtggtttggtggacttggaggctgcctggctgagagccatgggctgagtgagcccagggaagtcacatggtgagtccaagccttgaaatgggtgtgtgatgtctgcctgctcagatgcttgcagggactaaataccacacagtcctgcttcacccaggatcggggcttagcgtgtgtgagtagtagtcatggtaataagagcacaaccatagctcactaacatgtatgaaacccatgttatgtatgaggggtggtgtttgcctgcattcatataaacataagacgtaaatgctattattggatgttcttagcagctaaggaaatggaggcccagagagattgggtaagatgctcaaagtcacacagctagtaagctagtggagctgagatgtgacccaggtgggccgactccagaccgcacgttagagccaccccactccctggaatagttgcacaggcggtcaggactggcatggttgttccaaaatcaacaaggacgcagactcctcttaccttcctgctatttacccttatgccggtgttgatcctccatggtccagggtggctgcaaaggcaccagacatcatattcaagtcccaaaggggcatacatctcagctgagtcagcttttccagagggctcctcccagaagctcctccacacacatctacctactgctccttggttggaccctcctcatgtggccgtggtcagctggaaaagagactgctctgaataggaccagcattcaggcataagaaggggagaagggagatggggtaggaaactcgcggcttctgctgctttaggtgttcaagttaattttgttacattaaaggaagaaaagaagcaacaaatgaagagatggatgagtgaatggaaagcattctgtctgttaggtagcaatgatttctaagtgatttctggagcagcctggtttgaggagtgcatgtggatccctatgggcttggagagcaccgccggggaatttaaaaatgccccattcctgaccctcccacactgggccagggaggtgagcagctggcaggaagttgaggaggaggagggaaagaggaaccctgagaggcgctgagagtgatgtggacaaacacagctaccccctccccagcaatcctaccctttctgcagcgatcccaccccttccccagcaatcccaccccttccccagcgatcccaccccttccccagcgatcccaccccttccccagcgatccgccccgcaacgatcccaccccttctccagcgatcccaccccctccgcagcgatcccaccccctccgcagcgatcccaccccctccgcagcgatcccaccccttccgcagcgatcccaccccctccgcagccatcccaccccctccgcagccatcccaccccctcccctgccatcccaccccctccccacagtgatcccaccccctccgcagtgatcccaccccctccccaatattttagttcagcaacagatgtttcctgaacagcctctgtgtgccactctccgcactgggcctaggatggggggaagaacaaagcagatgcgggggctgccttccgaagcttccattccaccagcaggcgtgggggaggggaggtcaggtgaacatgtgtgtggcacatgtggaatatgtggctatggctagacacgggaagggctgcagtgcagagtgaccgtgttccactcaggtggcttccagcatcccctcctgggctggtgggcgctggtgcacctcagtgccattgctgatgaaggtctgggtccggtggaaatggtgtggtctgcagatgaggtgcgcctgtcttttcttaaatcaaggacactttcagatggatttggtttctctctgactcggctcgttcagtcagcctgacgggcacctaccgtgtggctcgggccccgtgctgggcaagaccctgcctccagctcccagcctcactaggagtgggggatgggagtcacaggatgtgcccagtggaacagccgccagggcaggtgaatcctggagagcggcgggctgttcaggtctgggaccctgggaagccacagggaggagtgcatgggagtgaccctggaagcccagagatggagatggggaggggaagggctggcaggggccctgcccgagcaaaagatcagaggcagacaatgctcagcgtccaaggaggaaagcggaaggagctggagggcaaggcaggccctggtacctggcaggtgctccattggtgcctgtggaatggaccccaaaggatcttagccctgggagcaggcagtggggagcattacgtattctttccattttcaaaatttgaagaagggacttatatacatggtaaaaaataaaacggtacttctcactcccacctcatccatctgtccggagtcagccactgtccacggggccatttgtgatcattcagaagtgggtctttataggagtcctaacgcccagaacagtaatctgcagatattacctcccatgtgctgtgcccagctcggggtgagctggaacctgcggtagatccttcgctcggcatcagtctctggagggaggtaaagacctgtcctcagtgctcagccccaggtgactactcaaaaagccatttgaaagaagagatcataagcatgatttgttcatgctttaaacacaattttaaaccatacagatgtcacttgtttggccgtcactttgaggtagaatccaaggacatttctttgaggaaggatctaccaacttaagttatttttgctctaaacaaaggctggatgtgtctcctccaagttccactgacagtttctttggagaggagtgagtatttaaaggcacttggaagcaatctcagtgcagaatccttccagagttttaaggccccacctccccagatctcacttctctctcccacgcaaactgcacagtggtatttttagcaacttgcctctactgactccaaagcttagttttcatggaatttacattttcattttacacccatatgagatcatttaatcaatgtgcattaaaagcttaattacatttattacagagacaagtacacctggtacaaataggtttgggaacagaagcaaccagttcctgatccatgcacagctcagctggtgtggccaggcagttctgaaatcaacagggaggccacgaagtcagcacgggatgcccagcatggctggagccactgaaggatttctgcttcaagaagcctcaaccggtatctaaggccttcccactgatcagatcaggcccacccatttcagccaggacactctccttgacttaaagtcagctgatcacggcccttggtcacatctaccagacgccgtcacagcagcacctagaggagtgtttggttgagtaactggggactgggaccccaccccccataccattcaggttgacacatcaaattgaccctcacagattcaaggttggcagaaagctcatgagcagatgtaagattgcactcagtctctcactcacagcctctctcctcaggtgatttgtagagaagccactattcaagcaaagggcaagttcaaagcttagactcttaatgatgatgtggttttgcagtttctatattcacgtttattcccttttatcttccccagagtctggctgggagagccttccacataagggctaatggagcagcacccggttcctttctgtaatggcattgaattccactgcagggttgaacacaggtcctttaggcccaatgggcattaaggctctgccctgtgcttggctataatgaacatcctcatacgtgtgtctgtaagaggcccatgtggaaggatgttcacacacatcagaaatcttggaactggaactggcaggttagagaatatatgcatctgtcatttttgacctgagcattgaccaccagggaatgcccctgattgacagccccaccagtgggggggcggggggaggggctctgtctacactcctgtcaacattgtggattttccaactttctgccctctgctgatctggaggtggcacagtgacgtgctgtttggcacaaccacacactccatgtggttgttatttccatggaggtctgtgaatgacgatgaactttggacttgccccacaacagcagcccagttctactagtaaggcagagctgtgtcccacaagcccagaaccatgccccctgcagcggggcccctgtattgccagtggcttctctgttcattttgctgtgccagcttgagaggctgtgcaggggctggggattcagcagtgaccaggtagacaaagtctctgcccttggaggggtcctgagtccctaactggccagcttggtgccttgtcctgggttggcacacatactgccttttgtactctggtggcagctgtgcaagcgtgggactgtggtgtctctttcacaggcttggagggtggcttgcccaaggttgccttgttgctgtcaaaaccagcctttgggctcaagtttctcaatgtaaacctggcgttgccttgatgtcccattcatgtatccactcatgcattcagacactcattcattcattcagtcacttgttcattcattcactcgttcattcactcattcactcattcattcattcagtcactcattcattggtcacttatcacggaccaggcttggttccagggccctgagtacacagcattgggtactactgatgcagttcttaccattgaggtactcaaaacataaataatcaattctggccatgaaggccacaaaatacacaaatgcactggggagcaacctgtgcagaaaggagccagttacttcagctggaggagtcggggtgggctttctggaagaagaggtttaagctgaaccatggggagatctgggtaacaactttctcagcagagggaagggcccaggcagaggcgctgggtgggaatcagcttggcatgtgctgtggtctgaatgtttgtgtcctccccaaattcatgtgtcacccccagtatgatggtggttgtacatggggcctttgggaggtgattaggtcatgagggtgcagtgctcttgagcgggattagcgccctcaaaaaagggacccctgagggctgcattgctccctccaccatgtgaggacacagtgagaagatgctgtctctgggaaagtgggtcctccccggatgccgaatctgctggcacctcaaccttggacttcccagactccagaacagggagaaatggatttttgttgtttataagacactgagcttaggggactgtgttgtagcagccgcgctgggcaagggcagctcagcaggtcagcatgaccaaaggaggacaaggtatggggaggagggagatcagtggggtgggggaggggaggggtgctcaggggcttcgaggaggctggagctctgctcctcagcaggttgtctccctccaggaattccctgccacaggctcgggcctctgggtcctggtggctgagcacagatcttcgctgagtgtccctggtctgggccaatgtggggccagcatcttggttcttcccagctgactcaacctgggcttggctcacccttggctgggacccaaggaggccaggcagggtggtggggcccagtggggtgtggggcacattccttccagtgcgctcccctgccccagccttacacctggcattacagggcacatgctgtcctcaccctgcctctcacacctgctgtctctgcacacaccctcctggccctgcctctcacacctgctctctctgtacacactgtcctcactctgcctctcatacccactctcccacacactctgtccctgccctgtctctcatgcctgctctgcacacacagtcctggccctgcctgttacgcctgctgtctctgcttccctctctcacgtccttccctgcagggtgcgtctctccctcctctttgcacacatgttcttggcctttcttcctcactccactttcctcctttcaaaagtagcattggcagggctgggtgtcactgtgaatgacattctctgcgttaccttgactgtgagaacagaaagtgcctctctacaggtagatgcgagtttggtcctgaaagtcaagggcctggttttcctccggaggatttgaatccttccctctccctgctcccctcccttctctccttccctccctccttccctcccatagttctcaggcaccaggtgattcctcagtacctctgagagtccccagatggaaggtgacctggatgtcccttggtgtccatgttgctgtctttagcacctggaagaggaggtagaaggggcatgttcacggtggggttggggaagcctctcagggcagcccgggaaccatccggagagactggtgctggtgaccagctggccttcatgggcgggggtgcacgtgatcttggtgcctcacctgagcccttggaacacccggctccaggaggctgattggaggcgagacccctccccaccaccactggggctgttcctggtgcagagggtgaaggactcatctcatctgtatcccaggggcactaacccaaccctgggcagggcagtctagagtccctttttggcttagggtgggccacagagccaggctgacaaaacagaaatagcaacagtgatggagacagtgcggtgtgcagcttgcggagcccagggcacagcggcctggctagccccctcacatacggctctctcctttcagtctcaccaggtgagaccatggaggtgcagagaggagactggctgcacccaggaggtggaggacaagagacactggagagtctgggaggccaactccacgtacctggagttcttttctgtgctgccctgggagggagcccaggctccaggggacatatttctcctgcagggtggggttgggaggacagagtaggcaggagcctttggcctgaaggcttgtcactgtgggcacaagaggcatgggacaccttcccgacatcagaagccccccactgcaccaagcttggcggggcttcctggtggagttgaagttgccctgcctcctatgccctcaggacacaggaggcaggccagccgttctgttgccttttggaaactcagggcagctctgtggattgtcacagcaactggagctcctgctgtattttcaggatggtcccgggaggcaggtgttctgcagccatggggcactcccttagcaatgaagactggccccccattccacttgacttctgaatgtccctgggacactcatgagagtccgaagcctgtttatgatgacctgagcctcatcccaagtgcattgtggacacacacaggaggtattttggtggagctgtattacaggtggcgtctcctggaatgcaaaatgccagaaacctctcccacagattggggagggaaccttgctttgtccagagcttcaccaagaagcattcctccactagtgtctctcagggcatggagtgaccagtgtggcagctgtgggtctgtctgcattggtggctggcactgtgatggtgatttttctgtagcggcagcattggcattgtgtgctgtgtcacccaatccagccatgcctggcacttacttacctatcggaatatgtgttatttgattaaaacttaatttcctttttcctcctttatattgcagatagggtgttatgttgtttttttggttatgcgtgtcagggatttggaggaaaagggacaagacagaacaattgtaataatgggggtgtgtggggtacagtggggctgcggacccgtgtgaggagaaggacatctttgccggacagggacagtgtgaacagccacttattggtaaatgcagctcgacgtggggccatcacccggcatggagttttgggaggggtgggagtaggaggggctgctggaggggtcaccgtaaactgaaaggctttgctgagggccttggagtttgtcctgaggatggtgggaacccgggcttgagctcatcgtgggagtaggagttagagttatgctgctgtgggcagggaggtggacagtgtggaagtctccatcatccagggctgaggcttgtggcctggatcagggaagtggccttggggatggagagaggcagatggatggatggacggatggatggatgcaagcagaacccagcagacttggagcttcctggggtgttggacgtagggagtaagaggagccagttctcccaggggtctggtgtgtgcctgggtggtggctggagccagcccctgagcccaggatgctgggcacggagcaggtgtgaggaggtggggaacagggtgtgaaaaggtcggctttggactcagagtgcctggagtcacatcctccccggcatcccagaagtcaggactgctggctgctgagatggggcttgccccaggcatgtggaccagcagccagcacctctcagctgagccctcagtcggcagaacatccctgcttgctgtttcctagtgtggacacactccatcccctctgcctggatgcccatcccaggtctttccctgggcggtttctttcatcatccaggcctcatcttatggcctggagagtcctcttctcttcctgaacttctctccagacacacccacattgctctgacgctctgagacatagggtcaatgtgcctgtcatccgtgcacccagatggtgtgcgcctgggggcaagcagacgagacatctgccccattcaccatcagatgtctgaggatgcatcaatgcgtcgtgtgaatggtgtgtggagacgctgcctcgctggggaatcccatctccaggcgggggccgccagcttttctcagtgactcaaggcggctgtggggcaggattggcattcccagaaaggagcctcccaaaatagcccgggcgtcccctgtgggtgtcgagctgtctgttctctctaggaaggcattctgccttgtatggaaggaattgcttctcaatttctgctccacactgaggtgactttagatgttgattcaaaccttttctgtgacatctgtgctggggtgagatcaagatttgggggatgtgcgtttagtggggcagcctggctgggtggggcttcattggggaagcaaagcttggggagctggaactatgcttctcctgaccccgtgtccttccacttcctgaaattacctgcagcccctgctgctgtgctcatcatgcaggaaggcagtcagctgagcagtgtgtgcagaggacgattcagaaactggtacaaacttggcactgagacggcgtctgatgggagaagagggggtgtctgatgaaagaggctatgacagacaggagcatgtgcgtgtctggtggaagagggtgtgcgtgtctgatggaagagggtatgagtgtctgatagaagagggcgtgagtgtctgatggaagagggtatgagtgtctgatagaagagggtatgagtgtctgatggaagcaagtgagtgatggacagtgtgagtagatgatgaaagaaggtgtgagtatttgatggaggagggtgtgtctgatggagacggtgtgaatgtctgatggagagagcatgagtgatgaagagggtgtgagtgtctgatggaggaatgtgtgggcatctgatggaggaagatgtgaacatctgatggaggtgtgaatgagcagatgttgaaagagggtgtgagcatccgtctgatggaggaggctgtgagtgtctgaaggaggagtgattcttggggatccaggcctgcaaggaggcgctgggcaggatggagcctgcagctctgctggctgaaggtggaagagacctgggctcagcacgccaggtgaataatatcagtgctatagtagtaatgatgccacctatttgtgtgtcaacctcctcctgtatttagtgttctcgactctcccagcatccctgtgggttttgttggcaggtgttcacctggggaatcagaggctcaagtaagggagggcgtgacgccatcacccagctggcaggggtcagagctggaactggaatcctagctctgtgccagtgctggggcaccagtgctgactgtggaatagacagttgacagcctccacagacctggaaatgtgggtggcacagtggcatcatgactcctggagcctctccaggcgtcctgactgtccaggctgtcggcggtctcatcagctccacctctaggccccttcctccccattgtttgtcccctgctccctgtctcctctgtgctactcacagcacagggccaggtgtgtcgtaggtgactgctacagatctgtcgtgtgagaggcactcggaaccaggaagtgcctgtggggtcacctgtttggctggtgcccccttggcccccagaaatgactcacatccacacttgaacatacagacatccttttccagggtgtgttgtgctcgatacctttaattcctgtctgcattccagggcctgcccagcctcttcctggctccccagcccagcctggtccttccggcctccctgtcatccccacctctcgtgtgtgcacaagcagggaccaggtagggagaccggcagatgctgctctctgtccctggggtttcttttcttagtgttgctcccacacccacgcgatgctttaattaactgccacactcaggctttctcagtggggagagtcagaaatagactgtggcttccccagctccaggcggcaccaggacgtcaccagcagccccatttctgaatcaggagtctcaagcagctgcagagggtggggaggtttggggaatcccacaggggttctacacccccacctaccccgccccacccctctgcagggccttctgcagcttccaaagcccagctatgctccggccacgtctctagcggctcctcggagagcaacttgatactgaagctcaaagcccaggaagccctggcggcatccctgccccagccaggtccaagcaggctatgtagtgagggagaggaaccggcgcccattcctttgctcctcgacacaggctgctccccttgcctgcgccggctctgggggtctgctctcacagagcttcatgactcgttcaacctgactgcccttttcctggccatggttctgcctagaaaatttcctgggccaccctggcctgagtggcgactgtgtgtcagggcaggggtcagcacactgtggggcaggggtggtggcctgtgatgcatgcctctgcctgggcctgactctctgtgctgggagaatgcttcctgggcctcatcccagctgtgtccctgctggctagttcctgccagctggtgttgccggtgttcctccctgcctcagccctcccagcatctggaactggctgtgggttctgattccagctgtagtagctgctgatcacattcctctctctgagcctcaagggtctcgcctgtaatgttggcaaagtaattgtctgtccttggcatcaggctcgtcaccatttttccttttggaagccccaactctgcatgaagagttagcatagcttcaggtagcaggtggacaaaagggtatcttttatgtatacttagggtaacaagtattaatttggagtgtggggtgtttttgctctgtggccaacttcttccccaagtcttgaacacttcagggggccctcacaggcctgcagcacactttgtccttggtatctggtgggggtctgggcaggtccgtatctcttggtagtgggttcatctccatctctgttggacagaaatctggaagagtccggagagtgtttgcaaatgcaaatctagtcctggcacgcccacaccccatctcacccaggtctgctttaaatccttcagtgccgctctggggttccaggagtgaatccagactctctctccagcgatgccaggctgtgtgggtcctgcccctgctcagcctcggtgcacacacacctccatgcgatctaaacgaccccacctcaggacctttgcacatgtcctctcctcacctagcgatccccaatcatcctctggatcccaactaaagtgtcaccttctgggaagccattcatgtgcagattagagcctagtctgaacggtggcctggccttgttgggttggcagaaccaccctaagaccctgcttagcaccctcacctggcagtcaggggtcttcttgctcacctcaatcccctccactggtgagaaccacagggagggtcttggggcccacagcactgtctagggttctgcatccacccttccaggtgtggggtcctggcactctgtaagtagagaggcaggttggtgacaagccagtggggtcctggcctgagcacccttttgctctgtttacaaccctgtgcctccggggctgtgtctacccagaggactgcatattctagaccattcaggggtaccctgttgacattcagtgagaagcttggcagctagatgaagccctgcagtgagcgattggaccactaccagactgcctctgtgccttgggaccaattgcacagtttttgctggcttgatgtccacgctttcctgaggtgtaccagttggatgaaatgcttttctgggaacatggtccgcgatcagctggcaagtcacaggttgggttttcttgagaaattactatatcccaagcatgcattgtcacaaacatttttgtgcattatctcatttaatgctcattaagagggtctggtactaattctcattttggatgagaaagacaaggttccaacaaagggcggggggaagccttgttcgggggccatgccagtggacactagcctccagggacatttggggtacttctcagatttgaggaaatgcacagcctcactcctcaggtgtccctatgggtgttcctggctgggcagctggctcaagaattgtcttgagccacacacaaaatacaaatggctggggccagcatcgcggacagtgaaagagtttaccaaggcagttataggtaaagaaaggcaaatttattagagaaagtatgaagatccgttgcaagggtgcaatgggcagcacagtagagaaggggctgctggaaagaggcaggcgctggagggaagttttatagggttgtgccagaggggcttatgtgcagataagatagtactgctgggtcttcgagtggaacaaggtgtttggaaataggatgtcatgccagtgggttgtctgtgattagctggctctcagaacaattcttctcccccacctaggaccccttcctcattgttgcttacttattaggactccacgttttacttcccaagatcccattcctatacacagcctctccctcttagccagaggagctgtgcaaaggaagtaccttttcatgggtaaaagactcatggtgcgctcactcttgctgggcttcagggatttttcatttctattgctctaaaagtgcctgtgtgccttccccctccatcccatctccttcctgcttccgagcccttctgtgggcagcatgggggccaggaatctggcttgttcctgcttttcctatggtggtctgccccaccattattcacacacagaggctgttgggttctcttaccattccctgtttacagagactcagatacattcagaagcgagctaatgctgggtgcccagctctaaggggagaccccagacaactccaatttcctgatgatttctcttcctttacctaattccttctccaagacccttgcagacactgctgtaccaagtggattctgtgtaactctctcagaagtttcctcttccatgaagcctgccttgattacccacccccatcctcactccctcagtgtttaagcccagtgtgtgaacagttaagagacgctatggtcttcccacactggtttcttctcttcatttgggtctcagcgaaatgtatctctgccagattctgaatgtatctgcccctgcccaaccactcacccaccatatccgccatttcctccacggcattgaccactctctcagatgattttgttcatttgtctgcctttacctctagaccaggggcatccaatctttcagcttccctgggccacactggaagaattgtcttgagccgcatacataaaatacactaacgataggtgattagctaaaaataattgcaaaaaaaccctcataatttgtgttttcagaaagtttatgaatttgtgttgggcctccttcaaagctgtcctgagctgcatgcagcctgcaggccacgggttagacaagcttgctctagactatgagcttcccaagggcagggaagacttcccatactcagcactctgttctgggggcttggaacagtgcctggcacatagcaaatatgtcatagtcatctcctgagtgcttgaatgagtggcctttggggtgttttgactagactgcaaaagcaacacttaagtgagctaggctttgcatacattgtttgggactggggaggattccagccaggaattgtcagggggggaggttcaagtctcactgaacatcgagatatgatgtggaagcaaccacccacagagccagaagacaaagcccccaggggagcagaaccacaaagggttgtgttctagtggggagggaggagtggctgagccccgcaatgccctaggctttctgctgggacaaggattataaataggagataaataatttttaaatggaggcaacatcctcactggggcaaaatattatggccctaaattctaggcattcaaatactgggccctgttgtctccctgctgtggttagaggatctggaagtgggaaggtttctggctctggcccaaggacaatattattgtagtcataaaaataatcagagcttggcattaattttggatgatgatgcctccttctcctgacaagccctttatgttttttggtggtgactgttggctgcatcctccaacttcctcaatgagagaccacttgaaaaagaaataataatttgtcttcatatcgcacactccgtctgggctgatggtgggaggggaatgcgtgtgggtgggctcagctctgttagctgcgctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaggtttgggcgacagatcagaaaaatgaagacctgcacatgtggagctggagcaaggactagtctagtattagctctgtgacgggagagctttgactgtcacctggaagtctgacttgattttgccagcaagaggcaacaaccaaaggttcactttctctccttccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacgtgagtagctggtgattcctctagaggttttccttcacgtgtggtgaggctgttgcacaaatcctgagttcccataacccagcccttctctgcaagcggaatgctccatgctcccagtaaacctgagctgctgctgaattctgaaagcaagccccaaaggaaagctgatatacctagaaacattttttttaatttaaaaaaactcctttcctcttagcataaagatgtttttattttcagggttagtcccatatgtctaagtgcgttaggtttcaagcaggtcttcctggcagtttgggtcggggttcttcatggctatagaaatcacaaagcatgaaccgcatgaacacactagagaaggacacgccccttgcctgttacacttgggaggaataaagcagtcagctcagggaaacggtgaagccatgagaagctttcctgtggctcaggactttgaggttccaggaccctctgttgctcccagccttgcaaccccttgcatttcccgttaggtggacaattatagcatatgctgagcataggtgttcatgagtaacctccatgctctagggcactatattccattaaatattccataaagtcagtgatttaggggtggccaaacctcttgaaaaagtgtttctccaatagttctttatctagtcattttcagtttttaaaacattttccacagaaagtgtcttctaatggcttggatttttaaaggactttttttctctttatgtgatgaatactgcagactttctctgagtttgttttcttatttgtgaacatctttttatgaagttataatggtaccaagctgactttctgtcagaaaataccgcagagccccttgttggtctgggtactgaacttgaattgattcctccctcctttctttgcctcagtgccttcattaactgcctaaaacaatcccctcctttatagattgttgaaaataaccctcagataaagacttcttcattttactttttaaacttaagatatagtgactactgttctatgttaactataccatctctgaggatttaaagaaaagctcttcattgataacatgcttaattaagtaggcagacagaaaagtcaagctgtttcagttgccaaatatttgaatttttaaaaattaagtcacttatttataaagcttgtaagttgcagatgctactaaaagtagcagtccagacttgaaccaggcaagttcaagacacaggaagcaccacattccaagtagcctgctgtcagcaacaggaagagagtactacagcccagacctttaacccaggaaccatgtcttctttcagtagcagcctcttccttcctatcgtgggcaaccaggtcttcccatcagcaagtacttctaattgtgttaatctttggaaataaatatcagagccttagaaatagaactatctttggtgaatagggagctagcaaatgcataactgaaactgactgcccttaccttcagtgcatgaaagggaaaatgggtttcctctgcggtggccatggcaatcccgccataaacactgtgccttcatcagtgaatgtaggtttgtccttagctcggaagccctctctagtgtcctgagtggaaggacctgagaattttactgctaggtttgtggtgggtgtttggttttacttttgttctgtggagatgagaatagggtaactatatatagcctagtatgaaacatcatactcataggctctagatacacaggacttcaagcactcatactgtattgtattttcttcttgtaaccaattcttagaatatcacttttgtatttgcttcaagggggaactcatgactaactgcagtcatatctgaggagcactcaaaactccgcccatataacactataacgtggatagaaaagcagaagagcaggggtccctttatatggtgatggtaattctttattaggcccaatctgtgccagggactatattcagtacttggtatatattccctcatttaatcattgcaacatatttgtgaggtttgcactttttaataaatgaatattgggaaaaggatagcactagagttcaaccccaggtctgcctaactccattgcccatcttcttaactactgcatcagaagcagtaatacatttctggatattcatggaagtctcaggtataactgtccaagctgctggagctatttccagaaaatatgagtatagcagtcctgattatgggtcccttgctttgtataatgcagagggtgttctgggtctggaaataagaaatccataaacatatcactaaggggagctcagaaggggaggtctgtgggcttaggctaacagggaggacttcttggaggaggtctccaacagagcgcctggcacaaagcagcactctgacaggaactttcaaagatcagttctccaaagaccctgctggtgaccttcgtagtaattatggcatttttcaggattaaaaaaaaaaaaaagatctgactttgtttcaatcttttcacatggaagctgcacttgggagctgcccatggcctattttaaagaaatctgaaacattttacgtcacgtaaatccctcatggcttgccttgtctggacactttcacaatgtctctctaattgtatcagctttctgatgataccttaaaagtatggtttcttctggtttctcacttgtataaagaattaagcagaaagaggatttcattaccttttctaaaacaccctaatccaagatgactcacttaaaaaaaattactggaaagcacaatatattaaactctcatataaccaatcccacaaatgtataaatatttgaaacgcatcttttacataaaggcagataatgtgaaattgtgttaattgcaagtggcaggatttcccttaccaaaacctaccagtgtttctaggagtgctgattgttgaaatctctttcctaggaatggagctatgttcaggtcagggacataaggctttatttagcaacagagaacaccagaaataggacagccattatcttgtatcccagggggaagcttacgttttatactatatctcagcactttcgtctatttttggcttccaagggtaggtgcgagcacagcttgaatgttaatagtcacaacttaccaagcaaagctaattttgctgagggacttgggctcctttaaaaggcactgtcatataacagtgttcacgcttcagcaatggagagtcagcgaggttcatagatgtgttaagatttgaaatatagtctgaacatataaattccaggcaagcatatgctgcccaggagctgaagaaggtgttccatgttttatgttggttaaaaagtctgtacgcttattaaggaaaaaaattagtggcagtgctatttatattgaaatgtacatatacatttatttacttagtctactacagctttttttatgtggcatctaagtgctagatgtaaatataaagatatttggggagaaagacagacacagaggtgtctacttccttaaacaaacagcagccatatctgtggttgtttctaatgcacagaagggctgaggagaccaggttgggatgacagcaaagctttgcttagtacaagtatttctgtgtaatgagaccatgatctcctgagcagtgactgacaaagtgggaagaaaacaccatgagtgatgtggaattaacttcagctcccagaaatatggatatcttgggaacacttccctgctgaagagaagaacgtttcaacctgtttctctttgttattttttttttcctattttaatctttcacagaaaggaatgatcagacagagcaggaagaaagaagagaaatcaagcaaagattgacaagaaaggtagtataagcattttattgcctgaataataaaaggtggtctagagaacagctgcttcggtagcaggtgggatgggtaatgctaggtatcactctgtgatcatgaataatgttctcctggacatcatggcatcagttaaatcaggatatttgctcagcaacaatgaattaactccctctgacgttccctatggacgaagtccttccctagcacggtagcacttggagaggtgcacaatgcacatgacattttttacttatgttcaggtggaagccagaagttgattggcattttcttaatttacagtgtctaggaaaagcatacctgggtatcagtgttttagtcacattttacactcatcgcttttgttcacctccaatatgtctagaagttcctcagttgcagaaagctttattagactcaaaggtttgttctctgtgactcaaacagttaacatttactatggccaatacaggtagcaactctataaatcttaatctacttttaaagccttgaccatttctaaattcaagtgttctggattccccttcttcgttgtgctgctccataataattctcttgaaattaacagaatatccttcctaagctggacatataataactttattagtacttttaaaaagcttatctaattgtatctgaagccagtgatgccataaaatctaagttaattcactaaccattccttgagctggtgctatgtactactgggggtgtgactccttctgataaaatatgttggaggaagggggattgtgatttaagagtacagtatataatttcagcccttcacattagagattgcttgtatttgggttatattttccagtttcaggttttttttgttttgttttgttttttaagagaagtgctgtttgttcagagtacttcaaaaaagctagtttggcatgtgatacttaactatgatgatctttaattttagcttaatcagagacccactgttgatgaattaagagacagaaaaattctgatacgattcagtgattacgtggaagtagcaaaagcgcaggactatgacaggagggcagacaaaccctggacgagactgtcagcagcagataaggtacctaactgcctgtgctggtggggggtgttggatgatataataaaggcaaaatatgtcatgccagggagtttattcatagacaatgggagccctcaactatttaagggtatactgcagtaaatattggtttctcaaagataattcagggtcagattgagaagtggttctcagctaggtgacagttttgccccgagggacatttggcaatgtctagagacatttttgattgtcacaactcgggatgctactggcatctcctggtagaggccagggacactgctcagcatctcacaatgcacataacagcccccacaacaaaggattatctagtaccaaatgtcaagactgtggaaattgagaaaccttggtataagggataaatcaaaggtgggcaaggctgccataagagatcaactgacaagtttaaacaaaaagagctacagtggggacaaagaggcattcaagaaagcctctacagtatagaaaaggttctagattctccccctggacttgtgcagtttgaggtatctctgagaacctcctaagaagtctgaactgaacagctagagaggcaggaagaacacaaggaggtagtaggtcatagagtctctgcatgacatttggtgagcacagagagggtcagttcttgtctgtgatcaaacacttgactggcaagatttaagcccaagagtgtccatagagttttgtcaccttcttgcttctattaattttcagaagacttaaagcctttaggaagagaaaaattatacattcaggcaaggaatttgctaattgttcttcattcttcatatgctgagtatgagtatgtacacagatattgcatcaacttggagaaatgtgaacgtgttggactaacttgcctggttctttgtgactgatgtgcccagaggatcacagtgatgcgaggagaagtatctttggtggtctgcagatgtgtttgagtatgagaataatatacccctaaagttcttaaagactttccttgtcccagaggctgtgtttgatgttttcagtctcatcaggtccctcgagtgtttatctgagaaagaagtacatgatgcaagtgggcctggggaagccaaaatattaatgtatgctgaagttagaaaggcttatttctagattatctctgattataaaattccaagttcaccaaaagctgaagtttactcattatcttggtgttcctgtttcattagtgccctaagcatgtgcttggtccgtttaggtatggagtgaacggagtttggggaagggttgtcttcccactacagttcagcaaattaatgaatggaacacttacataatactagtcctagccagagcaatcgagcaacagaaagaaagggcatccaaactggaaaagagaaagtcaagttatccctctttacagacaatatgatcttatacctagagaaacctaaagactccaccaaaaacttagatctgataaattcactaaagccataggatacacaaaatcacacaaaaattagtagcatttctataaactaataatggactagctaagaaagaaatcaagaaggcaatcttatttaaaataggtaccaaaaatacctgaaaatgaattgaaccaaggaggtgaaagacctctacaaggaaaactacaaaacaatgatgaaagaaattgaagaggccacacacaaatggaaagatatctcatgctcatggatagaaaggactaatactgctaaaatgaccataaaatgaccaatgcaatccctatcaaaataccaatgtcatttttcacaaaaatagtaaaagccatcctaaaattcatgtgaaacccaaaaagaacctgaatagccaaagtaatccttagcaaaaagaacaaagctggaggcatcacactaacttcaaaatgtattataaggttatactaccagcataatattggtataaaagacacatagaccaatggaaaagaatagaaaacccagaaaaaattcacttatttacagccaactgatttttgacaaaggtgccaagaacataaactggggaaaggacactcttcaataaatggtgctgggaaaattggatatccatatggcaaaagaatgaaactgtacccctatttcttactatatacaaaaatcaacttgaagaataaagacttaaatgtaagaccccaaactataaaaccactaaaagaaaacacagaagaaacagtccaggacattggtctaggcaaacattttatggctaagacctcaaaagcacagatagcaaccaaaataaacaaatgagactatattaaactacaaagcttctacacaacaaatcaacagagtaaagagacaacagggaatatgagaaaatattaatatctgcaaactattcatccaaaaagggactaatatccagaatatacaaggaactcaacagtcaaaaaacaaaacaaataatcccattagaaagtagacaaaagacatgagtagacatttctcaaaagatgacatacaaatcgccaacaggtatatggaaaaaatgctcaacatcattaatcaacagggaaatgcaaatcaaaaccacgatgagatatcatcttattccagttagaatagttattaaaaaaataaaaacatgctggaaaggattaggagaaaagtgaacttttatatactgttgatgggaatgtaaattaatgcagccattatggaaaacagtatggagactcctcaaaatattgtttaaaaactatatgatccagaaatgccacttctaggtatacacgcaaaggaaatcaaatcagtacattgaagagatatctgtactcccctgttcactgcagcattattaacaatagccaagatacaaaatcatccaagtgtccatcaatagattaatggataaagaaaatgtagtgcgtgtatatatgtatatgtgaatacagtgtgtatacacagccacacaaaatggaatattccaccttaagaaaatccagtcatttttgacaacatgtatggaactggatgttattatgttaaataagccaggcacagaaaaacaaatatcgcatgttctcactcatgtgggatcaaaaaagttgatgtcatggaggtagacagtagaatgatagataccaaaggctgggaagggtggcagggtttggggagagaaagagaggttggttaaccagtagtaacatacaattagaaggaataagttctaatgttctatagcagagtagggtcactacagttaacaactatgttgtgtatatttcaaaacagctagaagagaggacttaaaatgttcccaacacatagaaatgataaatactggaggtagacatcctaaatacttgatcatcacacagtctatgcatataacaaaatatcacatgtaccctgtatatatgtacaaatattatgtatcaataaaatttttacaaagacttccagaatattagctacatactagcttggtaggactataataatgagtatggcagttttaatgatgaaccaaaaaattgtttgtttttttctgtatattacataatagagtcaacaaggattaggaatggttaatttataaacacgatgctaatttcctgatttttttaatatcctgtaaaacaatgtcttgtttttaaatttcaggcagcaattcgtaaagaattaaatgagtacaaaagtaatgaaatggaggtacatgcatcaagcaagcacttgacaaggtcagatttgtttctgtgaatttcatggtacttatttttgaaacacacaccgccttcccccgtcccccgccacaaaccatgtatccagctatacaaattcagcatttttccagagaactctattgaacaaatagaatgtacctcaagtaagaatgctgcctgctcccattatttcctttaggacttggtgaaaggtgatatgtatggtaacaatatcggtttatttaagtagttaatgcatatttaacaaaaataagcctcaaggcaatgaaagtaatttttctgtgtatttaattcccctctaatattcagaattcctccaatttatagaactcacctgtttatacttacagatttttgtgaaattagtcactccccaccttcacatttactttttcctatcgtaaattattagtcacatctttaacacagccagcgttctcctaaagctgagtatttgtttcctcagtaaatatttgagtaagtgctgagaatgcaatagtgaatatgataaaggaggctcccatcttcatggagtttatgtcccattgggaatatattggctgattctcccataatcaagacttttcccattaagatgaatatattctctgtctatgctatgatatgcaagggatgacactgggcttcttagtgatgacgaagttgggaaaagatttaactctctttacttattgaactgcatattttttcagtatttccccccacttcttttccatggccatgaccggtagtaattatgtgaagttctcaaacatctctgattctaaagcagatgactgtgatgcaacaagccttcaactgtatcagttgctttgtcttctcctttatctgaagatgctcaaggcccacatacaaagagaaaggaaatcctgcatatagatactgccttaaactaaaataatagctttagttttctgtttgttccaaagtggccactgcaattgttatctgaaagatttactctgtaagattaatgtggctatagaacagaaactaagtacaatggaattccaccttaaccaatggttttagggtgaatatatcaaggggaagggaaagttggatgaataggaaaaaattatgcaaagagtttgttttttaaggttccctcccatgactaacatacttttggggaggaataggtcatatggaggaataggtcatatgaatgtttaggaaaaacagtttcagtaaatcatgcacaattacatttaatgttcattctgtcttaaatagaatgaatacatattctatatattgcaatctcaattttgtacattttccgattatacattattaaatgtttagtaaagatgtttattgtcctaagttgatagctttctaaaataatgactctaatacttaaaatgtggtataaagaccctaaaattatttcaacaattcaagagtcagaacggtatttttggttatgagattttaagagttttaaaattactatgaacatattactctacaaaaagtcataactctactataattttcaataatttattaacaaattcatcatttctactgatttagcaaagccctggcctttctgtgtacttcaagggcttttaactcacaggtttaaaactaagttctagatagtcctaagaattcagcatataacaggggcctgagagtggggagccctctgagactctaccctattttaaccagagtagctccatcctcatgttttacatatgggacttctgagaatctttttaatagcagcaaatttatttgtataaggtttttggctattttaactgctagaaatgaataaccttaaattctttgtcttttttataatctctagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaacccaggctttacattttcttgtggttgggatgagtggtactttagaacagggatctgtgaaacaagtcaatttttacttgtgaacgatcagaatccaaacacatgaatgagaattccaactttttatgtgtttggtttgtgccttagaaaatcaaattgagtgcctttaaccaagaaataagcaataatttgttgaaaaattctatcaaaatgaaaagtatgcctctttagagtatttttaagctcacctctgcaaacactgttaaagaaaggaaatttaccccagcacaaaggtgaaaatcttggcacaaagggggaaactaacaatacatgttccctgaaaaatatttttaattggctttcaaataagtgtccttacagagatgagccttccctcctccttccctcctggtatactggtgaggcaggaagcacagtaacttggagcatgactttcagagcttgcagaacttgtgcacaaatccaagctctgtgctattcaacaagttacttgttttttctatagtatggtcatatctctctcacacaacattgctgtagtatctaaataagacaaagtagctaaagtgctggcacattgctgaggacgttctgggaatccaataaatgttagctactgatatggttgccaggtagcacctggagcaactgagtgtcctctatgacttcttgccacatatgctacctcattgctttccactatttttccttttctacttaagactgctactgggtcagacgcccacagaaactgccaagtctttatgttagcactttgtccaaagtgacttatgatcagtcctagagactagcaaaacacactattcattgaattatagttttttttaataagaaattgttatggtagaaaaattccagctctacctcttagctgctctgtaaccttctgtgaatcagttgacttctctgagcctcaatttgtttgtgaaatgtatctaaatcctttctaattagaagtcagttaaatttaaaggatttgatatatatatatatatatacattatatattttctgttattcataacccattatttgtagccaaaactttacctcttttctatcttaagcaacatattagaagctctctgtatttaatattcaatttaaaatattaatgggagcccaaattatgtaaaactaagatttcaatttccctcacatagaaatattaatatatttactatgaaacagaaaaggaaaaggtgctactgtttagaaaccaccttggcccccaaagtacaaaagatcagtactgcttaacaaaagaaccaggcagatcctatagttagaaatgacctggttagatgggacatatatttagttttttccccaagtcccataactagtggataataaaactaaaaaggtaaagtgcaggataaccaaaggagggtttggactggttcagactcaaaggttctaagatatcctaaaaccagcagacatattcacttaaatcaaaatttgtggcaatagtatctaacttctaccattgtgtttttattatgcacaaactattactctatacttacatatttcatgttcttatcaggtattataagggttaagagataaactaaaattgaatcaagtatatttactctccacctgcacatcacaactatcaagttagaggaataaaattaaaaagcaattcacaagtcatattacactgatgacatacatgtatatgtacacgcatttgcatatatttataatttgaagagaaagtttatatacttaacagccaacagatttagaaaaaactatttgtcctactgaataacagtatatatgaattatcagaattcttcattactagtattcaataatgagctttttatgcaataaatttacaaatcatttgcccctattttcagaaaaaattattaaagcaaccatgaatatttaaatcataagttctgtttttaaggagttcaaaacatttttacaagcatgttagtaatttagtgagaggaaattaaatatcttctagaaacatctagtaacttttaagctaatgtaatagaggaaatactacattatatgactttgtaaaaagtatttctaaaaaaatttaaagggggctgggcatggtggctcatgcctgtaatcccagcactttgggaggccgagatgagtggattgctttagtccaggagttcgacaccagcctgggcaacatagcgaaactccatctctacaaaacaaaaaattagctgggcatggtggtatgcgcctgtagtcccagctactagggaggctgaggtggcaggatcacttgagcccgggaggttaaggccatagtgagccgtgattgcaccactgcactccaaccagggcaacagagcaagaccctgtctcaaaaaatataaaaataaaataaagagactttgaaatcatatcacctaagtaattttttgacaattgaaatggtggtgggagcggggaggaagaacctaacatcaagacatccaccttgtggaaagatatggtaattacaggcctacatttattatacattggaagtaaagtcaaagtttttagctatgtacctacagtccttcaacaacaaattcaagctcagaaatgcaaaatcctaatcgtactattaaaactgctattactatatgcttccgatacccatttgtctagtttttttccagagacctttttctccatttttcatatgaaaacatctcagaagatattcgtaagcaagtgaacatatgaaactgaatatatgaaaaatattttcaaaaagtagatttctataaatcccatttgcttatttagctgcaaatttatttacagtgatgatactaggaacatactactagttcaaacaaaaaatgtttgttcgaatgaacaacagaaagtactggttagcagttccatagttctatgaaaatagagcagtatttttaaagtaataaaaattttcttaaaaaaccttttcaaagtttttaatctcaactgtaaatcttaaagatataaatggggaaattctaaaaattcagttttcttactaagcaatgggaggaaagaaatctggatatatggtacatatgacaataatttaatgtttcaagttgcagacatgttacatatgtgtattattcctttctaaatgcagtttattatcccttctcaaaaatacatacactgaatgtattactacaattcaggtgtgttccctaaaagactggtctataccaccagtccattctctgctttccagatagcctacttcttaattataatggtgacacctgatgtggcagaaagcacaatctccagaaccacctatcatcttgcttcaatttttacattccaagttagatttgtttgttgatattatttgctggtattttattttgctcaaaattctacttgtttattcatagcatatatgattcttccatactttaagttttaattagataagaaacttatacactaactgtatgtggtttaactgttaataggtggtaacagaatggttaaagaactaactccagcaactgtgaagctcaacactaggcactgaactcagagttggcagaatttgtcactgtagactacaaatttcatgttgaattaaatgctgtatgaaaaccactccatctattattcatttaaaggatctgctggccttttaagttggtgttggccatccataatactacgatttggtggcaatgagatcactacagtaatggctgtagaatttagtatttaggtttctgcctagctatactaacgtaaaatttcttctcttccatgtccttttccatgtgtacttctgggacagttaccaccttacagctctatttggttgaggacatgcggtaaacctacaccagggtgttagattacaatccaggtaagaaatttaagtcattagctacaatgatcatttatttttaatatgtttaaaatagaacaatcaagaattttagctatattaattaatatactcattagcctctgctatgcaaaattgatttaaatcactatttctgtgaaacagtaagataaactaaggaaaaattttataataaagaacagagagttctgatctataagatttcccttccgaacttgaagtctgcaaactacagcccacagaccaaatctggccagcccctgcccttttagtggccagtaagctaagaatggtttttatatatttaaatggttacaattgaaatgattataataagcaccgacgtgatactctgaaatttgccttctgggccacaaagcctacgacattttctgtatagcccctcaggacaaactttgctagatcttgctctgaacttaaaaaatttaaataaacatataatagaacattttagaaatgaattacacagaagtcaaatagctaaattgtttttaaataagcttaaaaccttttaacttcaaatctattccaaatttcaatactcatttataaacccaattgtctttgtatttgacttgtacaaaatgtacatcaaattaggtaaataaagcctcatcattattaaaggcaagtgtttcattagtgtgacttccactcctccaagttccttttatttaaaattgttgctatcacagcataagctaaaagtatattatctaaagctcaagatggtacaacatattgatgtcactcaacacacctgtattcctaaaatgttgttctcctgtagacgtcaattcagaatattttcatgcgcctttaaatagaaaaactaaagctaaccattacaaatacattgtcttaacaatgaagtctatgtacatttgatttgcctatatgattcctctaagggtccaatgaaatggaaatctgtatgattctgcatgacattaaaagcacacatatcctcatttttaagtagggagttcatctctgttttgaggtgggcattctggtgaaaactgaaaaacctgctagacatattctaaaagagctgtaacaccatggaagggttcatttattactcatttgtgtatctagacttgagctcagtgcatatcatataatagatgttcaaatggctggttaatactttatcaattacaatgaaaatgctgacaccatataggacttgaattttaggagacacattagttcgctttgaacttagtaaattcctacttaaaactgccgtattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaacaacaaaaaaaaaactgccgtattcattactttgttcattcacattgttgtaagcctacttttccagacactcttttagcttctgaaaattgtgatgaataagacatacaagtttcctaccacacagaatttacagaagtggagtttgtggaggcaaggcagaaataaagaaatttcagataccaaaaactgctatatgatagacagaaatagtaacattaattggatggtgagggaagtgctctctaaagaattaccacttaaatggacacgtgaaaaacagcaagagtttccaggaaaatggaatctcaaaaccaaagagttagaaaaaagtgagattgttcaagtaatgcttgaggcatactcaacaaggcggaaaggagtacaaaataagggtaaagggaggcagaggtcagctcatgtggggccttctagcccgtgatataaaggcttggttttaataagttttaataattcagatgaaaggcagattaataaaataaggcatttaaagtagtataattctgtggcatttagtacattcacaatgttatgtaactaccacctcacctctatctagctccaaaacatttcatcacaacataacttttaagcagtcactccccattcttcctttccctcatcccctggcaaccactaatctgctttctgtccctgtggatttacctattctgggcatttcatataaatgaaatcctaaaatatatgacctgtgtgtctcattctttcacttagaatgtttttgaggttcatccacattgtagcatgactatatactcctttccttttatagctgaataatattacactgtatggatatataccacattatgtttatttatcatcagttgacagctatttgggttgtttccaccttttgactattgtgaatagtattgctgtgaacattctcatccaagtgtttgttcaatctgttttcaattctgctatattttagatatctgtccctaccccaatctcatgttgaattgtaatacccagtgctggaggtggagcctggtgggatttgtctgggtcacgggagtggatccctcatggcttggtgctgtcttcacaatagtgagttctcacaagatctggtcatttaaaaatcagtggcatctgcccctgcaactcactctcttgcttgctcctgcttttgccatgtgacttgcctgctttctctttaccttccaccatgattgtaagcttcctgaggcctccctagaagccaaacaagtgccagcaccatgcttcctgtaaagcctgcagaactgtgagccaattaaatctcttttatttgtaaattacccagtctcagatatttctttgtatcaatgtaagaatggactaatacagaaagttggtactgaggagtgggacattgctataaaggtacctgaaaatgtggaagcaggtttggaactggttaagagattagaagagtgaggagggctcagaagaagaaagaaagataagggatccatatgaactttaaagtagttttttccaattctgtgaagaaagtcattggtagcttgatggggatggcactgaatctataaattaccttgggcagtatggccattttcatgatattgattcttcctacccatgagcatggaatgttcttccatttgtttgtatcctcttttatttcattgagcagtgatttgtagttctccttgaagaggtagttcatgtcccttgtaagttggattcctaggtattttattctttgaagcaattgtgaatgggagttcactcatgatttggctctctgtctgttattggtgtataagaatgcttgtgatttttgcacattgattttgtatcctgagactttgctgaagttgcctatcagcttaaggggattttgggctgagacaatggggttttctagatatacaatcatgtcatctgcaaacagggacaatttgacttcctcttttcctaactgaataccctttatttccttctcctgcctgattaccctggccagaacttccaacactatgttgaataggagtggtgagagagggcatccctgtctcgtgccagttttcaaagggaatgcttccagtttttgcccattcagtatgatattggctgtgggtttgtcatagatagctcttattattttgagatacgtcccatcaatacctaatttattgagagtttttagcatgaagcgttgctgaatcttatcaaaggccttttctgcatctattgagataatcatatggtttttgtcattcgttctgtttatatgctggattacgtttattgatttgcatatgttgaaccagccttgcatcccagggatgacgcccacttgaaaaagagcccgcattgccaagtcaatcctaagccaaaaaaacaaagctggaagcatcacgcctacctgacttcaaactatactacaaggctacagtaaccaaaacagcatggtactggtaccaaaacagagatatagaccaatggaacagaacagagccctcagaaataatgccacatatctacaaccatctgatctttgacaaacctgacaaaaacaagaaatggggaaacgattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggtaataccattcaggacataggcatgggcaaggactgcatgtctaaaacaccaaaagcaatggcaacagaagccaaaattgacaaatgggatctaattaaactaaagagcttctgcacagcaaaagaaactaccatcagagtgaacaggcaacctacagaatgggagaagatttttgcaatctacttatctgacaaagggctaatatccagaatctacaatgaactcaaacaaatttacaagaaaaaacaaccccatcaaaaagtgggcgaaggatatgaacagacccttctcaaaagaagacatttatgcagccaaaagacacatgaaaaaatgctcatcatcactggccatcagagaaatgcaaatcaaaaccacaatgagataccatctcacatcagttagaacggcgatcattaaaaagtcaggaaacaataggtgctggagaggatgtggagaaataggaacacttttacactgctggtgggactgtaaactagttcaaccattatggaagtcagtgtggtgattcctcagggatctagaactagaaataccatttgacccagtaatcccattattgggtatatacccaaaggattataaatcatgctgctataaagacacatgcacacatatgtttattgtggcactattcacaatagcaaagacttggaaccaagccaaatgtccaacaatgacagactggattaagaaaatgtggcacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacaatgagaacacatgggcacaggaaggggaacatcacacaccagggcctgttgtagggtaggggaagggggagggatagcattaggagatatacctaatgttaaatgacgagttaatgggtgcagcacaccaacatagcacatgtatacatatgtaactaacctgcacaatgtgcacatgtaccctaaaacaaagtataataataaaaaaaaaagataagggaaagcttgcagcttcttagagattggttaagcggttgtgaccacaatgctgatagtgatatggacagtgaagtctcggttgaagaggtctcagatggaaatgaggaacttacaaggagctggagcaaaggtcacacattttacgctggatgcattctgttcatgccttagggatctgtggaagtttgggcttgagaatgatgacctaaggtacctggtcgaagaaatttctaagcagcaaagtgttcaagaagtgacgtggctgcttctaacagcctatgctcccacgtgggaacaaagaaatgactcaacattggaaattatatttaaacagaaaatggagagtaaaagttttgaaaattcacagcctggctgtgtggcagagaaagaaaaagctattttgggagaggaattcaagcaggctgtggagcaaccacttactagagatagtggcataactaaaagggaaccaagtgctactatcaagacaatggggaaaaggccttgaaggcatttcagagaactttcattgcagcccctaccacaaggggcccagaggcctagggtggaagaatggtttgtaggccaggcccagggcccatatcctgtgcagcctcaggacactgct

SEQ ID NO: 537 - DNA, 51504 bp, Homo sapiens
agtggtgtgatctcagctcacctcaacctctgcctcctgggttcatgagattgtcctgcctcagcctcataagaagctgggattacaggcgcccaccaccacgcctggctaatttttgtatttttagtagagacggagtttcaccatgttggccaggctggtctcgaactcctgacctcatgatctgcccgccttagcctcccaaagtgctgggattacaaagacatgagccaccgtgcctggcaaggacagggattttcttctgttgtgtgttcatagctgtatgcgcagggctccgcatgttgctggtgctatataactatttgttgagttaattaattaaaaagtgctatgcggagaataaagatgttatggagagtggatgtttgtgtgcagctgttgcataagcaagggtgagggaaaggctttgatgtgtgttcttctccttcgtttttttttagatagagtcttgctctgttgcccaggctggagtgcagtggtgcaatctcagctcactgcaacctccatctcccaggttccagcaattctcctgcctcagcctcacgaggaattgggattacaggtgctcaccaccatgcccagctaattttttgtgtatttttagtagagacggggtctcaccatattggacaggctggtcttgaactcctgatgagtgatccacccgccttggcatcccaaagtgctgggattacaggtgtgagccaccgtgaccaacccttctccttccttttttttttctttttttttttttgagacggagtctcgctctattgcccaggctggagtgcagtgatgcaatctcggctcactgcaacctccgcctcccgggttcacgccattctcctgcctcagcctcccaagtagctgggactacaggagcccgccaccgcgcccagctaattttttgtatttttagtagagacggggtttcaccgcgttagccaagatggtctcgatctcctgacctcgtgatccgccggcctcggcctcccaaagtgctgggattacaggcatgaggtgccgcgcccggccaaaggctcaactttttaaagaaaaaaggacgaatcaagagaggcggtgattacaaaagttgttcatcaggaattgtcattggtttacagacatcacattgattagtgattggctatacatgtttgaactatagagtgtgtgacactctagagctacttggtatcaggtcgtctagagtccagaaaccaagtagcctcaaaaggtaattattggatgggtgcagtagctcatgcctgtaatcccagcttgaggcaaggagttcgagaccagcctgagcagcatagaaagaccctgtctctacaaaaaagttaaaaattagtcagtcatagtggtgcacccctgtggtcccagctgctcaggaggctgatacaagaggatcacttgagcccaggggttcgaggctgctgtgagctatgatggtactccagcctgggcaacagagtgagtccctgtctcaaaaagtaattaaaatacatttttataaagtccctctgagccaggtgcggtggctcacacctgtaatcccaggagtttgaaaggctgaggcaggagaatcacttgagcccaagagtttgagaccagcctggacaacatagtgaaaccccacctctattaaaaaataaaaaggccaggcacagtggctcatgcctgtaatcccagcactttgggaggctgaggtgggtggatcacggggtcaggagttcaagaccagcctggccaacatggtgaaacctcgtctctactaaaaatacaaaaaaattagccaggcgtggtggtgagtgcctataatcccagccactagggaggctgaggcagagaattgcttaaacctgggaggcagaggttgcagtgagccgagattgtgccactgtactccagcctgggtgacagagtaagactctgtctcaaaaaataaattaattaatttttaaaaaagttgttaaaaagcccctctgggcctgatcctgatcatctaaaggggctctcctttctcagataaaaaagtttgttttctttctcattccctccccagctctcccccaattcttgtttaagacaaggactcgctctgttgcccaggctggagtgcagtggcacaatcacggctcactgcagcctccagctcccaggttgaagtgatcctctcacctcagcctcccgtgtagctgggattacaggagcaccaccatactcagctaattttttttttttttctgagaaagagtttcactctgtcacccaggctggagtgtagtggcacaatctcagctcactgcaacctccacctcccaggttcaagcaattctaccgcctcagcctcttgagtagctgggattacaggcacctgccaccacgcacagctaatttttgtatttttagtagagatggggtttcaccatgttggactcctgacctcaagtgatctgtccgccttggcctcccaaagtgccaggattacaggcatgagctaccaggcctggcttttttttttttttttttttttgtgagacggagtttccgctcttattgcccaggctggagtgcaatggcacgatctcagctcactgcaacctctgcctcccaggttcaagtgattctcctgcctcagcctcctgagtagctgggattataggcatgtgccaccacacccggctaattttgtatttttaatagagatggggtttctccatgttggtcaggctggtctcaaactcccgacctcaggtgatccgcctgcctcggcctcccaaagtgctgggattacaggcgtaagccaccatgcctggactccatgctctttttaaaaattaattaatgaattattttttttttgagacaaggtctcactctgtcacctaggctggagtgcagttgcacgatctcagctcactgcaacctccgcctcctgggctcaagctgtgataccctaaccttgttttaacctgaattgactctcccttaggtgagcgagccagacagactccatcctggctccttcacttgcagccccttaacccaacccccctttcttcaaggacttaacttgtgcaagctgactcccagcacatcaaagaatgcaattactgataagatactgtggcaagttatatccgcagttcccaggcagtcgcccgattaatagtaccctaagcccccgcgtttctgtctggttgatagcgcccaacgtccagcgtctatcaccttgggatgtgtttaaagcccctgcacctggaactgtctgctttcctgtaaccatttatctttctaactttttttgcctgctttacttctgtaagattgttttaactagactcccccctcccctttctaaaccaaagtataaaagaaaatctagccccttcttcggggccgagagaattttgagcgctagccgtctctgggctgccggctaataaaggactcctgatcttgtctcagagtgtggcgtttctctataactcgctcggttacaacaaagcaatcctcccgcctcagcctcccaagtacctgaggcgcaccaccatgctcaggtaatttccgtattttttgtagagacgagggtttcactatgttgcccaggctagtctcgaattcctgggcttaagggatcctcttgcctcggcctcccaaagtgctgggattacagctgtgagctactggacctggcctatttatttatttatttatttatttatttatttttgagacagcatcttgcaatgttgcccaggctgtatgcagtggtgtgtacatagctcatggcagccttgacttcctgggctcaaacgatcctcccacctcagccacctgagtagctgggactacaagggcaccactacgcctaattttttaaactttttgtagagatggggggtttcgctgtattgccccagctgtcttgaactcctgacctcaagtgaacctcccacaaggacctcccaaagcactgggattaaaggtgtgagccactgtgtctggccccaatatgttcttaacatcccctcctaccaccaccagtctggaaggttctagaaggttcctaagactgggctatgtagctacaaaggtagatttgctggatgtagagattcgcagtcatttatcttccttttggaataaggagattaaactaaataacagaaaatagatggccaggcgtggtgactcaagtctgtaatcccagcactttggaaggccaaggcaggcagatcacttgcagtcagaagcatagctaccaaaaattatgaaatttagctggttttgtggcccgcacctgtaatcccagttactcaggaggctgaggcacgagaatcgcttgaacccaggaggtggaggttgcagtgagctgagatcacaccactgtcctccagcctgggcgacagagagagaccctgtctccaacaaacaaacaaataaaaagaacggaaaacattttgctcttagacaaaatgcatcacacaatccacctatcaggaggctgctcgggcctggcggcagggtcgccagccctcaccttggtcaaggtgtacgtccccagtaggttcagctccagcagctggcggaatccctgggcagaggtctcctcaggcctctgtgggggtgggtctaaagtggggggtgagagagagaggaaaagtgacgggggctggacacagttgcccacgcctgtaatcccagcactttgggaggctgaggcaggcggatcatgaggtcaggagttcaagaccaacctggctgacagggcaaaaccctgtctctacgaaaaatacaaaaattagctgggtgtggtggcgggtgcctatattcccagctactcaggaggctgaggcaggagaattgcttgaacctgggaggtgcaggttgcagtgagcctagatcgagccactgcactccagcctgggcgacagagtgagaccccatctcagaaaaaaaaaaaaaaaaaaagccgggtgcagtggctcatgcctgtaatcccagcatttggggaggccgaggtgggcagatcatctgaggtcaggagttcaagaccagcctggctaacatgatgaaccccatctctactaaaaatataaaaattagcctggcgtgctggtgggcgcctgtaatcccagctacttgggaggctgaggcaggagaatcgcttgaacccaagaggcagaggttgcagtgagctgagatcacaccactgcactccagcctggacgacagagtgcgactccatctgaaaaaaaaagaaaagaaagaagagaagagaagaaaaaagaaaagaaaagaagagagacatggccaagtgagggcacagccctggggacacacaggagggatggaacagggccacagtttcagcacaggcctggggggcttccattgctttactctcctgtccaagtggctagaaagaggtatgaggcaggatgagggaatcaggggcagggagtggggaaactgacgtgcaggaaacagagttggggggcaggaggtggagaatggccctggggtctcacaactcacggtggccagcgttgttgacaacacaatccaggcggccaaatcggcggatggtctcagaaaccagggtctgaggagaaaggaaatgtcctttgttttttttttttggagacggtgtctccctcttgtcactcaggctggagtgcattggcacgatcttggctcactgcaacttcagcctcctgcgttcaagcaactctcctacctcagcctcccaagtagctgggattacaggcgactgccaccacgcccggctaatttttgtactttttagtagagacagggattcactaggttagccaggctggtctcaaactcctgagctcaagtgatccacccgcctcagcctcccaaagtgctggaattacaggtaccacgcccagcccaggaaatgtcctttgaatgagcagtagatggggtgtccagccataaagaagacagggctcccaaatgcaaggcaggagggggaagctgaactcccaggtcaggggacaagagctagaggaagaggggactccgagatcagcagacacagcaggcaagcaggagacaggaaggagacagggggctggtcagagccacactgcagtcgtcacacccagggtcagggggtggggcaggggggtgacaaggattcagagagcgcgtaggggacagttgcccaaggggggcagataacagagagatactgattaaaaggaagaaataggaacccagaaataatggagaaaaaatcagttacatacaggccacgtgcagtggctcacacctgtaatcccaacactttgggaggctgaggtgggcggatcacctgaggtcaggagttcgagaccagcctggccaacatggtgaaaccctgtctctactaaaactacaaaaattagccagacacggtggctcatgcttgtaatcccagcactttgggaggctgaggcgggcggatcatctgaggttgggagttcgagaccagcctgaccaacatggagaaacaccgtctctactaaaaatacaaaattagccaggtgtggtggcacatgcctgaaatctcagctactcgggaggctgagagaggagaatcacttgaagctgggaggcagaggttgcggtgagccgagatcacaccattgcactccagcctgggcaacaggagcgaaactctgtcttaaaaaaaaaaaaaattagccgggcatggtggcgcacacctgtaatcccagctactcgggaggctgagataggagaatggcttgaactcggtaggctgaggttgcagtgagccgagatcacaccactgcactccagcctcagtgacacttacaaaaaaaagagacagaaaaatcagttccagttgacccactttgagggacttattcatttccatccacatgttaaatgtgctaagagccttggagaggtgtgacagaaggaacatgtgacctgcccatcagtcacagaagaccttgtgtgtggagtgacactgggtggaaacctttgacgagtccagcggagccaggagaggaaggaaaagtagagggaaaggcatatgcaaatggctggaggagaacaaagaactggtcattagcggagatgggggtaggaacaggaactcggcttaccttcacatcatcttcctgagtcacatcacagaggataaagacagctccagggagctcctgctccagggcccggcccccagactctgcagggagagaagagctgggagcctggacccctgggtctcagggaggaggggttggggacttggactcctgggtctgagggaggaggtgctgggggcctggactcctgggtctgagggaggaggggctgaggtctggactcctgggtctgaggaagtagggcctgggggcctggactcctgggtctgagggaggaagggctgggagcctggactcctgggtccgaggaagtagggcctgggggcctggactcctgggtctgagggaggaagggctgggagcctggactcctgggtccgaggaagtagggcctgggggcctggactcctgggtctgagggaggaagggctgggagcctggactcctgggtctgagggaggaggggctgggagcctggactcctgggtctgagggaggaggggctgggagcctggactcctgggtctgagggaggaggggctgggggcctggactcctgggtctgagggaggaggggctgaggtctggactcctgggtccgaggaagtagggcctgggggcctggactcctgggtctgagggaggaagggctgggagcctggactcctgggtctgagggaggaggggctgggggcctggactcctgggtctgagggaggaggggctgaggtctggactcctgggtccgaggaagtagggcctgggggcctggactcctgggtctgagggaggaggtgctgggagcctggactcctgggtctgagggaggaggggctgggggcctggactcctgggtctgagggaggaggggctgaggtctggactcctgggtccgaggaagtagggcctgggggcctggactcctgggtctgagggaggaggtgctgggagcctggactcctgggtctgagggaggaggggctgggggcctggactcctgggtctgagggaggaggggatgggggcctggactcctgggtctgagggaggaggggctgggagcctggactcctgggtctgagggaggaggggctgaggtctggactcctgggtctgagaaagtagggcctgggggcctggactcctgggtctgagggaggaggtgccagagcctggactcctgggtctgagggaagaggggctgggagcctggacccctgggtctgaaggaggaggggttggggacttggattcctgggtctgagggaggaggtgccggagcctggacttctgggtctgagggaggaggggctggggacctggactcctgggtctgagggcagaggggctgggggcctggactcctaggtctgagggaggaggggctgaggtctggactcctgggtctgaggaagtagggcctgggggcctggactccggggtctgagggaggaggtgctaggggtctggacctctgggtctgagggaggaagggccaaggtgagggctgagggaccgtcactcaccatccttgtcgcagataaccactcgggccccgctgttcactgagaataggaagggaacaggttactctccgagccttggttaaagcctctgccgccctcttgtggccacctggattggggctgatctccctctcccctcgtgaccccagtctcatgatcacccataggacagagggcagacgccttgacacatactctccttgccttgtttctgctgaggctcctgaacccccgttcgtggcttccggagcaaactccacgactgacagagccattcctcaaaccactggttttgtagctacaccaacagacccagagaaaggggccactgccttcggagaccctgccagactcagccctagcctacagcgccacacgcttactttagcctgcaaattggcttttataatatcagaatcctggctgcagtactggagtccctattttccgcccccatcaccccgcccccatccttcctttctcacactccacagctcccagcagtcagacccggctcaccgaaggcgcgcacgatcccagctccgatgccgcgcccgcccccggtcacgaccaccaccttcccggcatagcgcgttcccgtagccatcccgtgtacgtcggtctctctctctctctactctgggcctctttcacctccaaagccccgtgaggccgtcgcatcaaatcctcaatagaggctggatcctggaagtccggcctcggggggcgttgccaggaaggctagagacctggaagtttgtccccagcccctcctccctcagacactcctctcttcccacagacccaggaatccaggagccccagtccctcctcccacagacccaggaatccagaagcctcagtccctcctccctcagactcgggagtccaggcccccagcccctcctccctcagactcgggagtccagcctcccagcccctcctccctcagacccgggagtccagcctcccagcccctcctccctcagacccaggagtcagggtcccagcccctcctccctcagacccgggagtccagcctcccagtccctcctccctcagacccaggagtcagggtcccaccccttcctccctcagacccgggaatcctggcccagccccctccactctcagaccgagggatcaggttctctatcccttcttcccagagacctataagtccaagccccctgtcccttcctctctcaggacccaggagtccacgactccagctctgcccctcagagacaccagtgccacaaccccagacagacagaaagaaagctattgactaaaagttcaaagttttaatccaaatttagacagtgttgagaaaaccaaactttggccatagaaaccattcccctcccgggcccgcaatggggaccagaccacgccccctgatgccctgagtggtcccagatctccggcggtacctccagaccacgtcctcgcgctccgattggctgccgcttttgggcggattagaagctggattgtagcagagtgactcgcagaggccatgccccctcgtcttgtggcaggaccggaggggcgatcccggcatcccacgcgggcccccagggggtgggacctcctccacgcccactccctcggcgagagaaccccgtggaacccgaattagccaccgggggagatctggggggaggggtctcctggcgcgtggggtccgaaggaggcagcggcacaccgggaagagggtctccctgggagtccaaatttccacctggagaggatgagtgggacatgagaatggcaaacctcagcgctaggaccccggattcccagcccctcctccctcagacccaggactccggattcccagcccctcctccatcagacccaggagtccaggcccccagcccctcctccctcagacccaggagtccaggcccccagcccctcctccctcagatccaggagtctggatacgccagtccagtcctctttgagactcagttgtcggccctctccccgccccctgacctcttcctcccctcctcccaagtgtcccggaccccagtcacctcttgcctgagacctaaaactcccaaaccctgcccaactctttactcaccaagataaaaaattctcaccggcccccagacccctcctctccaggacctgggattccaggtctccagctctctcctccctaaaacccagaagtccaacatccccagccagtcacctgtcatcattctgtgccactgcgacgcctcagtagccagggcttgggagaggctgagaacccgctcccggtgaccttcggaagtcggcaagtaaggggtggtgttccttggactagaaaaaaaaagaagattgggggtgggggtgtgtacatgggggagaggtgggggatggttaattggtacaaaaagaaaaggatgaataagacctactattagatagcacaacagaatgactatagtcaataataatttaattgtacatttttaaataaattaaagggtgtaactagattgtttatacatcaaagggtaaatccttgaaaggggatggataccctattcccgatgatgtgcttatttcacattgcctgcctgtatcaaaacatctcaattatctcgtaaatatatgtatacctagtatgtaccaacaaaaattaaaaattaaaaaaaaaaaaaaaaaagcaggccaggtgcgacagcttatccctgtaatcccagcaccttgggaggccgaggcgggcggatcacttgaggtcaggagttcgagaccaccctggccaacatggtgaaacccagtctctaccaaaaaatacaaaaaagttagccaggcatggtggtgggtgcctgtaattccagctactagggaggctgaggaaggagaatcatttgaacccagaaggcggaggttgcagtgaactgagatcacgccattgcactccagcctgggagacagagcaagactccgtctcaaaaaaaaaaaaaaagtaaaaaataaaaataaaaataaaaaataaacagctggcacagtggggacccgggtaccgcacgtgcctttctgggagttgtagttcctagcacgtgtctctaaaatacgttaaacatggcaccgccctcataccgcccacatgcattacgggatttgtagtccactcgcgcgtcactatcacccaatttccttgatgcagaagtaggatctgctattgaccaagggaatttgaggaactaaagatatcactacggatctagggctttctggttttgttgcagatgccccgggaacttaagcatctctagaagggttgcgatttgtacttccatattcaggagactttaataataatgctactcccctttgcttttgcaaatttttttttcctgctcccttgatacgccctccagttccttacctactccaggacccagagcttctgagccatttctgggctcccgagtgtcctacgacaggctggaaaggaattggggcattagaactcctcacctggaagccccacgttctcattttgagggtgaagtgaagggggctccaaaagagaatgaaattgcccaaaaacactggcaatgttttgttttgtttttcctatgcttctgtaggcactgaatttttaaaaattaatttattttatttattcattttttagaaaggatggagtacagtggtgtgatcataactcactgtagtctcgacttcccaggcttggactaatcctgcttcagcctcctgagtaaatagaactacaggctcgcaccaccatgcctggctaattatttttatttttatttttagtagagacagagtcttgctatgttgcccaggctggtctcttactcctgcctcggcctcccaaagtactggtattacaggggtgagccatagcacccagtgactgacaatgtttaactttacctgtgttcctataaagcagcacatgagttcagaaatcccacctccaccaccaccacctgtgacttgtctaaatcctttctataaaagtctaaggggccgggtctggtggctcacacctgtaatcccagcactttgggaggccgaggtgagcagatcacttgaggtcaggagtttaagaacagcctggtcaatatggtgtaaaccccgtctctactaaaaatacaaaaaaaaaaaaattagcagggtgtggtggcatgggcctgtaatcccagccacttgggaggctaaggcaggagaatcgtttgaacctgggagacaggggtcgcagtgagtcgagattccaccactatactccatcatgggcaacaaagggagactctgtctcaaaaaaagaaaaaaaaaatctaaggggaggttaggtgcagtagctcacacctatattcttagcacctccttccaaggcaggaggatcacttgagctcaggagctcgacaccagcctggccaacgtggtaaaaatctgtctctactaaaaatacaaaaattggctggatgtagtggcatatccctgtagtcctagctactcgggaggctgaggcatgaaaatcacttgaacccaggaggtggaggttgcagtgagtggagatcgcaccactgcactctagcctgggcgaccttgtccctgaaaaaaaaagaaaacatcttttttttttttttttttgagacagagtttcactcttgttgctcaagctggagtgcaatggcaaaatcttagctcaccacaacctccacctcctgggttcaagcgattctcctgcctcagcctcccaaggagctgggattacagacatgtgctaccatgcccagctaattttctatttttagtagagacggggtttctccatgttggtcaggctggtcttgaactcccgacctcaggtgatccgccctccttggcctcccaaattgctgggattacaggcgtgagccaccatgcccggccgaaaaaggaaaacgtctaaggggaaaccatcctgagatatctgagacactctgatgttcagatctgggacgttcttcctattgaaagggcatgaataaaatcaattttcttcctggcttacattttcttttttgctttcttgctattgacaacacatagcaactgagaagaaaaactaggcttccaatccagatgtgtgacccccgcccccacccactgtcctcccctcactgccactcctgtccacccaccactatccaggcgaggaagctgactctagcacaagtacaaactggggtaaattcggaaatccagtttggaggaaggaggtagtgattatctccattttacagaaagggactcaaagtaggcgaagaggacctactaccaccccaccgcccagccccagccctcctcccctcaccctttgctccacgtcaggctggcgtctggctggggacagtgtccttcccagggtgagaagccggggggaggtcgggcgagggaagggccgtccacattcctggtttctgcgcatccgctccagctgctcctgggcactcatccggggccgggccaccggggcctagggaggcgagaaacgtcccaagacccaacctttaggccaggcacagtggctcgtgtaatcccagcacttttgggaggctgagtagagaggatcacttgaggtcaggagttgaagaccagcctggccaacttggcgaaataccatctctactaaaaatacaaaaattagctgggcgtggtggcaggcacctgtaatcctaattactcaggaggctgaggcaggagaattgtttgaaccccagaggtggaggttgcagtgagccgagatcacgccactgcactccagctgcacaacagagcaagactctgtctcaaatatatatatatatatatgttgcttaaacaaggagagagggagaaggccgggtgcagtggtgggtgactgtaatcccagagctttgggaggctgaggtgggaggatcacttgcggccaagagtttgagaccagcctgggcaacatagcaagaccccatctctacaaaaaataaacttgttagatgtggtggtggatgcctgtcagctactcaagaggctgaggcagggggatcacttaagcccaggagttcaaggcttcagggagctatgatcgtgccactgcacctcactctgggtgacagggcaagatcccgtatctaaaagtaaaaagtaaagacagagagagcactcattgctgaagcttccagttaaacatcccagtgagatagcatggatctgtgcttattgtagaaccagtccctgcagtttcctctgctttgaccaatcctgagtcctgtttatataaatgatggccagtggccactgtatattaccctatgttgttaatttattttctttttttttttttttttttgagacagagtctcgctttgtcacctaggctggagtgcagtggcgcaatctctgctcactgcaacctccgcctcctgggttcaagcacttctctgcctcggcctctcaagtagctgggattgagtaggtggcacccgccaccacgcccagctaatttttttgtatttttagtacagacagggtttcaccatcttggccaggctggtcttgaactcctgatctcgtgatccacctgcctcggcctcccaaagtgctgggattacaggcgtgagccaccgcgcccagccaatgttgttaatttcttcacagcaggccagaccattggcctaaaagcttggtagcagcacactcagatttctacacatccaattgttttaaacatagtcttaataagcaggtatttttagctatgcagtctgcctgctttgtataccctgaaactgtgcccaacatctgctacccatagataagatgagccccaagcccctgctgctctttggacctctctgatccagagaaacctccacatgctggtggctggcatcacccagaagtaagccccttctccagtccctttctcttgggagctcccttgccttcctcccttcctgtgcagtggtcctcaccctcacacagtaacctctggagggtctcacactgggtgtgactcccccatagacaaatctgtcagtgtccaccaaataaagctcctgtgtgctactgccatctggtggtcatagctttttctttgctaaaccctgaaatccctggaactcactagaccacccctgtgctctggaccttggcagcccctgaaaccacccggttggggtgagggaggagcatgtcccaagataagtgatgttcccagcaggctccaatcatccatgcccatgacacaccactgagaatcaaaaagtgcctctcctctcttcctaggaaaggctcgattgcttttgtatccatgataacaagtaagcacaagaaatgccttcttttttttaaattattttattttattttattttatttttgagatggagtttcactcttattgcccaggctggagtgcaatggcacgatcttggctcactgcaacctctgcctcccaggttcaagcgattctcctgcctcagcctcccgagtagctgggattacaggcatgtgccaccacgcctggctaatttttttgtatttttagtagagacggggttacactatgttggtcaggctggtttcgaactcctgaccttgtgatccgcctaccttggcctcccaaagtgctgggattacaggcgttagccaccgcacgcggtcttttttcttttttttttttaaagacatggtttccctctgttgcccaggatggagtgcagtggtgcaatcatggctcagtgcaggcttgacctcctggactcaagcaatcctcacgtctcaacctcccaagcagctgggaccacaggtgggcaccaccacgcacagctaactttttattttttatttttttattttttgagatggagtcttgctctgtcacccaggctggagtgcagtggcgcagtatcagctcactgcaatctcagccacccaggttcaagcgattctcctgtctcagcctcctaagtagctgggattacaggtgcgtgctgctacacccggctaatttttgtatttttagtagagatgggtttttgccacgttggccagggtgctcttgaactcctgacctcaggtgatccacccgcctcggcatcccaaagtgctgggattacaggtgtgagccactgcacctggccacagctaactttttattatttttttgtagagatgggtcttgctacgttagccaggctgctcttgaacgcctggactcaactgatccacctaccttggcctctcaaagtgttgggattacaggcatgagccaataccactggccaagaaatgccttatttattttattattattattattattattattattattattattattattattattttcgagacagagtctcgctctgttgcccaggctggagtgcaacggtgcaatcttgggtctttgccacctctgcctcctgggttcaagcgattctcctgcctcagcctcccaagtagctgggattacaggcacccgccatcacgctcggataatttttgtatttttgtagagacagggttttcaccatgttggtcaatctggtctcaaactcctgacctcaagtgatctgcctgcctcggcctcccaaagtgctgggattacaggtacgagccacggttcccagccccaagaagtgcttttaaatctatttgatcaagtaatcccaacaggtaccccaaagacttctgaaagccagccaatcagtgatggagccaagcttctgaaaatcagccaatcagtgatggtcacatgcttctgagggctggccaatcagtgatggatccgtacttctgaaaatcagccaatcattgatagctccatgcttctgaaaaccagccaatcagcaacagacacagagcacagagcttccacagcttaaagtcaaccaattcctaaacattcctgccactagaagtcaaccagtttctgaactccagggccacatgagatcagcattctgctccactcagggtgtctttttttttttttttttttttttttttgagacagatttttgctcttgtcgcacaagctggagtgcaatggtgtgatctcagctcactgcaacctctgcctcccgagttcaagcgattctcctgcctcagcctcccgagtggctgggattacaggcgcccaccaccacgcctggctaatttttgtacttttagtagagacggggtttcaccatgttagccaggctggtctggaactcctgacaaagtgctgggattacaggcgtgagccaccgcgcctggcctcattcatctagttttcatcttgatgtcagctctaggtggtaggttctgctattagccccattttagagaagaaaaaatgaaggcacagagaggtttaataactgacccaaagtcacacagcttagaagcgacagagacaaaaatcaatctcaatgctcttaacaagcagtgctctctctgctctgagtatggccttagaacgctctactcctagctgtttcccagaagtgtgggggtccctgatggtcagatgcaaggattacaggatggacctacagcttaccttggttcctagctgtggggaagggaggtggcgaccctcagggctggaagcccgggagaccctcggagacccaagacctggaaagacagaacgggacttggtgaggacgggaatttccgtaaagtcccacccaaccaggatgctcacctaagtgagggctggcgaggtctttgtcgcctccaggaggccgcccccagtcagtctcgggggacctaggggagctcagttccaaggactctggcaggctctgcggggattagaaaagggggataatgatgatcattataataattattattattaccatgttgcaagcatttaggcattggaatacagtctgaataggattcagaccataaaccaggccgggcgcagtggctcacacctgtaatcccagcgctttgggaggccgaggcaggcagaccacctgaggagttccagaccagcttagtccaacgtagtgaaaacccgtctctactaaaaatacaaaaattagctgggcgtggtggcaggcgcctgtaatcccagctacttaggaggctgaggcagaagaatcgcttgaactcgggagttggaggttgcagtgagccgagatcgcaccactgcactccagcctgggcggcagagcaagactctgcctcaaaaaaaaaaaaaaaaaagactataaaccagatctgagcatggaggcttgtgcttgtaatctcagccctttgagaggccaaggtaggaggctcacttgaggccaggagctagacaccagctgggcaacatagcaagaccccttcccttaaaaactttttaaggctgggcgcggtggctcatgcctgtaatcccagtactttgggaggccgaggcaggcggatcacaaggtcaggagaccatcctggctaaaacggtgaaaccccgtctctactaaaaatacaaaaaaaaaattagccgggcgtggtggcaggtgcctgtagtcccagctactcgggaggctgaggcaggagaatggtgtgaacccgggaggtagagcttgcagtgagccaagatcgagccacttgcactccagcctgagcaacagagagagactccatctcaaaaaacaaagcaaaacaaaacaaacgttttaggctgggcacagtgggttcacgtctgtaatcccagcattttaggaggccgagatgggaggatcacttgagaccaggaggtcaagaccagcctaggcaacatagggagaccccgtctctacaaaaaagttaaagaattcgccgggcatggtggcagacacctgtagtcctagctacttgggaagctgaggtgagagaatcacttaagccccagagatggaggttccagtgagctgtgatggcaccactgcactccagcctgggtgacagagcaagaccctgtctccaaaaaaacaaaaaaactgtaaaccaggagccagatgtcctggcttcaaatcccaactgtgccatttattagctgtgtgaccttcggcaagctgctttacctctctgagccatattttattttatttgagacacagtctcgctctttcagccaggctggagtacagtggtgcaatcttggttcagcttactgcaacctctgcctccctggttcaagcgattctcctgcctcagtctcccaagtagctgggattacaggtgtgcaccactgtgcctggctcattaacattttactttttgatattaggattgagtccatatatatgtggcacttagaacagtgcctggtgtctaagtgcattatatatataatcatattagggctgggtgcggtgcctcactcctgtaatcctggcgttttggaatactgagactggaggatcattttaagccaggagtttaagaccagacttggcagcaaagtgaggttccatctccacaataaacaaacaaccaaaaattagccaggcatgatggcacgagcctgcggtcccagctactcaggaagctgaagcaggaggattgcttgagcccaagaattcgaggctgcagtgagccatgatcacaccactgcagtccagcctgggcgacagaatgagatcccatcttaaaaaaaaaatcctggttgggcgaggtggctcacgcctgtaatcccaacactttgggaggccgaggcaggcggattactcaaggccaggagtacatgaccagcctggccaacaaggtgaaactccgtttctactaaaaatacaaaacttagccaggcttggttgtgggcacctgtaatcacagctacttcggaggctgaggcaggagaaccacttgaacccaggaggtggaggttgcagtgagccaagattgcaccactggactccagcctggatgacagagtgagactacgtctcaaaaaaacccccgaaaaaaaagaaaacaaaggcttccagaggttaggacacttgtaccaggtgggttagctgatcaaggaagaattaaagaggtgggtggggaatagactgagtcaaggacaggtgggacatgaagcttggggtggggaggaattatgtgcgtcttacctccctctctgaggactcctcgccctggagcacgggagatggggagtcaggctcagtgtgtgggggcggtttctgggggccacccagacctgccagcgtgtcttccaccatccacagctgctgctgagcagacactctgtcctgcagggaggaaaggaatttgttacttaaaggtgggaaaacgcaggagggtttcagctaataggcccctgcaaaggtctgaaatcagctgggctatatttatggagttgggatttattttttttcccatgtggttatccagttgaattgaaaaaaactgtcttggctgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaactgtcttttggccaggcgtggtggctcacacctgtaatcccagcattttgggaagccgaggcgggtggatcaccagaggtcagaagttcaagaccagcctggccaacatggtgaaccctcgtgtctactaaaaatacaaaaaaaaattagccgggggtggtggtgcatgcctgtgatcccagccactcgggaggctgaggcaggagaattgcttgaacccaggaggtggaggttgcagtgagctgagatcgtgccactgcactccagcctgtgcaacagagcgagacactgtctcaaaaaaaaaaaaaagaaaaagaaaaaactgtcttttctttctatgttgttttactgtgttacatctattataaataggtgaccatacgaatatgagagtctgttctttttgtttgtttttggagacagtccctccctctgtcacccaggctggcgtgcaatggcttgatcatagctcactgcatcctcgaactcttgggcttaagcgatccttccacctcagcctcctgagtaactgggaccacaggcgtgcacaaccaggcccagctaattttttcacttttatttttagtagagacagagtttcaccatgttgcccaggctagcctcaaactcctgggctcaggtgatccacctgcctcatcctcctaaagtgctgggattacaggtgtgagccactgcagctggcatgggtctgttcttgccaagtctggattgtagatctagtgggagcagcttagagtgagaagatgcatttaaaactaggcatcaatggttttttgttttttggggttgttgttgttgttttttaagatggagtctctccctatcacccaggctggagtgcagtgtcacgatctcggctcactgcaacctccgcctcccgggttcaagcgattctcctgcctcagcctcctgagtagctgggactacaggcgtgcaccagcacacccagcaaatttttctatttttagtagagacagggtttcaccatgttcgtcagattggtctccaactcctgacctcaagtgatccacctgccttggcctcccaaagtgctgggactacaggcgtgagccaacacgcccggccgtgtcaatgtttttaaagatacatgatttagaacttgatggctagatttagagtgaaaaagcaggtctgaggctaagcaatgaggtttatattttaggagcagagcttgcactaaaggaatgggttcagaactggaactccagaggataaatttaacagcaaaagtcaggatgcaggatgcaagagatgaacttgcaagatggaaaaaaggctgagggttggagttttgctggtgagagcatggcttcaacaagaggagagatttagaaccaggggagagagcagctctggatctgaagtaggtattaaaacgaaaggcattggccgggcgcagtagctcatgcctataatcccagcactttgggaggccgaggcaggcggatcagaaggtcaggagttcaagaccaccctaatcaacatggtgaaaccccgtctctactaaaaatacaaaaattagccaggcgtggtggcacacgcctgtagtcccagctagaggctgaggcaggagaatcacttgaacccgggaggcagaggttgcagtgagccgagatcacaccactgcactccagcctgggcaacagagcaagactccatctcataaataaataagagggcggccaggcgccgtgactcacgcctgtaatcccagcactttgggaggccgaggcgggtggatcatgaggtcaagagatctagaccatcctggccaacatggtgaaaccccatctctactaaaaatacaaaaattagctgggcatggtggcacacacctgtagtctcagctactggggaagctgcggcaggagaattgcttgagcctgggaggtggaggttgcagtgagtcgagattgtgccactgcactccagcctggcgacagagcaagactatgtctcacacacacaaaaaaagaaaataaaaaatagaagggctgtgtgcggtggctcacgcctgtaatctcagcactttgggaagctgaggcgggtggatcacctgaggtcaggagttcaagaccagccggaccaacatggagaaaccccgtctctcataaaactacaaaattagccagacatggtggtgcatgcctgtaatcccagctactcgggaggctgaggcaggagaattgcttgaacctgggaggcggatgttgcggtgaaccgagattgcaccattgcactccggtctgggcaacagaacgagactctatctcaaaaaatataataaaataaataaaataaaaataaaagagtaggccaggcacagtggctcacaccggtaatcccagaactttgggaggccgaggtgggtggatcacctgaggtcaggagttcgagaccagcctgaccaacatggtgaaacccccctctctaccgaaaatagaaaaattaaccgggcatggtggtggtcatctgtaatcccaggtacttgggaggctgagggaggagaatcgtttgaacctgggaggcggaggttgcagtgagccaagattgtgctactgcactccagcctgggcaataaagcgagactgtctcaaaaataaaaataaaaaataaaagagtataatggattgtttgtaacacaaaagataaatgcttgaggggatggacaccccattttccatgatgggattattatacattgcatgcctgtaccaaaatatcttatgcacttcataaatatattcatctgctatgtacccacaatacattttttaaaaagaatgttgtaggccgggcgcagtggctcacgcctgtaatcccagcactttgggaggccgaggcaggcagatcacctgaggtcgggaattcaagaccagcctgaccaacatagagaaaccccgtctctactaaaaatacaaaattagctgggcgtggtggcgggcacctgtaatcccagttactcaggaggctgaggtgggtgaatcgcttgagcccgggaggcagaggttgtggtgagctgagatcgtgccattgcactccagcccgggcaacaagagtaaaactctgtccccctccccctcaaaaaaaaatgttgtaaaattatagccaactttacagcagaaattaggtctggcgcagtggctcatgcttgcaatcccagcactttgggaggccgtggcaggcagatcacttgaggtcaggagttcaagaccagcctgaccaacatgtctctactaaaaatataaaaagtagctgggcatggtggcatgtgcctgaaatcctagctacttgggaggctgaggtgggagaatcacttgaacctggaaggcagaggttgcagtgcgccaagattgcgctactgcactccagcctgggcgacagagtgagactgtcttaaaaacaaacaaataaacaactttacagcagaaattagataacagctcgagaaaacggcattcaaaattgaagcttaattaaaattttaatgagagaatttaaaaaaaaaccccaaagggcatggtcttaactaaaataaggggcttagattgaaaggacagaaaggaggctaagggtcaactgggcggggcctcgattctgtgggcgaagattaaatgctaaaaggatttccaggcagaacttggagttgggggtgggtcttggggtctccaagcagcgatttacctggggagaaccaaggtgcagcaggtactccagcgtctctcttaaggtgcccagctcctgctccaggccactgtacgtgtcccaaaccctctctcgctcctcaggttgcataaagggggagacataggttaggtccctctcccaccagatccttccccaccccatcatttgtcagctaaggaggagataagggagtttggtccctggagccctgcaggcgtatggactacaattcccatgggcctctttgcttggactactgggaaccccaaagtctgtatggaacctgcaattccagtacactgctagtgtagacaaataacagcattccctgaatccccaggattacttctgctctctcctaggtagcagagtctacagatctaatgaatttcattagacagttaaaagaccacagcacccagccagacacggtggttcaggcctttaatcccagctatttgggaggccaaggcgggcggatcacttgaggtcaggagttcgagaccaccctggccaacatggtgaaaccccgtccctactaaaaatacaaaaattagccaggaatggtggcgagggcctgtaatcccaggtattcgggaggctgaggcaggaggatcacttgaaccagggagacagaagttgcagtgagcctggatccaggcgctgcactccagcctgagcaacagagcaagaatccgtctcaaaaaaaataaccacagcacccactcaccctggggcagcagaaacttccttgccaataccaacaataacaatgataatatcagctaacacttattgggcactgatcatgtgctaggcattgttctcaactctcatttaattcctatgaggtagttactattattgtctccattttacagataataattatagctgacacttaagtattgctttaccaagtaccaagtaccttaagtgttaaatattcattcattcattcattcattcattcactcattttcacgtatcacatataataattctcagagttacttaaggccgggcgcagtggctcatgcctgtaatcccagcactttgggaggctgaggcaggctgatcacctgaggttaggagttcgagaccagcctggccaacatggcaaaaccccatctctactaaaaatacaaaaattagccaggtgtggtggcacatgcctgtaatcccagttactcaggaggctgaggttgcagtgagctgagatggcaccactgtactccagcctgggcgacagagcaagactctgtcccccccaaaaaaaaaaaaattagagtggttacaagacaatgaggagagagaaaaaataataaaatttggagtgtagacttctgaagaacgatcttcctatgagccctctggggcaggtccccttcgtaacgacttgcatagtcctggggcctcctaggagggcaggccccttcccaggtgctcacctgagtcaagtgacagagggtggccctcacactgaccagccggtcctgcaagaggcgctggcgaccccaggccctcccgggagccccagcctccctggtggcttggcccagctgttgccgggtcaactccagagctgcttctagttgctcctgcaccaagacagaaggtggttagacttcagaagccatgcctagccccaagaagaaagaaaagatgtcctttcacgtcctggacgtccagtcagcatcctgacttccgcattcaggaagggctcagggcaggcagagaggccaggcgccctgtccttggcccagggccccgcaccttctcctcctgcttctggtctatctcctcctgcagcctccgcagaagccggtcctgcccgcacaacttggtcagcagcgtctggagaaaggagagcgggagctactgatggtccagatctggctcttcccctgccgctcctcccatcatctagaacattctctccccaactctgggaactcagcaaggattagatcagtgacaacttacatctgtctccaagctttggtggaaagttgactccaggggaggacccggctgaagagaaggaaaaaagtcaggggtcaaaggggacaggctggtcattcttgtaactcagtgctgagccacgccctgtctctactgataggtactgcactatttatttatttatttatttagagatagggtcttgctctgtcacccaagctggtgtgcagtcgtgcgatcatggttcgctgcaggctcaacctcctgggctcaagcaatcctcccacttcagtctcctgagtagctgggaccacaggcgcacacatcatgcccggctaatttttgtagttttaaaatttttgttgctgttggttttggtagcgatggggttttgccatgttgcccaggctgatctcaaactcctgggctcaagcaatcctcctgcctcggcctcccaaagtgctgggattataggcatgcaccatcatatcatgcctggcctttttttttttttttttttttttttttgagtcaaggtctgtcacccaggctggggtgcagtggcatgatcatggctcactgcagccttgaactcttaggctcaaaggatcctcccacctcagcctcccaagtaggtgggacaacagatgccagccaccggtgccagctaaggttgtttgtttgtttgttttcagggctggggtctcactatgtcacccagaccagtcttgaactcctgatctcaaatgatcctcctgccttggcctcctgaagtcctgggattacaggcatgaaccaccaagcctagcgacccctctccttatcagcttccttctaagcattagcaaatttcagtagaccaacttccacattcttggcttcagaaagatcaataatgggctcttgatcaagcagccatggcaaatattataattaatggagaaatttagacattttatttatgactaagaataaaacaaagtgcagggcacagtgactcactcctgtaatcccaaagctttgggaggccaaagagggaagatcacttgagcccaggagttaaagaccagtctgggcaacatagggagaccttgtgtctgcaaaaaaaataaaaataaaaaaatagggccgggtgcggtggctcatgcctgtaatcccaacactttgggaggccgaggcgggtggatcacctgaggtcaggagttcgagaccagcctgaccaacatggtgataccctgtctctactaaaaatacaaaacttagccaggcgtagtgacgggcgcctgtaatcccagctacttgggaggctgaggaagaagaatcacttgaacccgggaggcagaggttgcagcgagccgagatcgtgccattgcactccagcccgggtgacagagtgagatttcgtctcaaataaataaataaataaataaataaataaataaaataagctgagcatggtggtacatgcctgtagtctcagctactagggaggctgaggtgggagtatcgcttgggcccaggagactgaggctgcagtgagccatgattgcaccactgcactccagcctgggtgacagagtgagactctgtctcaagaaaataaataattttttttaatttaaaaaaaaacaaaaaacagcctgggtaacatggcaaaaccctgtctctacaaaaagtagaaaaagttagctaggtggccaggcgcagtggctcatgcctgtaatcccagcattttgggaggccgaggcaggcagatcacctgaggtcgggagttcaagaccagcctgaccaacatggagaaaccctgtctttactaaaaatacaaaattagcagggcgtggtggtgggtgcctgtaatcccagctactcgggcagctgaggcaggagaatcgcttgaacccaggaggggaggttgcggtgagccgagatcacgccattgcactccagcctgggcaacaagagtgaaactccttctcaaaaaaaaaaaagaaaaaggaaggaaagaaggaaagaaagaaagagagagaaaaaggaaaggaaaggaaagaacgaggaggggaggggaaggggaaggggaagggggaaagaaagaaagaaaggaaggaaggccagtcgcggtggctcacgcctgtaatcccagcactttgggaggccgaggcgggcagatcacaaggtcaggagatcgagaccatcctggctaacacagtgaaaccccatctctactaaaaatacaaaaaagttgggccaggcgcagtggcttacgcctgtaatcccagcactttgggaggccgaggcgggaggatcacgaggttaggagttcgagaccagcctgaccaacatggtgaaaccccgtctctactaaaaatacaaaaattatccaggcatggtggcacgtgcctgtaatcccagctattcaggaggttgaggcaggagaattgcttgaaccagggaggcgaaggttgcagtgaaccgagatcgcgccactgcaatccagcctgggcgacagagcgagactctgtctcaagaaaaaaacaaagaaaaaaatacaaaaaaattagccgggcgtggtggcgggcgcctgtagtcccagctattcaggaggctgaggcaggagaatggcatgaacccgggaggcagagcttgcagtgagccgagatcgcaccactgcactccagcctgggcgacagagagagaccccgtctcaaaaaaaaaaaaaaaaaagaaagaaagaaagaaaagaaaagaaaaagaaagagaaagaaagaaagaaagaggtttttgcggatttaagttaagttacgacgatgtcatggggtgtcctaataggaggagatggacagcaacaaaaacacaaaggaagatcatcatgggatgatggaggcaaagatgtggccataaaaaaaaccacagaacctcaggaattgctggcaaccaccagaagctaagagagagtcaataaaagctcctccttagaaccttcagtggaagtatagccctgccaatcccttgactccaggcctctggcctccagaaccgcaagataatccatttctgttgttttcggccatgcgctttgttacagccaccacatgaatctaatacctacccagggtctttgaaatatctacagttctctaggcaccctaggccaagagatgacattcctcatagagaagaaaggaagggagggggctccggtagatttagggtactccaggatacctaccaataaaaccatggaggcccgggtcccagggggccgcggggggagctggagataagtgggggagccagagtgtgcctgggaggaacgttgaaatggagatgtttagaaactggcatgtctgggagacttttcattttgttctgtactaagaaaaattcttctgccttgggatcctgttgatctatgaccttacccccaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaataataataataattaaaaaaaaaaagaaactggcatgtcttagtgacaaatagtagagtgggcatgtccataattgaagtgctttaggagatattttgaggttcagaactgggccctctcaacttcctcaactacctgctctccagctgtgtgccactgtggggacacagagggtgataataaatgcaccagcctggcaaaacagccccacaagatgatggaatttgctactctcattctcagacttgcagtcagctgtggatattctgagctaccgtcccatgatgctcagacaaaacagcaggcaaccaacttgcaaggtgaactggggacacaagggagatgcaaacctctcaccgcactgtcttggcacagagtatccaggactacaatccccatgatgcttaaagagcaatggctgggccaggcgcggtggctcacgcctgtaatcccagcactttgggaggctgagatgggcagatcacctgtcagctggtcaggagttcgagaccagcttggtcaacatggtgaaacctcatctctaccaaaaatataaaaatcagccggacgtggtggcaggtgcctgtaatcctagctactcgggaggctgaggcaggagaatcgcttgaacccgggagacagaggttgtagtgagccgagatcgtgccactgccctctaaccttggcgacagagcaagacctcagtctcaaaaaaaaaaaaaaaaagcaatggccgaagaccagcctagaaagacagcccagacacctgagaggagctggacacctgataggttcaagctctctctcacctgagcccagctgagatcattatggactacaatacccatgacacccagggagcaatggccttgagaatacggaaagacagccctgaggcctgatgggaaacgtagtcccctccttctcacctctctgctcacctgtgttctgggctcctgactccagtgctggggactcctggggggctttcctcccccagcctcagagggaggtcctcggcggggagtagggggtcgggagagggtctggcgttgggggccccaatccagaggaggtcggacatcaatgcgactcaacggggtgtgaggtcgggcagggggtgctgtgtctcctgagggggcagggggtcgccgcgcaggggcagaacggggacgggggaggctcagaggcgagggagggcgagagaggggggtgaacaggctgtgggaaggagagaatcggggaactgagtcaactagagccctctccatccacctccttacccatcaagtcagcctcaaggacatgtctcacttcactgtgtcttactgtcccactgggttagaatcctcctctactgtccaaatcctcagtaatgtccgctttgtggcatcttcccctccagtcttctccccgacaggctgtgacccccacgggagccccagcaagtcacacacactcaagcagaaagcgctaaggcccgcccccaaccagtttccggccctgcccttctcttaggccacgcccacaaccatgtcctccctactcactcggggctcctcgccctccgcatctggagtccagagtggaggtcggttgtggggctgggagtgagcagcctgggtctaccacgacctctggagagtcgagtcacttccggtgattctgagatgcgcccctcttcccctctgctcacctccgggggaccaccggggccgccggggccctccccgggctggggtcgtgcaggtgacctgggttgcccactagcgagtggacatagacaagatatcactccttcgaacttcataacagccctattctcttgtcacaggtgagaacacaaggatgcacccaaaaaaggaaagttgtgcactataaatcatcgtcccccttcttcagaaggggaaactgaggcctccaatgtgaaactgacctgtgcgccaggccacaacgtctatccaggttgctggacccaatgccccggaatatgggatagactcagccaggtagtccagtttccagcctgataattggcgcaggccatgtcagagcctaagagatagtctgacatttttttaaaatctgatactatcttttacctggcattgtttaggtggcagctcaggggacttcagaaggagccaatcagagagtgtgcaatattgatcattcctggagcagagctgagtgcgtgactgaagggtcagcttgggggcggggacggacaaggtggtgggcggaacttaagggagaaagacttttgctgattggaaaagttccctggaggtggggcctagaagacgaggcgccttagctagaagactggtgattggacactcaagggggcagggccccaaaggggaggagttgggatgacgagactgactcagggtggagggtcaggagcatggcttggacctctactcactagtcgtccccctccgcacgggaggcccggcccagcgcccgtagccagccccgcaggtcttctaaggtgtcagcggccaaaacgtaggtcctcatgcccgggtgctctgcctgcgggaagagaaggcttggaatccggactcccgggccttgtaaaaaggaggacaggccggaccggtgactcattccagtaaacccagtgctttgggaggccgatgcgggaggatggcttgagaccagcctaggcaacataatgagacacccccctccacctccttccgcccccgtctctacaaaaaaatcaaaaaattagccggacgtggtggagcgcacctgtagtcccagctaccggggagactgaggcaggaagactgcactttgcgtcgctgcacgccagcctgggtgacagagcaagaccgtcaagaaagaaaggaaagagggaaagagggaagggaagggagagaaagaaagagagaaagagaaagaaagaaagagagagagagaaaaaaaaaggaaaggaaaggaaaaaggaaaggaaaggaaaggaaaatggaaaggaaaggaaaggaaaggactggacagacgcggtggctcatgcctgtaatcccagcactttgggaggctgaggtaggcggatcacctgaggccaggagtttgagaccagcctggccaacatggcgaaaccccatctctactaaaaatacaaaaaattagccaggcgtggtggcgtgcgcctgtaatcccagctactccagaggctgaggcaggagaatccgttgaacccaggaggcggaggttgcagtgagccgagatcgcaccactgcactccagcctgggtgacagagagagactctgtctcaaaaaacaacaaaacaaaaaaacaaaccaaaacaaaacaaaacgaggatgcaattgacgcttgtcaagaccttttatctccagtaatggatattccagtgcttgttaggacttggagtttcctcgacagatatctacccgccctcatctccagttcccatcgcctggtgcacaacatggatggatggactcacggtgaaggtgaagcgccgccctcggggggctcccggcccatctggtctaatattgtagctggggagcaggacgctgcctaggacactctcctcgcggctgtctgcaaagaggggctggggtcaaggatcacacagggatcagaaggccaagatgctagagagaagggcagactgggcgggggggccctcccaccccaagccagccagccagccactgacccttgtaataaaagaggcaatggccggagaggacgaaccagcggcgtttccagagacggagccccgagctgtcctggggagagagatgggaggaggggcctgagtaaagggaaacagaaaaaggggatgaaggcagtgacgatggggacagagagccagagagagaaagaaacttggagagaggagaacagagacataaagtagggatcaagagagtggggtgaggccgagcacaatggctcacgcctgtaatcccagcacttagagaggccaaggcaggtggatcactcaattccaggagtttgagaccagcttgggtaacatggcgaaaccccatctctactactaaaaaaaaaaattagccaggtgtggtggcgcgtgcctgtagccccagctactccggaggctgaggagggaggatcacttgagcctgggagtggggtggaggcacaggagaaagacccagagagacagaagagacagagacacatgtttggggcaatggagtggataagaaggagagctggaagccctctgaacatgatagaatagaatagtagccctacttcttttcttttctctctcttttttttttttttttgacagagtcttgctctgtagcttaagctggagagcagtggcatgatctcggctcacggcaacctctgcctcccaggttcaaatgattctcctgcctcagcctcccgagtaactgggattacaggcacgcaccaccacacccagctaatttttgtatttttagtagagacagggtttcactatgttggccaggctggtcttgaactcctgacctcaaatgatctacccacctcggcctcccaaagtgctggggttacaggcgtgagccactgcgtctggcctcccccactttctttttttgttttttgagatggactctcgctctgttgcccaggctggagtgcagtggcacgatctcagctcactgcaagctccgcctcccgggttcacgccattctcctgccccagcctcccgagtagctgggactacaggccccccgccaccacacccggctaattttgtttttgtatttttagtagagacggggtttcaccgtgttagccaggatggtctcgatctcctgaccttgtgatctgcctgcctcggcctcccaaagtgctgggattacaggcgtgagccaccgcacccagcccccactttcaaactatgctctggaacaagtcatttccgcctagaatccaccttcatgttttctcgtctatccgctggagattgagaagttttagggaggtttggatgagacatggaccacatatgggcagactttagctgcagagacttagtccaattattctggagcctgagacacagagaggccaggaaggtggcaatgagccatgacccaaatgcagcgtctccacctgcctgaactactcatcgcctctgcctgaactactccactaactatctccaacctcgtgtgcctcttctcctcaacccattcccatagaagcccacatgatcttttaaaattataagttagatcacgtgagtccccttttcaaaacagagaattaagaacacttgaaattcagtctcaaattccttaccatcacttactgttttttgtttgtttgttttgttttgttttgagatggagtctcgctctgtcacccaggctggagtgcagtggcacaatctcggctgactgcaatctctgcctcccgggttcaagcgattctcctggctcagcctcctgagtagctgggactacaggtgcctgccaccatgcaggctaatttaggttttttgtttttttttttttttgagacggagtcttcgctctgtcacccaggctggagtgcagtggcatgatcttggctcgctgcaagctccacctcctgggttcacgccattctcctacctcagcctcccaagtagctgggactgcaggcgaccaccaccacgcccggctaatttttttttttttgtattttttagtagagatgggggttcaccgtgttagccaggatggtctcgatctcctgacctcatgatccgcccaccttggcctcccaaagtgctgagattacaggagtgagccaccacgcccagcctaatttttgtatttttagtagagatggggtttcaccatattggccaggcttgtctcgaactcttgaccttgtgatccacctgcctcgacctcccgaagtgctgggattacaggcgtcagccatcgtgcccagcccatgtactgctttgcagagagttttgagtttgaaggtgcataagaatcaccaggaaggtgtgttaaaacacagattctggggccccatccccagagttcctgatttggcaaatctatgatggtacctcatcatttgcctttctagcaagtccccagatgacgctgatgctgctggtctgggaccacactttgagaaccactgctctgctgctcctcctggcttcttcccctggcctcacttgacaccaaggttttgcctgctgcagaccttttccttttggatgcgatctgcctccaggtcttttttttttttttgacatggagtctcactccatcatccaggctggagtgcaatggcgcaacctcggctcactgcaacctccacctcccagattcaaattttccttgtctcagcctcccaagtagttgggattacaggcacccccaagctggcccggctaatttttgtattttttagtagagccagggtttcgccatgttgaccaggctggtcttgaactcctgacctcaggtgatccgcccgcctcagcctcccaaagcgtttgaattaccggcatgacccactatgctcagccagctcaaatgtcacctcagagataattttccctgaccaaatgtcaaattgaagttctcctctctcagccacgttcaagcacatcatattccgtttttttgtttttgtttttgagacagggtctcactctgtcacccaggctggtgtgcagtgacatgaacacagttcactgcagcctcagcctcctgggcttcagcaatcctcctgccttagcctcccgagtagctgggactataggcgcacaccaccacgctcagctaggttttgtgtgtgtgtgtatttgttgttgagatgaggtttcttcatgttgcccaggctggtctagaattcctaagctcaagcgatcttcccgtcttggcctcccaaaatgctggggttacaccactgaacctggaccctatgttacttcttcatagcccatcctgcgatctgaaatgaccaagtccatttatttatttactaatttattatccacccatgctccacccaatctggaatgtaatataaatacttttgtgttatttgcatggtgtgtgccctgggattgggaacactgtaagtgttcaagaagtagtcaagaaagaatgaatgaatgggccaggcacggtggctcacgcctgtaatcccagcattttagggagccgaggcgggtggatcacttgaggtcgggagtttcagaccgccctggccaacatgataaaaccccatctctactaaaaatacaaatattagctaggcatgatggtgcatgcctgtaagcccagctactcgggaggctgaggcacgagaattgcttgaactggaggccagaggttgcattgagccgagatcataccactgccctccagcctgggcgacagaaagagactctgtcttaaaaataaataaataaacaaacaaacaaacaatgacggactaaggggaggggcagtgatagcaagaaaaagaaagcctatttggggacttgcaaggagagagacagaggacagccggggcacagacttcagtgtccttttccttctcctactgaccccacctgcttatgaagccagcctcggatgtgcacgggaaggttgggatccctcctgagcgcattgcctctcttcccaaaggcgtggatcttgtttactgcccgggtgggcttctgaggagagaaggggacagaagtgaacagggagagcctaggatggtcctgggagggggtgagggtggacacaggcaaccgtaggctctcgcttggctgccctgagaaatgggtcaaggaccagccgggcgcagtggctcacacctgtaatcccagcactttcggaggctgagacgggtggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgagaacccgggaggaggagcttgcagtgagccgagatcgcaccactgcactccagcccgggagacagagtgagactccgtctcaaagaaaaaaaaaaaaagaaagaaagaaaagggtcaaggtgggggctgaagttggagatcagaattgggaggtgttcttattgcagagttaagagactcttttttttttgacaggctctttggagtgcagtagcctaaacactgcagcctttacctcctggactcaggtgatcctccagcctcagcctcccatgtagctgggaccacaggcatgtcccaccatgcccagctaatttttttactttttgtaggggacgggggtctcactttgttgcccaggctgggagagactctttttttctttttcttttgagacagagtctcgctctgtcccccaggctggagcacactggcaccatcttggctcactgcaacccctgcctctcgggttcaagtgattctcctgcctcagcctcctgagtagctgagattgcaggcacgtgccaccacgcctggctaatttttgtatttttagcagagacgcggtttcgccatgtcagtcaggctgctcttgaactcctgacctcaggtgatccacccgcctcagcctcttaaagtgctgggattataggcgtgagccactgcgccgggccgagactctttttttgatgggcagagggaggtgttcagaggcaaggaagaggctgtagggaagcaatttggggatcaagcatccactgccaagaagcagatgcccttggccaccagagccagagctgtagtaggtcctttgggatctgaactgggactatgggctgggagggccccataatcagggggaactctcacgctgagtctccagtgaatcaaaggatgccctggtgccctgcggtcacaccccttagcaaccaagtacaaggagaggaagcctcaaatccctccatcctgcccggatggagcctcatctcctgatgcccacagatatctcaggcatccttagccaggtcccgacaatatgcccttccttggaagcggtggtactgaccaaggctgagatcagatctctgggctctgaacttgagaaacaatatgtgtggaacggcaggaggaaaaagaaatgagtgtctccctaagcttttggctgggatgccgatttgggatgcaagtatctggaggccccttgggtcttattgtcagagaagggtctctccttataggatttcattagtgggtagattggatggcgagagataggacagcaagttctggcactaatcaagagcagccactacttctcagaactcgaggggcctcatggctggggagcggctttatcttagcaaccagggtcaagggaggttgttactctggtttagaattaggaaaatacaaagggtggggacagagctgggagtgcctctgaattcctagctgcggtgtgtaggcaatttgggaccttactatgtctggcagaccccgttgctaaggatctttgtccttaacaaccagagtccttggggaaacagaaggatgggcggcccagagccccaccttcctccccatccccgccaggaagctcaaaccttggggctcaggctgctgagcgaggagatggtggaggcgctgctggccaggctcaggctgctgcgaggtcggctcccctccatcaagggctgggggagagaaagaaaggggctgtgtctctgcagtgacgggtgtgagacagagatggggtcaggggcttggaggtcggaggaggctgcagagaaagagcctgttgtttcgggacttggggggctgggggaggccatggcccgtgaccacataccaagagtggtgccaagagaggtaggcggccctggcagctgcgggagggggcagctgtctgcagcccaggccagagaataggggcttctttattcctgcccactgcactcaggccaggaatttgaccctctctgtgcttagggactccccattccctgcctccttccggctgccccaggctacctgtctcccgccctcccacatgcacccccaaaccacccctgccaactccccaagccaagccctgcggcaccaggaatgtgaacccagagagcccctcccagcccagccagggaacttacccagctctggggtcccagtgacgggggggcaagaggacggtgtgggtgctgcggcacctaggcagtctcccgcctcctttgtctcttagctgctgtctctcatagttctcaatctctctcctcacctgctcactcacactttttgtctctttgtctcctgtctcttacggtctctctctctctctcttccttttacactacctctctccccactctcactttctgtgtctccctctgatctctgtctcttccagtctctctctcactcattctctccctctctctctctctccaatctttctgtttctgtccaaatcttttattgtcagactcacagggtctcttccttaagtctctgtctcattctctctctctctctctctctgtctctcagtcatcccctgtgtcctctctccttcacactcagtctcttcctctttctctctggctctgccgtttcctcccttttctctttccgatttcccttctcactttctcccttcctccctctcccagtttctctttcctctctgctggtctttccctgcctctgccagccgcccacgctgctgttctcccctcccaatcccggctgtccccgccccttctggcctccccactacagcctgacctctggctcagctgcccccatagctgaagggaggggcttgggccccccaattcccaggtcccctaaggaccaaggttgggacttctcagtgtttggagagttggacttgaggcctgcactccagggcccccgtgggtttgctgctgtggttgggggcctgagccactggtgtcctaaacggaggaggcttgtgtcctgcaaggggtggggactcaaatttccaaagccctggagggaatgggttagggatccagactcctgggtgcccgagaaggtctgagctaggatcaggactcctgagtcgtgaaagagctgggggtctggaaacatggctgtgcttggaaggggccagggacggtttgtccaggtcccctagggagaaaaggggatggtcccagtagggcagggtgaaatggagagttccaaacctccacctcagatccaggtgagaattctcttctagactgaggacaactccctcaggagagagacatgattccttggtatattttgaggaacaagattatgcatccgtaggcaggggaggagagcggggggctggaactgtcacccagggcctggaacttgtagcagaagcgcccccacccgcacaaagagtgccacccaggcagaatcgcggcttgtgggggcagagctactgcctaagtctgaagcagatgacacccaggagtggagccttgtgcctgtgaccgggaaggaatctgagctttcggtttaactgccattcaccatgcacctgttgagcacctactgtgtgcaggcactgtctgttgcagccactgagaagaaagcagtgagccctggctgggtgcaatggctcacgcctgtaatcccagcactttgggaggccaaggcaggaggatcgcttgagaccaggagttcaacaccagcctgggcatcatagcgagaccttgtctctatttagaaaatgaatttcttttttttttttttttgaggcggtgttttgctctgtcgccaggctggagtgcagtggcgtgatctcggctcactgcaacctccgcctcccgggttcaagcgattctcctgactcagcctcctgagtagctggaactacaggcacatgccactgcacccggcctaaattaattattattattatttttttgagacggagtctcgctctgtcgcccaggctggagtacagtggcacgatctcagctcactgcaagctctgcctcccaggttcacgccattctcctgcctcagcctcccgagtagctgggactacaggtgcccaccaccacgcccggctaatttattttgtatttttagtggaggcggggtttcaccgtgttagccaggatggtcttgatctcctgacctcatgatccacctgcctcagcgtcccaaagtgctaggattacaggcgtgagccaccgcgctcagcctaattacttttttttgaaaagcattgagcccagcaaagtgcctgatctcatagtgcttacatcctcattctcatttgcaaggaatctggaccctgctgtgactatcttggtcaagtggcttcatttccaagcctgtttccccatctgtgaaatgggaacaatgacaccctcgcactcggggaggaaaccaaccacatgtgaaaataggagactctagccaggcgtggtggcaagctcctgtactcccaactactcaggaggctgaggcaggagaattgcttgaacccgggaggcggaggttgcagtgagccaagatcatgccattgcactccagcctgggtgacagagtgagacaccgtctcaaaaaaaaaaaaaaaaaaagaaagaaaaagaaaaaagaaagaaaagaaaaaaaaaagaaaatgggagactctaggctggggcctgtgggctaaattggggtaggaggccaggcacagtggatcacaactgtaattccagcactttgggaagccaaggcgggcagatcacctgaggtcaggagttcaagaccagcctggtcggccgggtgcggtggctcacacctgtaatcccagcactttgggaggccgaggcgggtggatcacaaggtcaggagatcgagaccatcctggttaacacggtgaaaaaccccgtctctactaagaatacaaaaaaaattagccgggcgtggtggtgggcacctgtagtcccagctactagggaggctgaggcaggagaatggcgagaaccagggaggaggagcttgcagtgagccaagatcgtgccactgcactccagcctgggcgacagagcaagactccgtctcaaaaaaaaaaaaaaaaaaaaagacctgcctggtcaacatggcgaaacactgtctctactaaaaatacaaaaattacccaggcattgtggcacatgcctgtaatcccagctactccagaggctcaggcaggagaatcgctggaacccaggaggtggaggttgcagtgaaccgagatggcgccactgaactccagcctgggcgacagagtgagacgcctactcaaaaaataaataggctgggtgcagtagctcacgcctataatcctaacactttgggaagccgaggcaggcagactgcctgagctcaggagttcgagaacagcctgggcaacatggcgaaacactgtctctactaaaaatacaaaaaattagctgagtgtggtagtgcgtgcctgtaatcccagctactcggaggctgaagagggagaatcgcttgaacccggaagatggaggttgcagtgagccgagatcacgccattgcactccagcctcggtgacagagcgagactccatctcaaaaaaaaataaaaaaataaaaaataacaaataaataaataggcctggagtggtggctcacgcctgcaatcccagcactttgggaggccaaggcaggcagaacacctgaggtcaggagttcgagaccagcctagcaaacatggtgaaatcccgtctcagaaaaataaataatgaataaataaataaataaataggccgggcgcggtgactcacgcctgtaatcccagcactttgggaggccaaggcgggaggatcccctgacgtcgggagttccagaccagcctgaccaacatggagaaactacgtctctactaaacaaatacaaaattagccgggcgtggcggcacatgcctgcaatcccagcactttgggaggccaaggcgggaggatcccctgacgtcgggagttccagaccagcctgaccaacatggagaaactacgtctctactaaacaaatacaaaattagccgggcgtggcggcacatgcctgcaatcccagatactcgggatgctgaggcaggagaatcgcttgaaccccgaaggcggaggttgcggtgagccgagatcgcccctttgcattccagcctgagcaacaagagcaaaactccgcctcaaaataactaactaaataaataaataaattggggtgggaaggcattgaccctgagctgagagagaactggctcgctgttgaagcagggccacgcatttgattgacagttcgtttgttggaggggcgtggtcacgctcggaaactccgccgtgacgttgcaaaagctggaatctccgcgagaagtcctgtcttacttccacttcccacccttcgggttgcggtctcgaaaccccgcctctcttcgtgacgtcagcacgccgggcgcggtaggctataaaagcctagtggccattgtgttcgttgctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccggtgagtaaggggtcggaacgcctgggtccccacggggctgggggcccggatttagaaaggagaaggggttgggagcctggagtcctgagcctgagggaggagggatctggaagccagattcttgggtcccccgtgaaggaatcatctgccaagtagggggtcgggtcagaatgtttcagtctgcgagggaggagggtgtgagggtttgatttgtcaatcttcagcagaatgagagagctagggactatgactttgtcgccaagggaagcaagtaaagacttttgttcttggttcttgggactgggagttctgcgtctgaagaaagagagggctgggggcttggacccttggatctaaggcagaactaggggctcagactcctggctattgagagataagaacagagccaagggacagagatgggcgtggccgagatcagaaaggaatttgggactctcgcgttgctatttacaatagttgtgttactatttccgttgctatgactcatagtcacgcccggatgccatcctctaaatggcccctaaactttatttttttctcccccttttccagcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtaggtgctgagagcccagattctattttttttttttttttaattgagttggagtcttgggctgtcacccaggctggagtgcagcggcatgatcttggctcactgccaacctctgccgcccaagttcaggcgattctcgtgcctcagcctccagagtatctgggattacaggcgcatgacaccacacccagctaattttttttgtatttttagtagagacgggggttttgccatgttggccaggctggtctcaaactcctgacatcacgtgatccacccatctcagcctcccaaagtgctgggattacaggcgtgagctaccacatctggctgagagcccagattcttgagtcttagaaagaaagggggctgggggccgagacttctgggtccctgtatgttgcagagggttgcatgtcatctccatggagaaggctgtgtacgctgtcacgcaatcccttgtaagaggccaggcccctgggggaggagggagcagctgtggctcacagcagccccaggaaaccacctcttccttcagtgagtcagatagatagagaatcccgtgacagtgacaggcaagtgactagccagatagaaagcatttttgtgtaataactaatttttgtttgcttctctctctctcttccccgccctccccatccggattcccgtggctgtgtgcatctcctgcctgtgtccccatgtctgcccgcaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgtagcgagcagcgtctgtatgtgtcagaaactgacagcattctacttacaggtccctgagggagctgggaagagaatagcataaaacaaagcacttcaatggcggataaaccgcttttcctcaaatttgctaccactcatcctgaggcttcttttgaacctaacagtgcagggaccagccccacagggtcggtgggcttctccctgtgtgcggcgacgagagagtgtagaaataaagatacaagacaaagagataaaagaaaagacagctgggcccgggggattactaccaccaatgcgcggagaccagtagtggccccgaatgtctggctgcgctgatatttactggatacaaagcaaaaggggcagggtaaggagtgtgagtcatctccaatgattgataaggtcacacgagtcacgtttccaccggacagggggcccctccctgtttggcagcccaggtggagagagagaggagacagcttatgccattatttctgcatttcagagacttttagtacttttactgattttgctactgctatctagagggcagagccaggtgcacagagtggaacaggaaagtgaaacaggagcgtgaccgctgaagcacagcatcacagggagccggttaggcctccggataactgtgggccagcttgactaatgtcaggccctccacaagaggtagaggagcagagtcttctctaaactcccgcagggaaagggagactccctttcctggtccgctaagtagcgggtgtttttccttgacactgaggctaccgctagaccatggtccacttggcaacgggcgtcttcccagatgctggcgttaccgctagaccaaggagcccttctgctggccctgtccgggcataacagaagcctcgcactcttgtcttgtggtcacttctcactatgtctcctcagctcctatctctgtatggcctggtttttcctaggttatgattatagagcgaggattattataatattgggataaagagtaattgctacaaactaatgattaatgatattcatatataatcatatctaagatctatatctggtataattattcttgttttatattttattatactggaacagctcatgtcctcggtctcttgcctcggcacctgggtgtcttgccgcccacataacagctggtgggttttatagttttttttgttgctttttttgagactgagtctcgctctgttgcccaggctgaagtgcagtggtgcaatctcagctcaccacaacctctgcctcccaggttcaagtgattctcctgcttcagcctcccgagtagctgggactagaggtgtgcgccaccacgcctggctaatttttgtatttttagtagagacagggtttcactatgttggccaggctggtctcaaactcctgaccttgtgatccacctgccttggcctcccaaaatgctgagataacaggcgtgagccaatgcacccggcctatgtatttttgtttgtttgtttgagatggagtctcgctgtgtcacccaggctggaatgcggtggcacgatctctgcttactgcaacctccgcctcctgggttcaagcgattctcctgtcttagtctcctgagtagctgggattacaggcacactccaccatgcctggctaatttttgtatttttagtagagacggggtttcactacgttgatcaggctggtctcgaactcctgacctcatgatccacccgccttggcctcccaaagtgctgggattacaggcgtgagccaccgcacccagacccggcctgtagtttttctttgacatctgcctaaattgtattaaacttgggacaattatcaccacccccccaagggagctggagaattgagtcacggatccctaaaaggaggcagaattgtctgtgccttgctggaccattaaggctcaatctctacaggcctttacattctcctccgttgctttgataccagtgggtatcgaggtccccaagcccgggtgggacctccccctcagccagtgttcaggctcttgacacagtcatgaaaatgaattcaaggacgagttggaaaagagtgaaaatacaggatttattgcaaaggggaaagtccacactcatgaaaggggactcgagagaatcacgtgcaaggggggttgaggctgctaccgttatgggttttttgtttgtttgtttgttttttaaagatggagtcttgttctgtccagcccaggctggagtgtagtgacacgatctcagctcactgcaacctccacctcctgggttcaaacaattctcctaccttagcttcccaagcagctgggactgcaggcgccaccacacctggctaattttttgtatttttagtagagacagggtttctccatgttggccaggctggtctcaaagtcctgacctcaagtgatccacctgcctcagcctctcaaagtgctgggattacagacgtgagccaccacgctggccctttttggatttttttaaccaaggggtaaaatactcatgagcattcctggaaaaagat

SEQ ID NO: 538 - DNA, 66103 bp, Homo sapiens
catgagaatcttcactgtaatgaattatgtctttgcaatcttactcatcttaattatttcataggacttcttgaacttatttttcagcttcgtcaacttactttgtaaaccattgtattagtctgttcttgcattgctgtaaagaacctgagactgggtaatttataaagaaaaaatgtttaattggctcatggttctgcaggctgtacaggaagcatggtgggatcagtttctggggaggcctcaggaaacttacaatcatagcagaaagtgaaggggaagtaggcaggaggaagaaaatgaatggggaggtgctatacacttttaaacaaacacatctcatgagaactcactcactctcatgaggacagcatcagggaatggtgctaaagcattcataagaaactgcctcatgatccagtcacctcccaccaggtcccacctctaacactggggattaccattcaacatgagatttgggcagggacacagatccaaaccatatcaaccatattgttaacaaatatttacttgagtctaaaaataaaggaaaagaagcatcttttactgcatctttcactgacacattctttgtaaacagtggtttagtttagaaacagtggaaaacaaatggaaaatcaagaacctcagacatctattttcctattagttctaaagctttatatctccagcatgtacaattcaaggtctcctgtccatttcacaattacccttcattgaatgtcctgaatatccttaattatagaattaagaattcaattttgtaaagtaagagaaataagagcatttctcagatatgtgaaaaataattttagataatacagaagccaacagcctgcaagaaataggtcaaggtctgatccttgtaagcgaagcatcatggcgtaactggccagagttttagctttaaagttggaaaatccttattctgctctataatttggggcaagttatttaaatcttaagccttagagtttcctcctttctaaattggggatgatacatctaatttacagggatgtcatgggccttaaatgaggcaatatatgtggattggtacctagaatgcatgtggtaaattgtatttttcttgccctctggtgtttgtatgatgaaatgttttaggagtgaattattttggaattctcagtaatatcaaactccgacttcttagccccccagaaggtgtgaagggggaggatataaaattcccactatctggctggatgcagtggctcatgcctgtaatcccagcattttcagaggccaaggcaggaggattgcttgagcccgggaagtaaaaaccagcctaggcaatgtggcaagaccttctctctacaaaaaaaaaaaaaaaaaaaaaaaatttaaaaatagccaggcacgctgatgcatacctgtaagtcccagctactcaggaggctgagatgccaggatggcttgaacccaagacattgagctgtgtcattgccactgcactccagcttggatgacagagcgaaagcccatctcaaaaaaaaaaaaaaaaaatccccagtattgtaaacagaaacttggacaaaaaggctcaaggcatttcttcactttgtgttattcagtttaagtaacacaggaagtccctcttcagaaacattttccctcagactgtaggtagccctcagctttgtgatagttaatttaaatagtgtagttgctaagtgctcaaagcagggttcaaatcacctcacgtcaaccttttaggaaaggagttataattagtattcccatcttacagatgaggaaactgaggttcaggagcattgcaagtcatgtggccaaagtcccacaggtagtagaattggaacctgaacccagttttgctccagtgtccacggtgttcactggtcatttattgtcttcatgattttctttaataagattgtcttcttctgaattcttgatgaaatcagtacagtgatatagtgagttttgggaagacctgggagaactacagaaggaggaacttgtgagcatgttagtgggagtggtggggaggcacaagaggatagtcacatgtcagtacttgaaaatacaaccaaaaaaaaaaaccaactccgtacttagaaatgtacttagaaatggtacttaaaggccagtaaggagaatcgggtgacatggagggtttcttcccaacttctcacgcatggggatggccctctgagggttaagaagggtgcatgataccaggaagcccccatactcccttgactcacatgccatctttctgaaaacgtttgagccaaagagcgtttggagcttgtgatggttaaatgtgatgtgtcaagttggcccaggctacggtgcccacattgtttggtgaaacactggtctagatgctgctaggaaggttatgtcatgctgggaagaaccctaactaatatagagctttgtggaagtggagataatttagtatttaatattatagctggtatttagaatctacatatattttgtgttcttaaagtttttaaaatcagaatcctggacctaatagggatcttaataagtaatcaagtacatctttctgtcttagattctaagccactcaaaagagatgatagtcttttcctttttttaacattagaaccaattccacacatgcctgtatgatattctcaactccacagaatatgatcacattttacagattaagaatctttgatttgaatatcaacatatagttatttgctttgattttggggaagatgaagaaaaactggtcgattatttttatgccaacacttcatcatatagttgaagggaactataacaaggcttatcgttaagttggttttatcatactgtattgaatcatagtttcagatctagtagaagctggaatataagaagtgcgtataccaaagttgtccctgcttttgaagattgtggtatttgtagatctcagaacccctagctaaggtaattcctgcctaatttccccttttctgtcctaacttgcttattctccttcccagtgcttggtaaggcagaccaacttctccccattccctccaacagactcaggatggccgacaaagtccaatcaaacctgctcaaccatataggctctacaatttggcttttctaattctgtctttggcacataccccattttgccttttgtaaaatcttttctttagatgaaataatcccagctcctcattccctcgaccctttaatcattttgtttctgttctctgaactctctccaattttcctatatattgtatcagatgcggaaaccaaaaccacacaccattttctaacaggatctatgcattgccaaacctggggaggtgacttacttcttcaatcagaaattgaagccaagtccaaaaggttaacaagtggatgttggaacaggtgtgacacccccattccaataaagcaacactttctgagttggtaattattcagtgtggaaagtgtaatctacttgctttcacataaaaaattttagaatattcatgtatttgtataagacggcatgatagataaagcaggtgaagaaaaagataaatagcactggatcctgccaatatttttctaagtgctattgttctttgtgagaagttaaggaagctgatctgtttcctgggacaaagtaaagttcactgaaatatatatacataatatatgttataataattccaggcaagagaaagcaaaggaaatacccaggactctgccaatcccacaaatattcagtgagaaaaacacctggattctccccaagccacagctgtttagttggaaaatgcctggttcccattgaatcaaggcagtcagggaaaagggccacatccggcccagtgtgtctactgcgtacgacgcacacacatgaatcctatttgatcaagacacagttattttggaaataaatagttcctgctggattcaagcacagctcgtgactagcacacacagatgggggtacactgagtgcagatattatctatgagaaactccaatacacagatatttggtaagaaaacttatggcacaggtttttgggctctgttactatctcagttatttctctcctggaacatatgtgggtttggcagtgctgctctttgattagggttgcttggatcaccaagatctgagcatgtccatccagattctttaggtcgagcagcgaatatatgtaaaatgaaatgcaaaattgataagtcaatcttgttttcctttagtatacaatcaacaatatagtagcataatcataacaggaaagttccaggactttctgaacatacgtgaattaggaaaaatcctatatctctatcatcacaatgtacactttccacatattcccatcttttcctttattggcataaacttcttttgtgtcaaaaggacacattttcactacattttccaaataacttttcatcaatccattattttaaaaaaacccactgttggccctgaaattaatctgaaaattaggcagatatttccaatgaattaagtaatcatttatacttaagatttacctactttaaatcatacagaggtttcttattgttaacataatttataaggagtgagtcagtgcttaatccctttaaaggtgtttttagtttgctatccaaaatcaacctgaggagagaacctgtgttttgagaaatcacagacttcacatctgagggttctagaatcctgaggccttgggagaatttcttttacccaattacttgctccagaaatcaggagaggttatggtggaaacagcttcatgaattcaggttctcctcatctttcctctgttgactgccaattccttatttcccataactctttgtatctcagtgcaaaaaaaaaaaaaaaaaaaaaggagagaaagaaaaatggaggaaagatattgcagaagcttctagcctcaaaggatgcattcaattaataaacagtaatctttcaggaaagcaaccctaaatcccctggtcaacaatgtccattctgaccactgcacattgagtgttttagccatcaagctgacctccagggtatctgcagtagcattactgcatgtgcaggagcttctcttcaaacacagcttcctgtgtttgcaaatgtatatgtataatttttttctctgacttcacggacttttatccccgaccctgtattttttttttttaaataaacgtagcttccacgtttttgctgtgtgctttatcttgaaaatcctttttgaaggcctccagcctctcttctcatgcattttcatccccagtctgccctgtttcacctgtgggctttattcactgttcttccttctgttaagccctggtctcttatccaggcataacggagaagcttaaaaatggccataaaaaatgtagtttagaagagatgctttaaagctcaaattgtaaagcccttcagggggcacagatgaatgttaaatgctgggaagcaaacaccagtaatcagagatgtaatcgttcatttttgagcaagtgcattgtgtggcccaagaggaaaaaggcagagctgtaaacggctgcagagtggccacagctgccaatccttgaactttgcaggtgcccagagtgaatgattccaggaactcagctctccttctgcaagaatatcaccagcagaaaagccatgttcacaaatcaagggaacttgaaggattattctagacctaatctccatagtcccctgtggtaggcagaataattcctccttccctacgcccacaaagatgtcttcgtcataatccactgaacctgtaaatacattacttgacaaaagggactttgcagatgtgattaagttaaggagtttgagatgtggagattgtctaggtggacccaatgtaatcccagggggccttagaagggaaaaggggaggaaggaaagtcagagtcggaggaggagatgggacaaaaggttggagtgaaggagccatgagccaaagaactcaggcagtctctcaaagctggcaaaggcaaggaattggattctccccagagcatccagaaggaacacagttctgacaacaccttgattttggcccagtgagacctgtgtgggatttctaacctacacaactgtaagataatacatttgtgttgttttaagccactaaatttgtgataatttgttacagcagccacaggaaactaatacaccccttggcagtgccgagaccagtttttcctcttccctgaattctctgaagtaaatattcacattcccagtgccattgttccctctcaaacatgaacatttacgttctcaatgaaaagaagacagaaattatcacagcatcagtttttgcctccagccaacagtatctcaagagatcaattcctgctggaaatttgagcagattcctttcatagaaagtgtctctcaacagtgtcaagatgaagtttttctttgatttaaatgcattatttgaagttatgtctttgtaaaaatgttttttagaaaaaaacctgtcacaaaacaacactcatgtttaaaaggctaaagatataacaatcatgattgttaaaactttaactagctgtgatttggggataatattgagttagccataatttatcagagggagagactagagtctttgggaaagagagtcaaggacacaaaggttctgtttaaatcaaagggcttgacccaacagccagaaaatggggttctggttgtactgtggagagaaataaatcccgactgtggaaacaaatctaagtgctgtataatgggccatgaaatctattcaatgggagtcagtggctccagaggtgggaacctgctagtgtgtacacaaagaatctgtttcttttcatctcctcatactcaaatggaaatgtggtggtttccaaacttttctgacccaccttaaataatatattttatatcataggccacatatacacatatacaatgtaattaaaacagtattttcatgacatcttacttacccttgcaatgtgagctatattctgatatttcctaattcttcttgttatttttcactgatgttcgttcatttacttatttttcatttttaaaatgctagtcaggatcatttatttatttttcatttttaaaatgctagtcaggatcaactaagtggtcatgacttggagtttaaaaacatagcttcagtaggactattatcaagaaggtaggtattttctttgggttgtagtagtaacagctattcattactacctagtaacttcaaacaaaatgatagcttggaactcaatacctttaaggtctttctaagtctataatttatagtttttcatcaaaagaaatattactttatctaaagtttttttaataaaataaagcaatgactaataacttgaaaccttctctccagcaagtttgtttaatttaaaaaaatggttttactaaaataattctgattccgttttggtcttcaattattagttctaaacaccaaacatgtctttctaatgaaaatcaaattattgaaatttttgccataccttttttgtcacattgttcattggtgtttctgaattttgatttcaggagttggggaactagaatcactcctaagggataaagcattttgagtcacttccagagagtgttttgatttatgctgtagccaatatcatcttgaaattgtcctccccttctcatcactaatattgctgaaggcaggtgaagctagtgtcctaagactcacagagaaactgctcactttcactttgtttttaacaattatgctgcacaacacacttgtcagattcttgcctgtaaaataaaagtgatgctaaactctcagggctgaagaatagctaataaattgtgctaacccttcagagatgcaaaacaatagcaatcactcatcagtttgctgagaggtgacagattccaatttcctatttttccagagacactctcctcattaccaagcaaaaccagaccggttaacttgcccaagatctatagcttgctgcagtgatctcatcggtctgtgtccctgatgggaactcaagcaggtggtgcggagagcagcgagatgacatacggagacagattgccgaaataggctgatccaccaggccaactaattttccttctgagaagagcaattattttaaattgccatatatcaacatgactttgttcttgccactaaaatataacatcaataaactgtaatgtaaatgagtgcctcctgctacattgatttttaaaaattaaagattaaaaaaattaagaagaagaagaagagctcacattgcttcatttagaattaagacaggatcacaattcaaggcattacaacattaagctgggatgtgtaactcacactattttagaagccttttgacaatatcacaaaactactctgtaactttgtttttaaatcgtattaattctgttgaaaagtgttcttttgtgtgagagaacacggtctcttatgatagatacaaaaataaggatgctggaaagtagatgttggatacaagagagattaaaaaaactcacctgcccaatctgtctagaaccagaacttaggctggttcaatcaaatactccttatgaaagaaatgcattcagaattccaaataaggattttgaagaaaaattttaatatctgtatttagatttagtggccctaaagggaaatagggtgttgatttatgaaattgagagaaattatgagcagctggaacattaagggcacattgtcagagggagttttcattgccaatttggaatgaagttccagcatagtccagtgccatgatttaaacacataagatcctagatgccccaatctagttaatttgagcatatgtaatatccaatccttggattatttgattgacagagccattaaagatacagcagttaaagatagatacagaatgtagttaaattttattacattttacagttttttctttagagataactatttttaacttatgatgaatgatttttgaaataaaagacactttaacagaacgactaagtaaaaataaagtctgaaaatctttttattaattctagagagcttgacaatcaaactacaaaactgttcccaaggtaaagtatctaaatgcatataagcttcctcatgtgggctgagcttgcagcagaaacataaaacaagaagaagaacgtctcagggtagacaaagacataattatcttctatattattgaataaacactttactgcataataaatcatcttaacccctttttcttcaaattcggataaaaattgttttcccggcttcttgcaaagagcttccaaataatacatccattcctgatctcttggttttctcccagaaatctttaaatcaaatcaagataagcagtttaaaccattgaattcgttctgttatctttaaggattttctctaacattactcttcatttgtctggacaaacaagttacctggggttgtggaggacctacacaagaggaagatcatttggggtatattagactaccacaagggggagtgagtgccaaatattttcagttgggattttagaaggaaaccatcctgacctatgaagtatttgtattaggaattcaaggaagaatctggtggagaaggtcccttccctggaagaacccaggatttagtaaggaagtaggtaacaaaaattaattacattacaagacaaataatgctgtgggaataaagacttatggaacttagaagacagcttcgctttcattcatatccaatctggctaacacagttcattgcttcaaccgtctcttagcaacataccttaatatccttcgcacccagtccttccaaggcgtcgtccccttccacagcctcctccttccccacatccttttggattaatccaaacaagtgtttccttttgtttggccttccttgagatgctacctgctcctgtctgtgtctcgccgctgctgtttgtttcctgcagcagcacttatcactttctaaaatgaacatctttgttgagttacctgtttattgtccgccttctctctaaaatgtgtgattctggtgaattttattcacttctctgtcctcagtgcctacaaaagcattgactgaatttatgaattcatgcaaactgatatcattttaaatctataggttccaatcccaattgggtccccactgctgttcaacaaacctttagtcaacaaattcctttccttgagttataagaacctccttcaccactgttataaattcacttcagcaaatgatctggtccttcacaccccaatggcagcccctctaaggacctcatgggtttagggatatttagggtactgttcggtctgtctcatagttagcatctctgctgcattaggcaaggtttcccagtctctcttttaaatccttctcctgtggcttacacaaaaccattctctcttggttttcattcctcagacctgctggatcaaaatctccatagacaagacccaagtgtgtatgtgtgtgtgggtgtgtgtgtatttcaaggcagagtcttgctctgtcacttcacccaggctggagtgcagtggcacaatcatggctcattgcagccttgacctgctgggcttaagtgattctcccacctcagcctcccaatagctgggtctacaggcatgatctgccatgcccatctaattttttttatttttatctttttagtagagataaaatctcgctatgttgcccaggctggtctcaaactcttgagctcaagcaatcctcccagctcagcctcccaaagtacaaggattacaggcatgagccactgtgcctggcctgtttggtttttgttttaagagccactgataaacaggtaggactgacaacttcttgtggatttcttctcttctccttttcttgtccagggacagctttaaacttagcaactgggtaaaagccaaggtaaggttatagggggctgggcttgcgggggacagattttgccttaaaactgcctttgcatgacaaacacatctcttttatttggattacacgtttccagatcattacaaatgggaaattttaatcaagatgcccatatacacagcttacataaaggcaattgtaagatgcatgtattcaatatttacatgtttcagaaaatattagttgccatatagaagaatattgctatgccatggtgattatcatttggggggaaatcatttgaagggatgctgcctcagaaggaccaggcgccaaagatgttaaggtatgttgctaagagatggggtgtccccactattgacaccccctcattttcccactctcttagcttcagcttcagcttcctacctagaccccaacgatactcaaatctatgactttaagaacacatagcctctttctccctcaaatgtgaattcctcattctcaatggatgacgaatcttttccaactgatacttaacaggacccattggtatattggggctggtatttttgggggctggtatatttaacaactgttaaataccagccccaatataccactttctctcctaaacttcctttctttcactgagtccagtggactatatttttgatttaaattttttctccatctctccaccatttcttgaatctggataatcaggtcttgtttaaatgattggaattgctttttgacaagccagcctacctccaatacctaaacatgttccatccctccactgacaaactactaaatacttccatagttatctttccaaagagacaatccgattatctccactaccttcccctcttgttttaaaacccttcagtggctctcccattaaggactagagtcatatctccttattcctgcatgcaatgtcctttgtgatcagacctcggctcatttcccaggctcatcaccctcctgtcctccccaggccttagccagctctcattatgtgagagtttgagaagatgtcactaaattgtagcctttcaaatgccttcaactcctaggcatggacttatgcctccaaaaatgcaaagtaataaaatgtggaaaataatcagtttatttttatttgcgggttggttttatttcacatgctaaggttcttctaaatttattctggcttccctgcagcaattctgcccaattccattttacgtgaaataacagcagcaaagttcagaaatactgccaccttgtgatcacagagtaggtgaaaagccaagtggtcctccctttataaacatgtttataaacagaggagctcagaactggagagattccctgaccagtccctctttccaggccttaaaactaacaaccacttgattactgctagaaactcaaaattacaaaactctacctttagggtctactcttagtgactctcttttgtagagttttgttggtttccctcccccagattatttaaagatactgaaggacccacttatttaagccatcttcaggttcaggtcctttgaagcccagagaacttttttaagccttttacttttaggaggtatgtgctccagaccatagctgtcaactgtattaggacagcagtgagttgatgctatttgacaatacaaacccaaaacagggcgtgtaagaagtcctcaagagctgcttattgagagaattaatgaataaacaaatgaacagcagatacgatgacgattttaagagtggagaaaaatgtttctaatatttttgaaagcagtcattttattttgaaatgtcaagtccatcttgaaacattgacatattctatactcttgagctatttaaggtgggtttgaataaaagaataatggaggtgtagagaggcgaagtgacctatgtctagtggcataccaacaataaataggttcagggcaactcagggcattgcaaagatgggtgaggctgaaaggaaatgtaaaacatattcattcaaaccccttttgatactgctttgcaaaaacaggttcatccagttcttcctttctctctctctgtctctctctctttcttgagacaggatcttactctgtcacccagactgaagtgtagtggtgtgatcatgactcactgtagcctcaatctcccaggctcaaacaattctcaggcctcagcctccgcacctggctaatattttgattttttgtaaaaacaggtgcccacgctggctcaaattcctgagctcaagtgatccatgcacctcggcctcccaaagtgctgggattacaggcaagagccacaacacccagccttcttcctctctttggctctattcttaactattatttcatcacatagactagcttattttttaaggtttgttctcagaatgattgttttcaaatgacttagaactggatttctcataagcagcatagtagccactggagacttttgtacacaggtagagaataagctgctttgaaaagtcattggtcattccaaaactcatttgtatcatgagacatcatagaatatatgctttgtaaataatttgtttttcagagtcaataactaattaccagttcatgccctataaataaatccatattggaaattatgtctaagtagattcatcacagaaacgattggccgactgaccaaacagcaaacttcatgatttacttcttggcttagctgctctctttgcatttcttttttaagcagtcctcttcccccatcattattatagtaaagaaggaaaatggacaaggtgaagcaaggctagacaggtgtgaatttaaaaatcactgatcctagaaaatgtttgcagcttttgggttgtaagaaagtgaagtaggcctgacatgctggctcacgcctataatcccagcactttgggaggctcagtcaggaggatcacttgagcctaggagtttgagaccagcctggcaatatacggagatcccatctctactgaaagtacaaataaaaaattagcaagtcatggtagagcatccctgtggtcctagttactcaggaggctgaggtaggaggattgcttgagcccaggaggtcgaggctatagcaagctgtgttcgcaaggaagaagatgaagcaggttctgtgacacagaacagaattcagggcaagtgcagggctgggcagcctcacactgtaattcacactcagggcaataaacagaaaataattttcagaatgaaatcatggcattgatcttgtcatcatctcgagcacttgagattttgaaacaaattaacattgtctccttaaatgcaaggtatccttcttaggctccttaaggaactttgccatttaaaaaagttaagttttcaagataaagagacctactttggtcacagtgaagattatgactagccaattggcaaatgccagaagaaatccatgtgtttcttttcctttcactctgcccatgttccacgtatatcagttccacttagctaagttgtctgctccttttgacttgctggaatatcacaatgcaagtctggtgggcacagaaattctgggatggtgtctagccttaattaaacacccccaactgtggtgcagtcaaaccttgagattttcatgactactgagacctggacaaaaaacaagtattttttgcccagtagagttgaaagccgaaataagcaaacaagaaggaggaaacatataagtaggagattgcaaaggcagagaggtaaagatggcttagctccaggtggtcaatgatgctctatccagatgaggggctttggggcccagagcctgcatgtcctgatgggttttcaattctgagcacaagatattcatctgaaatgttaattttccatgttcagccatttgccatccggataaaattcccagcacagcttctgcacaaactcaggataaggtggcaagctcttaactgccttgactggtaaaccatgtaaataaccccttttcattgtttttttccacaggcaagatagagtagtctttctaatattaacttcagcataaatattgaaactcacataacttgaatattgaaaaaagcttccaaatggtctttgaatttaaatagcaccttgagactcccagcccccagaacagctctaaaattcaaatgactaaccaacttgccattctttgccttctctaatttccatatttctttttttttgtgctaataattagccatctcccacattcttgatcacatgtaaacagtagaccaggcatggtggagagagcagctaattaatatcattcagatggaagggctttcattttctgcctgcttttgggaaattattccctggaagaatttctttgtatggagatattggacaatctcctatgtccatcctgtggacaataggagatgttgtctgggctctgtaacatggatttgatcattccagctgtctgcttttagcagtgtgcgataacacatggtcagatggcttgccctgccctaacatatgcacgatcatggttcaatatcacttcactggagtacccaaatgtttctggtttacctgcaaaaaattcaactttttttaaacaaaattgggaaatagtataggtcttgtacagcattccagtcatgcaccaagcacacaccaagggttgtttagtaggtggccccatgttgggtacagttctctccctaaaactacaggaaaggcactccattctcacacattggatccttcttgcactttcattctcacacataacaaatctcccacaggcagacagttcgcaaagaccatatggatagagaggcattttgtcttatttttaaattttttttttttacaaaactgatatgcagatttaataaactatctaacagtattgtcaagggagttgggcaaaattttcagataattatatttggccccatttcacatgaaaatatcctttatgacttagagtacattcttggtgtatatattttaatgtattactcacattctgccttttaaataaaatatgctgaacttgaagtatccgccatgaatctttgatgtaattaaggatatctgattcttccactccccaatgcccccagggcctgcttaggtatttgaagctgtttcttgctacataaaacatcccagactgattttttgggctgtctttttaagttgtaacatactttgtttcttggagccactcttggtgttttcattgtgttgatttctggtggccttgcttctgaatattttctagattaagccttgcatggctgtgataggtgattattttatacttactagcacacagcaggacatttatacatatccacatttatggctatcttgatagttcattattttacccctaatacatagaaaaatccaagttttgcagaacaaaacttggagatgtgagttctggtggtttcaggctcacttatttgtggccctgtgtgacatgttgggcaggatttaaaacttgtactaataaaatttaaaagagctacaggtcacacacttcaaaaagtagatatgcaaatgacaaggatctaatacattgcatttatacctacaatcacagatgatttaattaatggcaattcaactctcttcaggagccagtgagtaacataaatgtgtgaatgagccaaggttaagacagcagggagtaaatgaaaccaggagtgcgtgcccctcctaataatacagataccttgagaattcgtgctggtcaggcaaacacatctccaagtcaaatatggcctctggagcattgtaattttattttttgggctatctccatcactggtttgcttggttttttttgttttttttttttcttctaagggcaacgtaacatcatttgccctcatatgggcaagatcaactgaagagctttttctttttgaatgttctggtagaattttattatggaagtgatcttcctttgaaagtgtgaaacagtatatagttaacacaatatggtggaagtgctctgataattgttttagttcttctgcagtttgggggatgttcatgacactcagggaggaaggaatatggtgggtgattctgaacaagggccccagagtcagactgcagaggttcacatcccttctcctctagttcccagctggacaatcctggtcacatgtgctctccttcctaagactggggatttcttcatctgtaaagtaggatgggatgccaggcatggtagctcacacctggaatgccagccaaggcgggaggaccacatgaggtcaggagtttgagaccagcctggtcaacaaagtgagaccctgtcgctacaaaaaatatatatattgttttttaattagccagatatgtgtgtgcccacctgtagtcccagctactcaggaggctgaggtggggaggatcactgaaccaggagggccatgactgcagtgagccataatcgcacaactgcactacagcctaggtgacagagtgagacccatctcaggaaaataaaaaaagtatgatgggagcagtgcctacttcacagaattggtctgaggattacatgagacaaaggaagatctcacaacagtgcatggcaaataataaaagctcaacatatgatggttatcaccattatcatcattatagcattatatttgaccttgtaactaatgtgttttctttattccctgtgattctagtattttctagtagcctctgtgatcggcacccaattaatcaaaggcattcattgttcccaggaggaaggtgggtaaaacctacaacaaagacatcaattaaagtgctaaattaatttctgtccctctctaacataaataacaaactagaaagcaaggcattcatttgcaggaggctggctttgttaagagagacaaagagttgtgtttccaaagagctagagagtggagcactggaggctttgggcatgcagtaagtcacagggagagtaagaatgcacacgtgtgtgaacagtttccctctacacggaggacagacagcagccgtccctggagggctggagggaggatggaaaagaaaggagagagcaaaggcatttagacaccaacaaaatggtgactcgctgcccctccccatcccatacctcatccccagcatctacccccagaaagaggcaatattgaacccccaagtttgttttgagtattcaaaagtatggaaaacccgtgccccaattcctgtatagcgctctaggagagcggtttcagagtggacagtgtgataccataaacagtagagaaaaatagctgcttctcagatttcagacataaggaagaacatgcttggatgtctaggtgtgtgtgtgaaggatgagggccccagaaatattttcgtaagtttaaattctgacctgactgtatttcaaaccagaagcgactgagttttgttgaactggcaaggttgtttttctaccactgggccaaaatagggcttgcagtttgattagcataaaaataaaggaagttaccaatctgagtctaatgaatgtttaaaatgcttccccttttattatgatctattcattgatttccaggaaggtgttttttgcttgcttccctgtgctctggattgctggctgctggctctagttattaaggaaacaagatcatgaccctgaaacctttagacactcaaccaactctgtgcatctgttttttctctgccatgatctgctgtctgtattttgcagccacatggaaagagcaatgttttaaaccttcactagtgctgtggatcaattctggcttggattctcatttggaattgattccccttgggcaggaatgtgggtgctatatcactccctgagcatgtcagtaaacatcctccctgtcagcattgctgttcaatcatgtcttgtccagcaccctgcgggtacaagagatcacagagccttacatttggccatttcctaggaagccacacttttatacattaagtcaaattctcaggtatctcttggttttgctctattctcacctctcaagctgacatatattttctaaaattaagtcttccagagacttatctgtaaaaatattttcttaagaaataattttcattttatggaagaagaaatatcaacttagaactactttgtgacagcatccaggctgggtgtgatggctcacgcctgtaatcactttgagtggctgaggcaggaggattgcttgagcccaggagttcaagaccagcctcctaggaaacatagtgaaactctatctctaccaaaaaaaaaaaaaaaaatacaaaaattagctgggtgtggtgacacatgcctgtagtccagctactcagggggctgaggtagcaggatcacttgagcccaggacactgaggctgctgtgagctgtgattgtaccactgcagtccagcctgggcaacagagggagaccctgtctcaaaaattaaaaaaaaaaaacagagtaagatcatccatttttgataggcacatattgactgcttggtcccatagccatgtgggagctaaggctccagttgggggatctgtgctggtagtggcctgagctggatatttcactgatgggtccttatgtaatcatccagtgggttctttctgcccaccgcacagacaaaatcaattcactgagatcatgacattgcagtaaagatggagtttaatccatgggaggccagccaagagggaaacagagctattacttaaatcagtctccctgaagtcttggagttaaggtttttcaaagatagtttggtgggcagggggctggggaataggtgctgctgattggttgaagaagcaatcataggtgtgtggaaaatggtcccatgcactgagtctacctctgaggggggccacaggactgactgagtcatgagggtccatgtggagacagccagtcatcagaaatgcagaaaaaacatctcagaaaaacatctcaaaaggccaatcttaggttctacaaacagtgctgttatctataggaggaattggagaagttacaaaccttgtgacctctagaacaatggtcagttattaattacacctatgtcttctcagaattcaggcccctatctcatggtcctaaccttgtggcttttctttagttttacaaaggcagtttagtattcggaaggattattatcatctttactttaaggttaaactataaattaaattctttccaaaattagcttggcctatgcccagagatgactgaggaaagctctgaagttataagcaagatggaatcaactatgtcagatttctcttgctgtcataattttgcaaaggcggtttcactgttgtctaatacccaggtcctctcaaggtctcagtccagatggatttagaatacaggatcactgcagtccagttctgcttcatcttatcctccaaggcactgagttatttcatgtgcatagggcatcaaagcagcttattaacgtggtgtataagtagaaagaaaagagactaggaaatccagaagaaaatcctgttatatcttttgaaattcgtattcattcccaaacatgaatgccagcatttgctcatgtgctggccaactaatggaaactaaaaatggaataaaaaataacaatgtctaaggctttcagactatcccatatcaacttatcttgaggtagaattttattgttactgacctgctgctcctactagtaccataaactttcagatttaaatttacagaaaacatcaattgcatgattgtcccaaagttcttgtcctctcccattcttgccctctgcaactcttagttgcattcataatgttaacttaccaatttccaaaattccttcttcaattggataggactatatgaaaaaaaaaactaatgtgtaaatatggtgagaaaaatctaaggatgtaagtaaaattcagagaggcaatttcaatgcccctcatacaatgaaaccctttctacctgaaatttctctatccaaatgtgatctgtggacactctccagagcagcctctggagcagcattgaactttctggaatgaaggaaatgttctaaaactgacctgtccaatatagcaaccattagccacatgtggctattaaacacttgaaatgtggctggtgtgagtgaggagctgcttttttatttaatttcaggtaattaaaatttcaatcttttaatttaaatagccatgtatgatatgataagaaatatatattttggtcttctttccccatttcttggcacatagctcttaaaacccttgcaatctctgaagtaatcacgtctttctatacactaatgagatgactggtgtctgggggctctggacagcctcagaatagggggatgggtgccagggaatacaaccacatgattagagagtcggaactttgatctccaatccccccgcctctggaagagaagagggcctgaaggttgagtcgatcccagtgctcaacgatttgattaattacgcccacaagatgaagcttccataaaaacccaaaaggatggggtttgaagcgcttctgggttggtgaatgcctggaggtgctgtgagagagagtggcccagagaggtcatggaagctcctcatcccttctcccataccttgaccaatgtgtctcttccctctggctgtacctaaattgtattctttgtaataaactggtaatcttgtaagtaaactgttttcctgagttccgtgagctgcctttgccagagaggacctgttattattagctaagtcagacggaagttatgggcaacctggggctcactacttgtgattgacatctgaagtgggggactgtcttgggggactgagtccttaacctgtgggatcagatgctatctcctggtagatggtgtcagaattgggttaaattgtaggacatccagttggtgtcctcagagaattggagaattgcttgtcataggaaaaagctctacacattttggtgaccagaagtgttgtggtggtatagaagagaaaatactggttttccccctaaaaccatgaggctagtcgctgccatttttgacagcactactgcagaggattttacttttaaggttagaaagagcaaagctccaagggggtgggagggaagaggccccagcaccaggcctaggcataaggtaagccactacattggaccttgctggtgactctgtttggagcttctgagaatccccaaagctgacactgggagaatggaaatgggctaagatgccctttatgaatctcttccaggctcatgagaattctgctctattcattgtgtaattgtagtttctcccttcctccagacatttttctcgtttggagaagtgttggttgctaggagactgaactgccttttcaaggagagtactttagagagaaacaattcacatgattttcttcttttataaaatgaaaatttgtaaaatatttgcaatgcatagtgaaaaagtcaagcttttacatttctttgtatatttgttttagcaatcatagaaactttcaattacttttcccactgcttcacactgcaagaaagaaaacaaaaactgactgccttttctgtagcatttcttaaggaaaaaataacattccaggcttgtttccagaaatggtgaggtgatatcttatcctgcttacctcacaagggagctgtgagtgagaatcaaaaataatgacatttataatggaaatggaaattgcaaagcactatccaccagaaataaatcagtattgcacccaacagctcatagttttatccaactacttattcttaccatgattttcataaacttacaaaatcatgcagtctgaacacatcatttaacaaataaaagagccacaacttggagaaatgaataggtctcttaggtttctaacttccagacaaagatgccattatactgcaatgacttctcagagaatgtgaacaaaactcctttaaatgttcgactagctcttgtaatcaccatcaacaacatttaaaccttgggtagggagtagtcagcatgaaatgacatttcctctctaactcacctaatacgatgcctggcacacagtaggtgctcattaaagagtagttgttaataatgatggtaatatcctagctaataaggatcttttctttcaaatttcttggcctctgctttaaaaatccagctgtagtaatttttttattgaccaactgcaaaattctttcatgtttgagaaatttgcctatgttaattgacagtttaaagcaaaagagctttctttctttgtatatctgagcagcagaagagccaccaaaaaggagactaggaacaagttattttacaaagaaatattttggccaggcgtggtggctcatgcctgtaatctcaacactttgggaggctaaggcaggaggatcatttgagcctagaagtccaagaccagcctgggtaacataatgagactgtctctacaaaaaacaaacaaacaaaactatctgggcatgttggcacacacctgtagtcccagctacatgggaggctgaggtgggagaaacgcttgagcctgggtatttgaggctgcagtgagccgtgttcacgccactgcactctagcctgggagcctggccaacagagcgagactctgtgtccagaaaaaaaaaagaaggaaagaattcataatgtaagaataatatggttggaagaacctatttgataattatcatagatgctatattttttcaggttatccatggcttttgtggagtccatactccttagaaagagttcagcacaggagagcaccccgtgggtcctcttttgctagatgagctagtattttaaaagtacttagatgtagacaagctcctcagggtgacaactagcttacaaacagcatcccacaagcacacaatgccagtttcatactgccccaatgtctccagacctgcctagggtctcaaccgtgactaggcattagaactacccagtgaactttaaaaaatatgatgtcccagcccagatcaatctgtccctgtttctgggaggggaggcaggtctaggcggcttttaaaactccctgggtggatctaatgtgaagccagagttaagaacgaagtccttaagctgttctgattccaggtttctttgatctaaaccaaacacgtgtaggtccacagcactagctaaaagaactgaaggatcaaaagtttctctgccccatctgaaattgccaacatcagatcctcactgaatctcctgcgctcctatttctgctcctctctctccctctttttctccctgccttactctttccctttgtccctagctttcttctctctcttgctctcatctccttttctgtctgtctccttattctctcagttctgctttgagaaatcttccccctcaataatatgcctttgatccctttcactttcttcctttctgatagtttatctcaggaatccacctttcttatttttcatttattgttcgatttttgtttcatttgtgagccaaactaaaagattgtgtgtgtggtgagggaagagcaggagggctggagggcaatgatccagacatacacataaaaacattgaaaagaaaaaagttcaaaaggaatcaatgccaccaactttcaaagcacttgaaagcagccacaagtcccattccaaatctccctatcctgctctaattagactttcctttccttaatcaccagcattcaagaaaacaaaaaacagaacaacaaaaaaaaccccactattttgtttttaatgtagtttaatgttcttctcttttaattaagggtactacaacaccactgtgctagtcttggctgctttcagtattcagttctccagttcagtggctgaatgcctgccaccatggtggctgtagagagctgcagattgagaaatttaagatcttaaggaaaaactgtttggaggtcatcaagattgagagtaaaaccattagtaatgataagttctataccatgaatttccatttgacatctcttgctctctggaatctcttgaggatctcccacataggccattttagtaaggtgctcataaatctgtttagcattgttgaagataaaacacagaccaaaatgcattggtctctgtgactgtactcccatcccaagtgccccacatattcgacagtttcacccagcgagtgtttgtgcttatctctgcctccgctgtcctcagtcctctgtgctggaattattctccagttgtcacatgtgctccaggaacagccatctgagactgcagctcacattctgcgctcatttttgccatccctgtctatttctcccattacctcatttaaccctggaaagagtgacttaaaacttactcaataaaaagctaattccttgggattgttgtaaatatatacagaaaagacttcggtatgctaggatttatatatatatataaaagaaaaaaggggaagagtcagactggttcagattccctgggcttttgccaactgacctaggaacccagacacaagaatgggaatgtttctggaaaatgcttcctgagttccaaacaaccaacttacagcaaatatggggcataaagtcagcatacagctattcagtcaataattgctgttctgagagttgtgaattgaggactgcctaaggtgatgggaatccaagcgtgctgtttgaataaataagacaattttggcttgtaaagccttcttagcctgtgggggatgcttaaatggtgctggctaagattatttggagaatcaacactgacggccttggggatgagagaagtcaaaggaggaccacaccagggaagtggatgggttccaacagtttccacctccctggtgtgggtccttgctgctgctgtcaccctgtctcagacttccttgttgccaacaaaaactaataataacctgactcctttcaggaaaccaaagataaaggaaaacaaataaagcaggattcaatgagctaaggatcaatcgtttaagaacaataatctttcaaaccaactagctaataatagatgcaacaaataaaaaataagcaaacatgatgaaaaaagcaaaagtaatattaaaagagctcaaagaataactgaaagaataaaattttaaataattcagagtacatttaaataaaaatactgtaaagaataattagtatggtgaaataaacaaatctttattaaatacctattttttctttctttttttttttttttgagacggaggtcacccaggctggggtacagtggtgtgatctcggctctctgcaacctctgtctcccaggtttaaccaattttcttgcctcagcctcctgagtagctgggactacaggcatgagcaaccatgcctgggtaatttttttttttgcatttttagtagagatggggtttcaccatgttagtcaggctggtctcaaactcctgacctcaaatgatccacctgcctcggccacccagagtgctgggattacaggtgtgagccaccgcacctggccaaatacctaatattttaaaaggcaaaatattctacataaattcaaactctgttaatgggtattgtgccagaaataggctatcagtgtaaatatgagctactaaatgcttattcatttgttcaccagcacatatcaaggaaacattagtcagccagctgaattatgaaaattctctccctataattaaattatcatagtactaattaaaacaagtgtatactttttatacctgcatgtccttaaacaaatgtccacttctatctagtcaaacactaaatgaatgtattgtaaacattgcatgaattctaaatcccaaagaccaatgcacagaacaatttcattttgcttttcaagatagcaaaaagactgagaataagtctcgctcacccatatgaatttcctatgcaggcattattcccgggttatctagagttgaattgttaatgctatttaattttaatagccttctcaattttaaatcctacttgcagaatgtgtactccatttatgctatttcatgcttgacttgtctacatatctggggaaaatttttattttgatttgggttcagaatcaaaaaaaaaaaattcgcaacttggaaacgactaatatctgaaagcacgaccaaataaatcttctctcattcacagcacccaggaaagccaagattggcatgaatgaatatgctttccaagccctggcttttcttgggatcaagaagattttgccttgtatttttgcatgtacagaaataagaacaaaaagcacaaatatatattcgatttttgcactaagttttgggctgcttatacaacttagaaatatttctctatgtatccatctttctattttcaggtagagtccaatgccatgaaaggagctacgctgagtggaagaacatcaactatgtttttaatggtcattaaatgaagtctcaaaagtgaagatatccaatcaagtccaatccctggaacaatgtagaaaagatggacctaagaaaccaaaattgaaatgtctttttcatggatttagtgcagattccctttaagaaattgataaatttcactgtggactggttgctaggatacccctcaaaatctattaaagtaagctctttcctttaaaggactgggcagggtttccattatttcaaaatgactttgaaaatcatgctgggtgttccatctaagtgaatgaaacaggtaaatgaatggcccttaagaaaaataaatgaccatgaaggatctaaaaaataattaggctgtctcataatgatacatttaaaagttagctttgtcaaggagattcagattttcaaacctgaaaggaagaaataaaaatcaaatgtgaaatggaaaatgtgaagttccttgggggtagttaaaggcctactgttgtagaaagcaagggacagagtttacatttagagtgggcatgttgtttgacacttatcatcttaaatgtcatttttctctggaacaaaaagtagcatgggtacttaaaatgtttcacattttgaatttctgtcaattagtgaaaacttggtaagcgctcttacaggaatgttcatatccagttctgttacaaggaaggcaggctggggtaaaaaagatgaatgagttctagaaaggaaactagaagcctgactcctgaactgaggacacagagtgaatgttctttgatattttgatattcacatctctggaaactcattacatatggctgttttccttatctcttttcgtcaactatggataaaaaattctgaaatcaagagtgatcctgtatcaccaaaaatgggaactttgatgtcaatactacctaaagtgatctacaaatttaatgcaatccctatcaaaatcccaatgtttttgcttaagcagaaaaaaatccatcctaagactcatgtggaatctcaagggacccagaatagccaaaacaatcttaaaaagaacaacttcagaggtttcacacttcccagtatcaaaatgtattacaaagatatagtaatcaaaatagtgtgatactggcataaagggacatatagaccaatggaacagaatagaaagcctagaaataaattatccatatgtggtcaaatgattttcaacaaggctgccaagaccagtaaatggggaaaggacagtcttttcaacaaatggtgttgggaaaaccagatatccccatgcgaaagaataaagttggacccgtaggtaacaccatatacaaaaattaactcaaaatggattaaaaacttaaactgaagagctaaaactataaaactcttagaagacaacatcggagaaaagcttcatgacactggatttggccatgatttcttgcacctgacaccaaaagcacaggcaacaaaagtacaaatagataaattggactacataaaaattaatcattgtacatcaaaagacacaataaacggaatgaaatggcaacggatggaaaaaaatatttgcaaatcatatatctggtaagggtttaatatccagaatagataagagctcctacaacttaacaattaaaaaaaaaccaaacaacatgatttaaaaacggacaaaggacttcaatacagatttctccaaagaagacatacaaatggacaataagcacatacaaatatgctcagcactactaaacaccagggaaatgcaaattaaaaccatgagataccatctcataccgactaggatggctactatcaaggggaaaacaacaacaacaaccaaaagcaaacaggaggtgcagcacgtgggagttgctaccggagcagaatccaggttggagttggaaccctggagatgccgaaggaaacccgtcttccctaccgccccctaacgcaccggcctgcttggaacgcagttggaggctgcgcggtaccagtcccatgggggcttctgctccgggtcctccagtctcagtggtcgctgctgagccggctccctctgacttttttttttagacggagtctcgctctgtcgtccatgctgcagtgcagtggcgcgatctcggctcactgcaagctccgcctccggggttcacgccattctcctgcctcagcctcccgagtagctgggactacaggcgcctgccaccacctggctaattttttgtgtgtgtttttaatagagacggggtttcaccgtgttagccaggatggtgtcgacctcctgaccttgtgatccgcccgtctcggcctcccaaagtgctgggattataggcgtgagccaccgcgcccggtcccctctgcctttttaaggacccctgtgccacccccaaagaaggcttctgctctgctggagcccagatggaggctggagtggctgacctcacttgtggggaggagagaggtatcacagcggcttctgattcaagtgctggtgaattgtgggaggtggatgagaacgagccacttaccgtcagcaagttctgcaagtatgagcatggagacactgtgtctaccctcagtgttctcggctgtcagcggcagcaaagacttcagcatcaaggattgggaccttgctctgcaggtggcactgaattcataccgatctcatgctgggcaggtcacctgtgctgctgcctctccccgcaaggactctgtgtttctttcctgcagtgagaacagtagaattttattctgggatactctctgaccaagccgacgtcacaggtgggctgcagtgcctctggctgccttcccacctcactggcttggcatcctcagcaaagtgaagtcttcatctttgtgatgggaatgggacagtctcccttgtggacaccaagagagggagaggtgcccttggctcagctgtacaagaccaatgtgtcattgggctggtgttttcctcacaccgtgttcccttcccggcctcttacagcgaagatggctcactggctgtgctggactccagcctttctgaggtgtttagaagccgaggccactgtgaccttgcgagagatgctgcttgatcccccctcaatcactttctgcttaccacaatgggctgggaccatcaggtcgtctgccacaagtgcccacagaacctctcccagcccctggacctgaaagcgttgctgagtagattggacttaagacaaacagcaagtcccccatgagagtccacttctttgcccctgttccctcagcttgtgagataacacaggagccttctgtagtatgttgaaacattagatctgtgccattaattggcatcgtctcgcagcctgaaggaggctggatgctgggatcctgtagtcacaggaaagaaaagctttcttaaaaatgggcatgcaggttcgtcttgagtgtgtgtgtgtaggttttggtagggaggtgggacggtgggggagggatttaaaaaaaatctatcccacatctcccctgaacaccatctctccctcactccccaaaaaagttgacaaaagggttttattcttcccatgtagctgtctgaggaattgaccatatctgggtggggtatggaatgtgggcatccctaggttcctggaagcagctcttatgctactcatagagatgggactgattttattttttatagcgcttaattcaccgttatgggaaatgcttccaatcacaaaaattcagcccagctcgttttgaggaagaggcaggacatgttatagttttatacaactcatttccattaaactgaatcagaagtcctttttctggatgaattaaaaatgtggcctgtgcctgtgtaatgtccactcctttctgccaactcccttccctctgctccctgctggtgttgtgtatatgaaagaggagtgtttttctgtcatagatgccctagaggaaattttgtggatgttggagagcttaaaggcatttcaattgttagaaaactgacacagactgttacagaggaatctttgccacttttcccacccaaaaccagcctggggcctgacctcttctgctctcagcccctttctctgcatatagaaagtctaaatgcagtatgtgtagacttttaaagttttaaaattcagcctcaggaagaaaatcagaaatactggctggtgaaataaacagtttaggcatcttgtaagcctgccttttttgaaaaacaacaaaacaaagtaagtgttggtgaggatgtggaaaaattggaacccttgtgcactgttgatgggaatcaaaaatggtgcagtcattatggaaaacaatatgacaattcctcaaaaaatgaaaaatacaattaccatgtgatccggcaattcaatttctggatacacatccaaaaaaatgaaagtaagatctcaaagagatatttgtatacccatgtttagagcagcattattcacaacggtcaaaaggtggcagctccccgagtgtccattgacacatgagtggatgaataaaaaggtggtatatacataaaatggaatattattcagccttaaaaggaaaggaaattctgacatgggctacaacatggatgaaccttgaggacaccatgctgagtgaaataggctagctgtaaaaagataaatgcaattccactcatatgaggaacctagagtaatcaaattcataaagacagaaagtaaacaggtggtttcctggagctgcgaggaaaggggaacgggggtttattgtttaattggtgcagagtttcagttttgcagatgaaaagcattctcaggattgattgcacaacaatgcaaatgtacacagcactactgatgtgtataattaaaaatggttatgataaattctatgtgtatttcaccacaatttaaaaaaaaatacatgaaaattctttggaaagtataagatattacagacaagaggcctcaattattgaaaaaaaagatgaaacactgtcctgaatttcccaaggggaacaaaatcttgagcatgtcacctttgaaagcatcatcctgatccatgtgtactaaaccaagtctagtgtgatataaagttccataggctgcatgtggcattatgtgctacccttcaaaattgatttcaatccaagaaagagaacaaatctcgattcccaagtctttccacaacttgcttgcttttcaaacataaatcatacatattaaatctaaccattgtctataaaaagccaaccacacatttaaaatgtgttactggtaatagagcagcttgaggaggaagaggatgagggaactgaaggcaaggggagggaggtctgtggagagggtggggtggaacctgccaggctctgggaagatcaaggacattgacaaaaaagaacagatttatcatcacagaaaagatgagggtaaaaaaacaacaaacaaacaaaacaggttacaggacaggacataagggcagaccaaccgtttaaggaaaataagtctcattagagggttagaagcattaaaaaacttttttcactttgtcctctgaggagaatatttctgaaatttctgcttatggttatataaaatcgggctgaggattttttaaaacgtaaagttggtagcagactttggatattttcatctatatttgtttttctgcctttaataaaatagtgtgtatgtttcatttcagaagctatcaaagaccacattttgattggtccacacaatcaaaccagaagaatgttccagtttattgaatttgtctccttatttaagaaaaagaaaattaagccaggagaagttagcgctccatccaccagctgggtctttgatgaagggaagtgaaatgaggattctgcacaggtgggcggtagctggtggagtgagcgccctgcaggtgcaagtcatgacaacaaatggggagggatgctgtgaagacattgccccattgtgttaggagaattcccagacaccccattccactcctccagctctctccaggatggaagaatggggaactatgaggcgtatgcaccatccaggaagaatcctaagtcacatttaccctgaaaagcatgcttctgtccatgaatgtcttccaccctgtggctggggcttgggggcgggtagggaacagtgtggctggtgatatttatgcttttcttcatttaccaaatatcttgtaaatggaactctttcttttttataagtcagtgttaatgagtgtagacctcagagatttaaaatgaactatctgcaaatctgtgacattacactagaataaatgttttattaccccctcaaatccaagtctctcttaaaagatgttgaacagaaagtacttaaaggaatatcttacatttttcatccatagttcaagttaaatgatagggtaatactaacacattagctgtcctttatacatattaatcaataatgcagttttattatcaataattgatttaagtctcagtagtggacaattttaaaacagtctaaatgtgaaagttcagcattctaatcgttcacagacaagcaagttagtgtgaatatatgacactatgtaaatgacaatatatacatccaagtttaagtttacagtccaatataaggttacaattatgtcaagtcttagaagaatttttttcatagatacggacttctaacctatgtatatcactcttctgttactatacttgataaaatacattttgctagctagaatagacttatacttagaaagttccatttacagttacacaatttaataaagtttgattaaatgaactggcaaaatctgtaatgttacaaagtaataaaatgtaaaactaaaactatggcacatctgaaaatcaagaatgacttgtttggcccacattacaattcctgtatactagaataataatatatgttatgtcataatttttcataaatgatttttcaaaattcagcaataattttaaataaatgtgtgcatatatatacgttttgcatatagttacacaggtttcccaactgaaataactaagagaaataaaaacagagaaaaacctgcctctgtgctggaaggagggaagggtgacctgtcaataagtgtttgttgaatgagtgaatgaatcatgcaaaattctaatatcttattaaaataggagataacctgccatagctaggacccagaaataaagaaaacagagttactttcattgtatctggggatcatcccttagctatttctctcagtattttgaacctatgttaataatggatatcaaatttttcaaacaccagcagaggacaaggaagagctaacattctgaccccagtgaaagtggactctggtactttcatttagtcacaggctcgctcagggagtcttgtttcttattcctcactaatagtcccagtcatacaagcacttgagattattttggctccatcctacttccctgtagctactatggcctcccactctctcatggacattcatcgtattttgctcttgcaacattccctctcttggccacactccaatgcaaatgatttactgtaatatgtctccaccttcacaccttgtgagaatgaaatgaaaaatcctacaattaattcctaaggaaaacagtaccttctaatgccaccaaaggtattggaagcaattattattaattaataatataattattattaattgcaattgtcgttgcaaacagcttccaagagggtggtagacagccaagactttttattcaaatagctgttttcattcataaagcaatctactaaatgataatgtcatgctttttggcaacatccgtatttatgggttctccttttaagaattttctcttacatttggcatgctcagtacaggacaatacttcttaggaagtttgatggatatttttcttttgtacttttttaatcaacagaaactacactgattttgatttgcttaaacaaaaattttttttcatattaacagtcattttaccatagtgttagaagacaccatggtggaggtacttgcagtgagataacatcctgcatattaatccttgtgtttttctctcctccacttcctgactcttcccttcatcagctggaggcaatcacgttgcctgggagagaattaagattgttaaagcaggaatttaaggagaaaggaactattttaatattatttttgaagtagaaactagggttttaagattcaaaaagagaagctccaaggagaccagagcagagagtttataacctcttcaaaaagaaagagtcagccaagagtcagctccaccccttggaaacatcaagaagcccagccaacacctacagaccatcccttgccattcctgtgagctcatcatcatgcccctggcagaaaagctacaagtttcttcttgtgactttcctatgaatgccttcctcgcgttgttgcctatacatggaccgttgctcattcaacaaaagccaacttctcaccattccttcgccttctctcctgccctgagactttgatgagctcccatctgaattgccatggatatgtacccacttctggaggcactcaaaagcaagtcccctggatctgttaaaaaacaatgtggctgcctataaaatataaaagtcaaaacaacagtagcttaaggaagatagaagtttatttctctatgatgtaattgatatctaaagatgagcagtctagacttggaatagcagcactgtattcataatgacctcaggctgcttctgtatccctgctacattatcctaatgctggcttccattttcaggatcacctcttgtcctaagatggtgggacaagctgtcacatttatatgctccagctatcacatttgctttcctgacaggagaaagggtgaatgcccacatctcccagctgagtcaacaactttaaacaaactttctgaaagtcccacacaacatttctgattaaatctcactggctaggacttgccttcatagccacacataactgaataaaagtctgagaaatgtagcattttatgtggatgcatcccctacaccttccccactgacccctgccaaaaaataaaaataaaataaaataaagtgaaagaggagaatgcttattggaaattaactcaccctaccatatgcccctttcctaaaaaaaaaaaaaaaaaaaaaaaaacaaaaacagagctgggtctttgaagagagttgatgtggaattaattcacaggtacatatctgggggaggactgggtagtggggaaaaataatccttgtttcatgagaaatatatagataaataaccaagtaattaaggttccattaagatttttaaatggcaattaacaaagccaaatatttcaagtgtgttatatataatacaattatctatgttacatataaagatgaagatgattatataaaatataaattatattaaaaataaacatacagtaaattatgcataatatatagatatgccatccaaggcatttatgttattttctccttgaatgatcaacatgacattcaccagaaactggatatgtctagagacatcttgatttgcacctaaaacatgaagagccgctttaccaaaggccttgggagagacaggtgtcctagagtctagaactaattcagcagctcaggatagaaaggagagcaaagaacctgtgacaccataaaaaacttcagcagcagtaaccaaccatgatggcaattaacataaccagcaaaataatagctaatattcgtagagtgtttactatttggtaggccctgcaatgactttactctttaataggcacaacaactcgatgagactagaactattatcactcgttttcaccagtgagaaaactgaggaacagaaaaatgcagtcactgaagtcacttgtagacaagcgcattgcacaattaatcagcgtcagagccaagaataaaaccagggttttattctgctctgaactataccttctcctcttccagaagtgcagacatctgatcagaagaaaagatcacatgatatcacagaatcatcaggatggtgctgaagatgaacaaactgaaatgtctgaaagtttttaagaaattcataggctgtcttttaagtatgatgttagagacgccaaccaaatattgctcttctcaggggtgggtcatttcaatttcattttcagaaatttccagttgatacttatcaccacaaatgaaagctataaagaaagactacttgaaatgcatgtcagtccttttctttaataaatttggtttatggtgaagccacaagacaaaatatgtttatccccaggaggtataaacaactcagtgcaggttataggaatctcagttttgtatccaaacaggtgaaacatttttaccactgaccttcagaccatcctcacttatctgaatttctgaatttcagacagaaattaagcaaggatgtaatgcatactctatttacttatattatttatatatttcagagctaaattttttagaaatgcaaacactatctttgtttgtgagacagggtctcactctgttgttgactgcactggagtgcagtggttccatcagggctcactgaagcctcgacctcccaggctccagtgatcctcccacctcagcctctcaagtagctgggactacaggcttgtgctaacatgcttagctaattttttaaaaaataaattgtagagactgggtctcactatgttgcccagtctggtcttgaactcctggggccaagcaatcctcctgccttggtctcccaaattgtggggattacaggcgcaagccatcatgcccagctgacactatcttttaaccataagctacttaaaaaaaagagcagtagagggtacagtttgttcaaagaagaaaattttactttttgaaaaattgaacagtacaaatgctgtgagattgtaacccgcactttctaaattcagcttaatcacatcatagtatcttccaaatctatgagtttgctgttaaatattaattacattttaaattcataaatgtacaaattaaccttgttaaaattacttctgaaatcccattgtttaataattcattcaataatatgcttttgttacaaaagtttaaaaattcaaatcagatcactgaaggtgattcttccaatttcctaattattaaaatttctgacttcagttatctaacaaaacaataccagccaacacattggtgataaaatagacctgttattttgcagcttacattctattgggtgaaacaaacaataaaaaataataatcgagaaaaatagagcagaaataggcgatagctagggtgtactatgtgatttagataggagggtcacaattttaaatcaagcggaaagcacacccattccccccattctaaggcagagtagtccaataaacttcagtttttacaaaattaaactataatttatgactcttaggtatcaatatttctatttgatatgttaattagctaacaaattattctcaaggaaagaaagacagaaattctccatgagaattctgattttcagctttgtaaattctcctaaagaagtttcaggagaaacttcctctgaccaagttaagaaagaagagccgtatttaatcaaagtatctatctactgctgtgttaataagtttcttaaccaagaataaatttcaaattacatggagaatcgctggaacccaggaagcagagggtacagtgagtcacgattgtgccactgcattccagcctgggcaacagagcaagactctgtctcaaaaaaaaaaaaaaaaaaaaaaaaatatatatatatatatatatatatacacacacacacacatatgcttttttctatgtatagaaacccttctttggcatctatgaagatgctcatattttctaccttatctaaatcaatatagctaattatcaatatagctaattaacttaattagctatattaatagtaaaccatccttgcattcttagaataatctccacttgggtatgtggcttgattcttttattaaactttcctaataatatttgcatccataagtgagatgaaatcacaatttatttgttctttattggatttaggtgtctttgttatagtaacatttaaaaacacacaaaagatttccttgtttatcaaggtcctaggaaaaatttcaagtgcatttaaattatgttaggattcaattctgaagttcttcaggtttagtgatgtatgtgttagtggtggtagaggtggctgtctttgacaacttcatttttttatggcaattaatttgtttatgttttctgtatccttttgaaatagccataggctatttttttctttaatcattttgtttggcaaatggcatggaattggacagagctcttttagttattacttccctcctccctttgtttctattatttatatttctgtttaattggcttatctagttttatctatttttgtaccaaaaaaatcagtatttattatttttccttattaacttaccaattccttttttcaaaagaaaaatgtttaacacattttcattattttttttttttgcaattggttgaaaaaatgtaaagtgaggaaatagaaataagtttatcaaaaactctaagagtttggctgtaagagtagagaaatgggtgtattcctagagggaaacaataggtttagtgttttttttttctaagaagcagtattgcaacctatttgttgatgacactcatttagggcagagggaagaaattcatggtacaggagagaaagagtttaatcatgggagcaaggtccttgagtgggcaagagtgtatggcaacaactgcacagagggaattgttgtgaggcagattgctcatcctctgtaacagcaggcagaaggcattaactatggaaatgtgtatttggtcattattgatggcccacttgagatatgtggttatagaccaagaatgagtccagtcagtggagctgtttttctttggtaacattttatagcttgactacactcaagctgtacggaatgggcagtggaaaagatttgagcttaaccctggttggatgtctgtcaggtaagtaaaagggcacatgcatgaaattctgcatctttcatagggttcacaaacacattatggtatatgaattaatgcaacagaggattcaagaacactgtaatacagggcagcatggagcagggaaagagatttttttttaatgcttttcagaatttgatacgtatacctaacttgaacacaatagttgaagctttgccagacaggtcggtaggggctttctcatctccttgtactagtaatttcttcttggcctttagagatggaacagcatccacctctgatttttcttgttagaaggcatatcagaatctctcaggaatgcaagtgtagtgttcttttttctttatttaagtttacgaaatacatgcttatagaaaattaaaacattatagaaatatgtaaagccacccatgaaagttcttccataattctgcttcctaacaaagccactgttagtaatgtggtgttacttatattttagagcatcaagttgtccacaaaaatgcttgcacaacttttttttttacccaagtttagaaatcttgccctaataatccagacattcctcactctcttaacgaatacttagaaacaaattgcataaaggtaccatctattaaaccagtcccttactgacagggcatttgggctagttttaagtattaaagaacaaaggtgcaatgactttgcttgtgtacacttgtcagatcattcccattaggcagtttcctaggaatgaacttagtaggccaaaaggttcaaagtttcaataaatcccagaaaactacattcctaaaggctgtgacaattatactcccacctatggcatacaagatgggtaatgtaattggaagtgcttgttcaaaatcatggtgcaattttttaatttggaaaatttaaaaaattgactgttcttataactgtgttttctaattatagaaggtgaagtctgacaaatcttgattaatggggaatcaggatcccagggcaggatttataaaacttgtatttaccaaaaagaggcatcagtattagaaactttaaaacttctctttaaaatctccgcaagattgcagcccttgctacagctttaaatagctgcactggtatctccagttattttccccaagtttcaataccagtattggtatcctactagttgaggaataaaatccatacttatatgagctttccccagaacaagccagctttagtcccattattcgacagtagcagaacattctttgtcccagaacacaccgcacactttcttgtgcctggtttcatcactttatgcctcatctcttttccttctttgtcttccttcacttcaaggtaatctccaatgccacttactctatgaagtcttccacaatccttcctgagaaaaataaatggtcttatcccttctgttcccccagcatttcacctgcacctctgttacagaatttctatactaagctaccaaactggaagtcttagaggatagacacatcttacttgtctatttcctgaacagtatctagtgcagaactttgtagaacatacactcaaaaactgtttttggaataaacatacataaattaagacttcaaatcttttaatctcaaattattagtcacagatgttattttttaaaggactaaaaaaaaactactgctccttcaaatgtcctaattatcggtttcatacattttttttaaaaaagggggttttctaataagactgtcaaaatattacatctagaatagttatgttcaataaacctgcatttacttgatatctgcatcttcctagtatcacaaattgttttagaaataaaaacacaggggtaggggacaggggacagtttattgtaaaatatgaagcagcaatgattgaagcaagtgaatttctcctttatattcccagccagagcacaaaatgactggatatcctcatgaacgccaagcttttttttttttaattaaaaagaaaaaaaaagagagagaaaaaattccacattcattaaaatctctttctcttgataatttctggtttccagctgactggatgagtttcttctgtctaaaaatagaaaagtgagttaaaataaagtattattagtttgcttcatgtctaataggcttcctttctaacaaaaataaggtatctaacattattcattggctttatacacttagttctttgacagttttaggaagagttgataaacttctggcattatccaagtctaataacagatggatggattcattatgtttagtttgtagttttccatctaaaataacatttctacttggatattctactaacaccaaagcttatgattctcgaattaatttacatagcaatctatttatttgctgttattcttggtgcaacatttcccagcaactataacaaaggaagttgggataaaattaaagccatccatggattcactggcatcagtgaaacaatatagaaatatataaatggacactattcaagaagacagatatcttaaatactataaagattatttttccttctgataattaaatgagaatatgctgccaaattggtatagctgttttacttaacgaatgtgaaacacagaacttacggctgtgtcatcctctctgtatactttaatggttttatcagcttcagctgttagtaatcgactttcagactgatcaaaagcacaagcaaatattcctgattcactgtccaaagacccaggttgcacagctgcgtgaactctctgaaaattgtagccagttctccagtcccaaagatgcatggtgccattgtcagcttaaagggaaaaatctagttacacctggtatcccctcagcagtacagcttgacaaacatttatgaagcatcattagcccaagcatgggaatactacggttataaaaatacataagacacaggcactccaccttctcttaatattggtttgtctactttcatttgggctgggttcagaacttatagatcttaaaaagcacctgaaaatctgacatccaattccagaataataaacaaaattttaagcaattcccagcataaatccctgagattcattagatgggaactcaaagaggactaagctatgaaatatactacatgtaatatgaatatgcatgaacacacataataacatgcaaatatgccctaaccaggcaagtgctgctataatacttaagtgtgacagcttagaagcattacaaatgtttattcatcattaaaagaaaaaataacagactaaacatatttattataaaaatcttattttacctccagatacaagcactccatcagaatttaccgtcaatgtgttaataatagcattatgaccggaaagattttgaatgaaacttccatcagggaatttccactgctttatgttatctggagaaccagatgcaaatgtgtaactgaaataatattaaaaagaattaacgacaaagtaaaccaagttaaataaagtggtgggttttaaaaagtttatttcagttatattttgcagtgtgtactcaatgatttatatattcagcaaaatagtcgtatcaaaatgtaaaaatattaagacatttgttcaaggttaaatcagaccttcacatttttaacagtatattttaagtcctagattaatgttttgttctcctttcatttccttaatgctctgcactaagccagagcaataaatgtgcagaagccctatttcacatgaagggcaatgtgttatgcaactcttttggagggagggagagcaagacaggacaggaagaaagagagaaaaggaatagagggcaagaggaagagagagaacaggagggaggagaggcgaaatgggagtgagaaagataagcaaaggaaggaagaagagagggggaaaagggtatggagagtagaagacagagaagaggaaaggaaggagaggaagaatccagaaaagtgtcagagtgatctgatacaccaaacaatagttgtgatattatgctccacctttttggatactctgactgtaatgttcacggttcttattatttctgtttctacatatattaacttcctccttaagaattaaactattcaatgaatgtctcagtgtccaaaatcatttatgtccaaaacattaagcctagccactaatatcttttattttgacatgcagcatttaatcatgatttacactgtctcatttgacattatttatttgttatcaagtagaaggctttcctcatgttttatagggcatgaagcaaaatagtgcatgaggaaaataaaagaaacacacgttcctatgcggcacaggcctagaaatgacagcagctaaatgactgccaaaagcagtgctaacaccactagcatttcagcattatcttaagaactgaagaaaaacaagaagctaattaggaaaatacacttactgtcttggatgtaaaaccacagccctaactgattttttgtgatttgttaatgtcactcttgtttttccagccaccagatcccataatcgaattgtagtatcatggcttcctgtaatggaaacacatatatccctcaaaacatagaccaggaaaaataatgcaaaagttaaataaaatacaaagcattcttccaaaacacatatgttctaaatgaaagtcatatcacacgcaaattagtcttggctaatttcttcatagttccaaatttttaggttgattttaattctttaaaaaaatgcaatacaacaattgattcactgtcaattgaacagctaaaacaaatgcaaataacaaataaatatataattgtataccctagtgaaaaggaaaaaacttcaatgatttttttaagttaataaaatacatcaggcaaaggaattattttctagtattaaagatccattgttactaactttatttagagcaaagtaagattcaaatcagttctaaagattactagtctcaagatgttttgtcttctaacttcaatttcttagaaaaataattttgacactataaaataataattgttcataacacagtattctagtcagacattacaggatactatgtatggcatactctatgatatgtaaaaagcatgaggtaaaaacagtggaatgaaatttcatttgaatacatttcaattgtccatgattaaaatatgacacagaaacactgtaaacacaatacagagcaagagtcatcatgaatattaaaagtatatgtataataacatggattctgacatgaatattctgtaaacttgaaaagtatcgatcatacctgtaataatttgtggttctgcagcctgacatctcactgtagcaactgcatttgtatgtccagataatgtgtgtacactggctttagttctcacatcccaaatctataaaaacacaatagacatattaggaaagagaataggtattcattatctcaagaagataactggatcaattcaaggctgaaaatttactacataactagtgcctgaatataataaagaaaatgcttaagtgaaagataatgatttacaaactggaggacgaatataaataggagacaacttgcaagaattctaaaaagctaaaagatcagggtactgaaaatctaagaatgagtatgatgggactactttttaagactactgaatgaaagaactaatggacaatagttgttacagaatggaacgtgagaatatcacatttcaggggcagggcactaataacactaacatggtgaggccatacaactgaagactaaggtggaaaaaaatgcaagttaagaaacttagggactaggatattgatgactcaagacagctatctttaattctctatcaatcaattgaagacactgaaaccgaaagtgcaccctacaagatgcaatatatttacagataaatacacaactctatcccatttacccgtgcagttgaatctcgactacaggttaccaacacatcgattgtcgggtgcaaatccaaaccatacactgcacttaaatgtccatgataatgccgtataacctaaagacaaagcaggaaagttaaaacttctagaattagaaagataaatagtagttcacaatgttttaaatccttaactccaaacttaccttattgtattcgagatcccagcatttcacttgtttgtcttctccacaagagaacagatatgggctccttgtgcttactatcacgccccgcacagtactaatatgcccagtcaatgacagttttaatttgccactagccaagtcccagatctgcaatcaaagaatatttatttttttctttcactggttactgcaaaacaaaattttagaaacctgattattaaaactgagctttcaaagacaaaaggaaaaagataacaaatacgtaaaaataaaaaattttgcaaaatgactcccctccaaataaaagcaagaaaaaaactggcatgctcaaactggaaaaatatttgcaattagatgacaaaaggttaaccttcttgttatataaatgatatctttgataataacagtaagaaaagtatggtattaaattaactgaggctggcaacaacttaaagaaatcctaaaagcagcaaatacagatatgaaaaagttcacactcattagaaatttcatacaaagttttttaaaaagattaagtatccatttttgcttaccatattagatatttgtaaaggaatgtacaaccaatgtgctgaaaaggatcctctcatacactgcaagtatcgattcacccatttggaaagtaatttgtactttgggtatcagcttcaaaaatatttgacccatttattccatttatggaactctaccataacaaaataatttaaaatacagaaaaagtcttatatacaaaacttaacagcattacttgtaatggtgaaaatcagactaaaaactctactgtccagtaataggaaaacagattacagactatctaaatgatataatattatgcaaccactttaaaagatggtaaatttttcacaggaatatgcctttgatacaacgttaagtgaaaaaagcaagatacaaaattacatactaagaatgattttttaaaagatacacacacaggaaaagagcttagaagtgaaggtattgatacttacagaaataaatactaaaacgaaacttatccaaatatctaacaatggtaggattatatacaggtctatgtactttcctaattctctatattttccacattttctatgaatgagcatgctcttaattttgtaaccagttggagagaacaatgtaagtataaaggaattagtggtaggtattcagtaggtaaagaaaaagtggtttaaatagcacttttcaaacagatatttatttagaacacttattagtataaatgataaattttactccttattcaggtctaaaataacagaggaactgcaatagcaattcctgccacaggaaataataactgattaaacttacatgacaaacacaaagtcatgtttattttttcttccttcattattacctttatagttctgtcagcagatccagtaacaaaccactgatttccaggttccacagcaatacatcgaacccagccaagatgcccactgataacctgtataaaacaaagtagaatgggcaggccaacgtagaagttaaaatgtatttaagtttaactgcagcccgagtttgaattgccctcccatcttcaaatcataaaagataatgactattacattttacaataatatgaaattatcttcagtgagttaatagttaacacaaattgtggctcatctatataatgtaaactactcagtaataaaaaggaatacattattaatacttgcaacaacttcaatgactcacaaagtattaagctgtgtgaaggaagccagtctcaaaaagtacatattgtatgattccatttatatgacatagtcaaaaagacacagctaaaccaacctaagtgtccatcatgaggtgaatggataaataaaatgtggtacatacacacaatggaatactattcagccataaaaaagaatgaaattctgttatttgcaacaacatggatggaactggaagatactatgttaagtgaaataagccaggcacagaaaaacaaatattgcgtgctctctctcatatacgggagctaaaaaataaatgatcttcagagttgaatgatggctaccagaggttgggaagaatagtggggaggcagaagataaagaagaggtggatcacgggtacaaaaatagataaagggagtaagatttagtgtttggtagcactagtttggttagctagtttggtagcactagtttggctagttagcttggtagcacaatagagtgactacagttaagagtaatttattgtatatttcaaaataactagaagagtaaaattggaatgttcctaatacaaagaaataatatcccaattaccgtgatttgatcattacacactgtatgtttttctttgttttttgttttgagatagggtgtcactctgtcgcccaggctggagtgcagtggcgtgatcttggctcactgcaacctccgcctcctgagcccaagtgatcctcccacttcagcctctggagtagctgggactacaggtgtgctccactacacatagccaatttttgtatttttttgtagaggcggggttttgttgtgttgcccaggctggtactgaactcctaggctcaagagatgcgcttgcctaggcctcccaaagcactgggattataggcatgagccaccatgcctggcctacacactgtatgcttgtatcaaatttgatatgtagcccataaatatgcacatctattatgttagccataaaaattaaaaataaattagaactgaaattattgaaaaaaaataagacaactatagtgatagaaaacagatcagtgattgtcagaggtgaaggaaagtgtaactacaaacgaatagcacaagggtgttttttgaggtggtgtaacatctatatcctaattgtggtagtggttacccaaatcaatacatctattacaattcattagagctgtatgtcaaacaaaaaggctcttactgtacaatcatttgaaaaatgaaatttttaagatacatattaaattatgtgtagctgtacatttcctactatgtacattttcttttttaaaattttctgtttttaatttttgtgggtacacagtagaaatgtatttatggagtacatgagatattttggtataggcaagcaatgcaaaataaacagtatggaacacttcacgaatctgtgttatccttgtggaagggccatgctcatcttctccgtaccattccaattttagtgtatgtgctgctgaagttagcatgcatgtccattttcttttagatgatacactctgaatcattttcatttattgtagttgaaagagtaactggtaggcccaaataaatttctttatatggtgtttttccccttcaccttcaaactaaatactttgaacactttttctacatttatttagtctgccatccatatttagtagctttatcttgacatttcatactattttatataaaagtataacttttgcttaaggaagtcaccttcccaagagatcttttaagatactccctacgactcttctcaatccacctcagatcgctctaccagcttttcatattcactctttttcctccttattctattcttcagtgcttgtcaactacaaagcaatcatggttcacataataaaataaatgcagagtcactcaccctgtagagtttccacggtgggtgccactggggttttggcattgtaggggcttttttagccatcagtgcagagttcttggtattgccagtctccatgacaatctagacatagaagagacattattattattaaagacatcatacctaaggcttcatgatatcaattcagaaatggaaatggaaagagggaacttacaaaagaatttttccataaatgaagaaatacaattttctgtatgttaacttaaaaaagcaattataaaatcacagacaggcagagcattagacttaagagcacacatcactgtgtacgggttcaaaacccagcttggccaattactagctgtttgacattaggtaacaatcatgtaacctctatgtggctcacctgtaaaatgggaagaatagtgcctatttcatagggttactacaaagatttaataagtagtaaatgctccatgtaagctcccaatattaaagtcattttaagtgtattagtgccactgtctttcattgtcatattttaacattattggtttaatatagcaaagactgacagttccttctatttatcttctaatacaatatttaaatactattttaacaggtatactgcctgatataccatctgttgttagcagtcatctagtcatccaaaacataaataagcccataaagttcctgccctcaagaagcttaaattataccctcataaggagggtagagagcctggacagaagacgtgctctgaatggaataaaggaggaaaggagatgtggcagttacacattcattcacttcataaagtcaaatcaattgcataatgagctgagaagcaaaaccagcacttatttcaagtggcagcatattttattatgctgcagataaatcaataaaataactatagaaaattcaacaactatttctaccatactaataccagttgccatttacttacaaacagataaacttatttctaaatgctcatttataagactagttgtatagcccatgaatagtacaacactaacagcactcaagataactgtacacaccaacttaaaatttaataaaaaaaaaaagactttcatattcaatacatactaacacaagtttcagaaaaactctccttgcatttttaatagtgggcaataaataccaacatcacattatctttatcaaaatatatattacacacaatgtacaagtagacaaataacagaattaaattccaaaaaatacgttaatttactaccaacttgagttttagggctatgaaatatgaatgactagctcaggctgctatttatcttaataattccaaagaagagggaaatatggcaacatgttccaaaagttagaaacctgctatttgatgcagaaaaacttactgaattcatcgctgtaggctgtggacggtcagaagccccaggatgtcggtattcacttccactaggggcagtacgatttgcatcagccctggggcaaaagaaataatattttcaaagtaattaatgcctccagtcatgtattctgcaaaactaaccctttattttaaattgttataaagtcctgataaaggaaaatgtcatataatagttataaagaaattttaaaaagaaaaaatgtgaacagtgaaatatgcttttaagatctttgtaattataatatttcatacttggtctgcaaaggtaatgccaccgctaaggactgtgcagctgattcacttggcattctctggatcttagtatctgctgtcaaagcaacccctattaaaatgaaaaatcaacttcttttagtagctgtgtattattcatttacatgcacttaaaataaaatgatgaaggaaaacatacaccaaatgtttattatctccaggcagtgatattatacaaatttgattaagttttgctcatctttgtttttaatttctacaataaatactgcttaataacacgtaactcaaatttgatttgatcacagcccacatggtattaaagcagcccagaatagtaaagttaatttccattatatttgggtattagtttcaagtcagtattaagcagttcctcaaatactaacagaatgtttccaagagtggatgtaacttactaaaactagaaacacccaatttccctgtactttctttacatactaagccttttgtcctctaccctgttacactggccactccatctgtggaccaatgccttaatacagacagaggacatgtttctcagatactgcttctaacatttccatcatttttacaagcttagtgatatttacatgtctgcctaaaccaccagataataaataactaggcctgcaacagttttactgtctttgaattcctagcacattgcctgaaaaattatacgtacttaagaatgtttgctgaatgaaggcatatgagtattcattattacctacaaagctatgcatggatgcttggctactgagcttatcttgcattttataggcaacaagaatctcattattggctcgttagtgaaaatatatgtgacatttttaagacattttcaatatataacagctcactaaccaggtcctggtgggtatggatgtgtacctgccacaaagtattcaacttcttgtcctaaaaaaacacaaaaaaaatcaacagtagtgaatttaccttatacaaaagttatcatctctttaaatgtatcaagtaatattaagttttcaactggatctatcaaattttctcaactaaagtcaagcctcagaaataagggaagttgatcacttttgctttgatctctgtaaaccatgtccttgaccatttgctatatagcaatggtatacaaagaagccctcctatcaagtgacaatccactctggtatttcttccaagcaaatggtttcctgtggaatcttgaattctctttacttattaagatttcagtatttaatttcatctttctgaattacagacaagatagatggtgtcctcacaggttaagaatattctccaattttttcctttaatctctactgtgaccttctccacactctaagaatctctgccatcattatactaccatttttatttcctataagaaaaaagtcatcaacagtattcccatgaggatcaaaacttccattataatacaggtacggccattaaatactgtacgaccacaataagtcctgccaggaggggcaaaaataacatattttatttttctgtttttaaaattcacatataagtctgacatttctgataataccatactcaccttgattggcagggtactgtttatgaacatatgaatccgttgcattctgaggacccttctctttaagattttcttttgaagtaggcatatgcaacacaggaccatactcattacgaagcttgattgccatttttcgtttgtgactatttagaaattataaacataagaacgtatccataaatactttaaaacaaacacttagcttaagtttgcccattcacgtagaaaaagtttctagtatgattttaagtagtatttaaaagaatcaaaaatttccaagggcatttccccaccatatctgttcttttgcttacattcgaccacacagcattcattaaacctacgtaatattttagtttgttacctaataaatagaaaaccttttatgataaattgtcaagggtctgactgaaagatatacagaaactaacataccctttaagaaacctcaaagtcaatatactttccttcaaaatataaatatagtaaaaactctatagcaacctttactagatgtatccaaacaggttagttagaactaatcaaagtacttaattggttcaatatcttaaaaagaaatgcatttatattacttttaaaaatagtctactttataaattaaatataaatgcttgtttgaggagttaagtagattttaaaaaggtaaaggacaaagaaggaacactgcacataatgcattcccagactggagctggatatgtagaaccaaaaatatgccaccactcaaaaatcttcatcatactaacgagaaaagatgggagtagaggtactagccaggtacaatttcagctcagcaaggctctgagagcagcgggaagctgaaagcacatacaaagtgattgattataaaataaaatacctaaaagggactctcttaattactgggtatttgtaaaatgcaattaattaatggaacttttactgtaaaaggccaaaaaaaaaagttaaatcagcttaaattatgccaaaacaccactcattattgaataattagcccatgactagcttatctttaaaggactccctctccctgctctcttcccctagtattagaatgttaagtattttagcaattgaaaaaaaaaaactacaccaacctctcttcatctaaaggcacaggttttccattatcagctacaaacatgtcatgggtcctcttcaacgacctgaacacaagggtgtgtacagaatgtttctgtacctcctaaaaaaaaagaatgtaattacacacctatctacaaattacacaaatcataacctaaagtcagattgattatacacttcacgtgtttaaatatgtaaaaagctttataccactcaccatagctacttgttgcaagctacaggagtcaagttcagagaagaggaggaagctcctctttggctagaacctcaggtttagcaactgagtgatgccggagtttaacttactcaataaatatttactgagctcctactgtgtgtctggcaggtattgtgctagaatctcacaatagaatgataaaaaggtggtcatggtccctgtgctcaagaggaaacagacaaataaaaagtaaaataattccacattttgataagtgctatgaaggcaacaagcaaggcgctgagtcagggaatgaaggactaagtataattgtgaaagatttcactaaggtgatatttaagcagaaagggagttagccttgcacaaaacagaggtaagaacgaaccaggctgatggaaatgtcatgtaaaaaaaagttcagttaactgaaataatacaaggagcgcagtacagctgtgtatggaggatgagatggtgctttgtagctgcaagggtagacaaggtccagattaggtaaggtcttttagactattacaacagcctatattttgttctagcaacatagggtcagtaaagggttttaaacaagaaaggtatgaacaacttacgttttaaacagaacaacttatagaacaaaatggaagcaaggaaaccaaccaacggggagctaatgcaccagtccaggtgaaagatgatgttggtctcaattaaggtggactgcagcggatatggagaagagtgaatggaatcaataaacatgtggggtaagatggacaagaccagctaacagcgttggctgttcatgccagggaaagatgtaaagaacggcaagtttttctgggggtagaggtgaaataagagacgacctgaacgcaagatagagaagactaccaatcttttagggcacagactcactgacactgccccgagggcggcaagtaccagtggtcgatcaccaacagaggccccgcctccgaggacactttccagctcccaagagtcaaacgaggactggacgaattatctcaggcttcgcgcccaggctgaacctccgactcgggttctcatccggcttctaccccttccccgaaaacccgaagaagagaccactcggccttggccaaatagctcccctcgtagcctcttttctctctggactccaagtactctcaatcccccacgcgcactgccaaaaaaaacagtccagagacaaacgactcttgagagccccagtgtcactttacctcgaccatgatgctaccgtgtatcccacctccggcagggaagaaactctaatcactaacgcagtacccgccgccacagctgtgcagcaccttccggaattgggcgcccaggcggcggatgtgatgcaagctctgcgcacgcgcgctagtctccctcggccatctaggatcaggaggcgggtctccctcctcgggaccgcctctagggcggagtctcgaggctgaaagccggagactcctggaagggcctgggtggagggtttcactcgtccctctgaagaaatcttagaattatgttttctgccttagttggggtcctggttgttcgtgctgtattccccggaagcttaacgctttttattcagagaacctaagcgtctggagagcaaactcccgtgggctctatctaaggcatttccactaccttgatctctttggaggtcgcctgcgtgctttgtgtctcctggttctaatcctggcgagaagcacttggacacttgtaggcttaacacctgaaaacaatttcgcttaaacagtccagtaaacacttgttaagtgaacgttgaggaatagctgttttaatttggaaaattttgacatgtagttataacaaaaccccatatttattttctgctaatagatttttttttttaatttctcaaaactgcatagctcttgtccatttcctagttgcctgctgattattgtggcttcaacaatgccagggtacagcttttcaaagctggtagaagacacaattggagactttagccatttttatttatacatatccttgtgccaagtattggtatttttgctttctaccctggtaaaatctgtggtttgtgatcaaccctacccaattatttttctatgtaaaaaaaaaaatggatggacttaggcatttacaaacttaaatagacaaacattttactggccctgtttcagtttcactaatcctgtcctgagagcatactgcttacactttgagagggggaaaaaatctagcaaaagaatagcaatataaatcaaccttacttggaaattcattaaaaacattaaggtcatgggtttttgtttgagacagagtttcgctcttgtcgcccaggctggagtgccatggcgcgatcttggctcactgcaacctcagcatcccaggttcaagctattctcctgcctcagcctctggagtagctgggattacaggcgcccgccaccatgcccggctaatttttgtatttttagtagagacagcgtttcaccatgttggccaggctggtcttgaactcctgacctcaggtgatccgcccgcctcggcctcccaaagtgctaggattacaggcatgagccactgagccctgccttaaggtcatgtttttacttgaagatacagcatctctgaatttaactgtgagtttggcctaagaattgcttttctgtaaaggtggcaggtgatggtatttccttgcaagaaaataccataattgtaaaatatatacttgatgaactaaataatatactcacctattaataataactatagaaaataacatgatttgaaatgacaataaaaccatagaaacctaagcaagactaatatatatggcaatatattaattgtctagttggatctattaactttttacatatttaatcatcctggagacattaatttaatttctcaataacaacatggtaatgattgaggtaaattgcctcgaatttgctccttttaaaacactgtcgtgaatttatagaatgatgtcatccccttgaaagtttacaatattttagataaatatagaactcaagtgaccctattatttagttcagggattcatgaattatgtatattgtaggaaaattttgtatttatatgggaatatgttttattttctggagaaaggatccacaagtttaattggattcctgaaaggctccgtcatacacacatggcctggctgacacccgaagctgccttatttgaacagcaggtgtcaccactgctctttgtacgggccctcagggctgtccttaaagcagacacggcaagtaacttattaatataaattattagtattatgtctgtgtaaaaccaagaatacaagttttaaggaaagccctccttctttaggcaagattttttaaactcaccaatacagaaactctttttattctccttcaaatattgtcctttgctcttgaacagtgataggtcatatgagtatagatttgagtgccattttcatcagctttttatgatatttttataggaagtgttttctgattcttataaaataataaatattactatttatttttctgtttcaacttagagggttaaatatacaagctttaaaaaacactatatgcaatgttctttagagttgtgtggctcagtatgtccatcccttaaatttcatatttgaaattgttcgttaattcaaaaggaagtaatcatgggagttatcactgtttatttgaatttctgaggtcaaaacctgtgaaaaatgatacttggacatttcttccaaaactttggtctttaattgtttagcacaatgctatgaatttgcctaaatactaaggtagtgttagcagatactttcttgtagcatagttgaaacaagcttctgggactataaggaacagtgaaggggctgttcttcctgttaatgcctggaaagactttgggaataattagattgtactatcagttataaactgtcagttataaatatcttagcaaggtgtatgtgtgtgtgtgagagagagagagagagtcctcgggtcttacttatcacaatttcaccatcctctactacatgaagccccatctcatgtgtattagtttgctagggctgatgtaacaaagtaccacaaactggatggcttagacaacaaatgtttattgtctcacagttctggaggcaagaggcttgaaataaaggcgttggcaaagttggttccttctaagggctgtgagagagaatgtgttctatgcctctcccctaacttccagtagttctctggcagtctttgccgtttcttgtcttctgctgcatcactgtcatgtctgccttcatcttcacatttcgttctcactgtgcatatgcctatgccaaatttctccttcttaaagaacatcaatcatattgaattaaaggcccaccctactccagtatggcttcatcttaactaattccatccaaaaataccctatttccaaataaggtcacattcttagatactgggggttaggaattcataatgtgaatttggggggacacagttcaacccacaacactatatcacaaaataagtgacaatattgaacataatcatgacttttgttgtttacctttacaaataagaatttgtacttacaaatatttgcaggcatttacaaatgtttttattttacagaaatatttttggtgtttatactgccacagaagaaataacaatgtcttggttccagctttcttagctgaatgttttgttgtaatatttgtttaaatatctgtatttcccagtagacttatggggtgaatatggcatgatgtttactatcacacagtcagaatctaattgacttgcaactggtaagttttcaatatttattgaatgaatgaataagtaagctattatattgtacacttaaatatgggtttaggtggctttgagagcttaattttttttgagacggagtctggctctgccggccaggttgaagtgcagtggcaccatctcagctcactgcaatctctgcctcctggattcaaatgattctcctgcctcagcctccggagtagctgggaatacaggtgtgcaccaccacgcctggctaattacttgtatttttagtagacatggggttttaccatgttggccaggctagtctcgcactcccgaccttaggtgatccacctgtctcagcctctcaaagtgctgggattacaggtgtgaaccactgagcccagccgagactttaattttgatttggagttgcagctactgaacatgtaggaaggatggtctgtgagtgtgtgtgtgtgtgtgtgtgtgtgtgtgtgtgatgtgctcactccgaaaagttgctatttcagtaaccattaatttaatcacagtctttctgtgtgtgtaatgcagataattgcttataaaaggactgttcagttctgtatttctgatctttgtaaattttatgacaatgaaaaatattttccattacatttaagtaagttaattctaaattttatttagtttctataaaacttagcaacttagttacaaaatacaatttatctgtagaaatatttgcaacagtcagtttagttagcagaaataccttttgacatgaataattaagaagagtaaggcatttgattgaatattttactattattattaattcatatttatagatcccattatatttatattacataatgctatttagacacttcaggctttcttttagaaatatgctaccaaaagccagaatcatgttcacagagaaatattaaaaatattcttattagtcacaatacaaggatgtccaccatcaccactattatccacgtgtattttttatgaaagcactagtcattcaattggacaaaaaaattaaattgtgtaaaataggaaatagggatgaaaagttatctttatttgcaaacggtatgactttctacctgaaaaaccaattgaaaaaactattcgaaacaatatgaaaattcactgagtataaaaatgttattaaaaatcaatagttttcctttatgcagttaaaaatacagcagggaaagggatttttatttaaaatagcaataaattttaaaatgtgcaagacctaaaggaaaaaaaaattaagagacgtgaaaacctgaatcagggacctccctcctctctgtgcatgtggcctcactactgctgcttctggagggactgaaaaatccctgagaccagcatctcagggatgctggtctggcagtcagagaggtctctgagctgacaggatttcctgaaatgctgtgaaaattttgcatcctgaaatccatgctggaatcctggctcataatatcccaaaaggtaatgctgacatggccaggcctgattgttgcctgtaatctctatcccttcctgaagacagtggcttctccaggtgtaatggttgagaggctgttgagcaaattggtactggtagagtaactttactgagagatgccaccaaaaaccacaatccagtgacagtggtgtgtcagaggactatgaggcagtgtccacagacaggcagagctccaagagtaaggacaccttcttggagactaggtgccagttagtcttgaaggcattcacattcacttatatggcacaatatgatgaagcaatttcagattacctcaggaaatagcacagtaaaggaatatctcagatgcccttgcagtacagaatgatccctcatcagactcctgtgcagctatacacactgaagcctaagcttcccatcacagttctaaatggagcccctggatttaaaaacttttgtgatgctttgaatgcctggcagctggtgaaggaactcaaagaggcattaggcattctatctgctgcccttttcaaacatgtcagcccagcagatgctgctgttgaaattccactcagtgaaaatgaggccaaagtctgcatatatcataagcaaagttaaaagacaaatgaaaaattgggaaatataggcaatgtgtatgttagccacagggctaattttcttaataagaaaagagctctcatgaatcaacagaaaaaatgaacaactcaaaagacaaggcacatggacaggcagttcacagaaagaccactgacattgtggctgatatgtaaattgaaaagattctcagtgtgctcatgatgaaagaaattttaatcacaataacaataagataacatatttcacctaataggttggcaaaaaattttaaaatttgacaacaacaagtgatgacaaggatgagggacaacctaaatattgatgagagtataaatggtggcaatcactttcataggcagtttagcaataagctgacaatttttttcgagacagggtctttctctgtggcccaggctagacttcagtggatgacctcctggggtcaggcagatcctcctacctcagcctcccaaatagctggaactacaggtgtgcactatgatgcctggctaattttttaatttttttgtagagacaggtgtctcactatgttgcctaggctgctctcgaactcctaggctcaagcacccttcctgccttggcctcccaaagtgcagggattacaggtgtgagccaccactcctggccccaaaattgtttgcataccttttgttacaatggatttactttccaaaaatgtccttggtatgtatgtatgtgtgtttgtgtgtttgtgtgagagtgtgtatgtctgtatgaatgtatgtatgtattatatataatcttcatagaaggatgcaaagatatacatacacaggtgttcattttgctaaggtaggaacaccacatcaatacaagagaaaaaatagctttgtacataacaggaagaaactgtccatcatagtaggtaagggtatagagtcagaatgccatgattcaactccttctctgcaagttacctgcagcatcatcttgggtaactttcttctttttgtacttcaattctcccatctgtaaaatgggaataatagtactactctacctcatagagttattgtaagaattaagtgtaacgtactagtaacagtgaccggcacagaattacttgatccataaacattagttatatgatactaattatccccgttgttctaaaaggggagaaagctgcataaatgtaacctagaagtcagaggtcaacacaggcagcttctattttcatcctaaactaaacctaaagtgggcctcgattctccccacaaggaaacctagtacacaaaatactagttagcacatatattagtctgttctcacactactgataaatacataccaagagtagataatttataaagggaagaagtttaattgactcacagttctgcagagctgggaaggcctcaggaaacttacaatcaaggcagaaggggaagcaaatatgcccttcttcacatgacagcaggaaggagaagtgcggaatgaaacagggaaatccctttataaaaccattcaatcttgtgagaactcactcactatcacaagaacagtatgagggtaactgcacccatgattcaattacctcccaacaggtccctcccacaacatatgaggattatgggaactagaattcaaggtgagatttgggtggggacacagccaaaccatatcagcaaagtagattgaaacattgagcaaataacaaaggattgaagggagatcctggacccaatagcatactttgtccatcctcattcaacttgcgtctttttcttagtttgtcgttacctctttattatgtggagaggatagagatttttctgcccacgtctcccccttccctaacattgtatccgtgtttctagaaaccagcctttctggctttctttgatttatatctaggttccatattttttcaagtacatgtttgtgttttttaaaatatatatatggatatacatacatgtatatatatcttttgcccatttttatctatagggctcatgctttctcatcaaactgtaactcttcataaaaattttattaaacctttgtctaatcctgtgcacattttacagaaaatattgttaatctaattcaagtaatacttattagttattaaattgtgaaagatttttgaaatttttgaaatgcatgttactgacatgcaccaaaataaaagtcctcattttccctagagtttcactgctaatactatcagactggctgtcttatttttaagcataaattccatgttggaaagagaagctttatattcaaataatgtaatccatcactaaaggttttcatatattatgtatatgggcggggcatggtggctcacagctgtaattccagcactttgggaggccaaggctggtggatcacttgatgccaggagttccagaccagcctgggcaacatggtgaaaccctatctctacaaaaaaatacatatatacatacatatatacatatatatatatatatatatagagagagagagagagagagagatggagagagacagagagagacagacagggtcttgctttgtcaccaaggctggtgtatagtggtgcaatctcagctcattgcagcctcaacctcccaggcccaagcaatcctcccacctctcagcctcccaagtagctggagtggctgagactacaggtgtgtgccaccatgcccagataattttttcattttttgtatagatagggtttcaccacgttgcccaaggtggtctcgaactcctgggctcaagtgatccttggcctcccaaagtgctggaattacagctgtgagccactgcgcccagcccatatgcttaatatatgaaaacttttagtgattgattacattatttgaatataaagcttctctttctaacctgcaatttatgcttaaaaataagacagccagtctgattcctaaaaatttgatcttaattttctcaacaaatgccaaaaatcatctcagtcaaagttaatgaaaggtaaaatgagtactatagaaaggacatcaggtgtctcacagactgggctgtgaagaatcaaattattatgtttggacgttttggttacttctgttgatgcagttggtaggctttccctctaaaatgctgccatggatataacatcagtccaattgacccagttcccttccccttccccttccccttccccttcttcttctcctcctcctcctccttcttcttccagcaaatatcaaatttggagagacaatctggtagatttagcttgcgtaaagggtctgtctacccctagcttggtcacctgtggttagagggtcagggtgttgtagtactgacaggaccactggagcttcatacctccattttaggggtcattccaggagaagggagcagcactcccagaggtgttcattacacccttaatggttgtgggtctcaatgtgacaaaagcagaagagcatctctatcttttcttagctcttgtgatctccatcctgttgtaggagaaaatgtcctattatcccttattaccatgctctatgtcagctcccataagaaatggaaactgacatctaagccagtagagggagacattccacaagagatggcgtcatctcctatttcttccccaccatatgctttcccactaaagatgaccaacaaattgcaggtgtcaccactgcactgctctcaggcttgccccaagagctctggtccagcctggcctccaactcgtcagtgttaatcaaggtaacacaaggaaaatatatacagagactaacaacttattacagtacctcaaaacctatgcatatttagacaacgagaatcagtattccttttagtcattcgttcatttatatattcatgaatttgctcaaccgatatttattaaatactggctatgtgccaggtgcatgacataaactgtacagtcattcaaaccaagtttcaagtctaaaagcccttttcctttgaagttcgtttccccctgaagaaagttagatccttaagttaccagtcccaaagcctcacctcccccaatcttaggctcaacactaattattgtaagtagttttcattttctgtctttccttttagacttaaggcttcgccaaggtctccccggcccccagcaaactacctgctatgaagtagatgctctgtaaatagttgttaagcacaaattgccttgtgctatggagactgggcctgacatgagttgtaaaagtatcaacaagtgtattgacaatgggtatcggcaagtctttgcccttcaagccagagagctgctgggcaggacagattatctctgttttctctgtcactgatttactacccttgacttatgcaatgacatcagctaat

SEQ ID NO: 539 - DNA, 83598 bp, Homo sapiens
ggtgggaggatcgcttgagcccaggagttcgagaccagcgtgggtaacatagggagaccccatctctaccaaaaaataaataaaaaattagccaggcatggtgtcttacacctggagtctcagctactcaggaggctgaggcaagagtatcgcttgaacccaggaggtggaggttgcagtgagccaagatcgtaccaccacactccagcctgggtgacagagtcaaatactatctcaaaaaaaaaaaaagaattatgttgtcacttgagcacagtggctcgtgcctataattccagaacttttggaggccaaggcaagatcagttgagcccaggagttcgagaccaggctgatgggtaacccagtgagaccctgtctctacagaaaatggaaaaagtagcctagcgtggtggcacgtgcctgtggtcccaactactcaggaggctgaggtgggagggtcacttgagcccggaggtcaaggctgcagtgagctaggattgcaccactgcactccagcctgggcaacagagtgagatcctatctcaaaaaaaattatgaaaaaaaattatgttgtcaaactcatagaagtggagagtagaatggtggttgccagaggctgcagagagggtaaaagggaattgctcctgaacagggataaagtttcagtttcagttatgcaaaatgagtatgttccaggtctgctatacaacatcacacctgtagttaacaatactgtattgttcaattaaaatgttgttaaaagggtgggtctcatgttaaatgttttattacaataaaaaataatttttaggaagaaagttgttaactgggtttttgtttgtttgtttgttgttttgcagatatcctttaacagacctaaagctgtgtgatttctagtaatccacctttcagagcgtgacttccacccgtctaaatccctgggagtgaactcatggagttctggggggaaaaaaaatcctgggaggtcgggttggccacaaagcccaagatgttccccaatttactaattaggttagaattccacacaaccagcacctcaccaccaccaagaattctaatggaaactttcttcagtgaaaactaacttcatttatttcaaggctggtgctaattttggttgttgactgctttggcctccgattatgggaggtatcctgggtgggaactgtcaggggaagctacttggaaggcaggactgagccggaccaaattgcaagattcaaaccagtgaggaggcccaacagcggattctccacagacccagcagaagctctcgggggctggaaaagggcgccacctggtggcatctgagcagaagtcagtgacacgttttcacccacatgtcagtacagctcccgaagcaggtccagcggaaaagctccggtatgaagcttttccctttacagtgtgctgtgagggtgtgtaaccacagttaatggaaagggacctcactggactcaatccagtgacatcacacatgccgtgtctcccacccacagagagaactcccaggtcttgagtatgtgatgcctggagcctcatctaccttctgaaggcatcgttcaggcacgctttacatatgagcagtgtttggattattaattggaaaggtcagaacaccgtttcagcgggtatatgaaagtgatagcagcggtgtctggaacataaaggagagtgtgtttgtccactcttcctagggacacagggacggggacactccccactctcccctgggacacgggaatgctctccactctcccctgggacacagggacgggaacactcttccctgggacacatggggacgctccccactctcccccgggacacagggggacactgtccactctcccctgggacacacggggacactgtccattctctcccgggacacacggggacgctctccactcttccctgggacacacggggatactctcccctgggacatatgggctgtccactctcccccgggacacacggggacgctctctagtcttccctgggacacacgaggactctctccactcttccctgggacacatggggacactctccagtctcccctgggacacatggggacgctctccactctcccctgggagttccagagtgaccgtcatcgtgaaaaatgacagggattgatgtagtttcctggcttttgacattaacccacaaacccaactaccactctgggtttttcctagagcgtaagccttagctgacgccatccacacattatggtgctgtggattttcctgtaatgaaaaggaaaagattcagacagcaggaaataaggggccagggggaggctaaggctgtcatgatggcagagaagtctcaacccatgatcttggaaaagctgtccacatttaggatcccgtctgcttctggggaaaacttccctggttagcttcaccttaaggtctccgaaaggtgtacggttccaagaatctggaggggtctttttgagtttggggttagccgatttttctaaaatgtgcacaagttctgggtccatagttcttacacacataattagcaaacgtcccagaaggcggcacgcagactccttggattcagacaaacccaagccaaaagggacctactcaaggcctctaactggatacaatagagttaagttttggatccaattcaatcctggacccattccggtctaagaattgctcaaggccgggcgccgtggctcatgcctgtaatcccagcactttgggaggccaaggcaggtggattgcctgagctcaggagtttgagaccagcccaggcaacacagtgaaaccccgtctccactaaaatacaaaaaaattagccgggcgcggtggcatgtgcctgtaatcccagctacttgggaggctgagacaggataattgcttgaatctgggaggcggaggttgcagtgagctgagatcacgccaccgcactccagcctgggcaacagagtgagactccatctcaaaaaaaaaaagaattgctcaaagtagagggctcaaaacacatggtcatagagcacaaatccagcagagagaactcacctatgactctagatgctttgagagatcagcaggcacacaggccctactgagcattcagtgctcctagggggtggctggaggtctacttcagatcccacttctgacaccaaactgttaaaacaaaaactttggacaaattaaatttaagagtttgtgtgtgtgtgtgtgtgtgtgtgtgtgtgtgtgtgtgtgtgtgacagagtctccctctgtcatgcaggctggagtgcagtggtgcaatctcagttcactgcaacctccacctcccagattccagtgattctcctgcctcagcctcccgagtagctgagattacagatgccacaacacctggctaacttttgtgtttttagtggagacgaggtttcgccatgttggccaggctggtctcgaacccctgatctcaagtgatccacccatgttggcctcccaaagtgctgggattacaggtatgagccactgtgcccagccaacagagtttaattgagcaaaacacaactcatgaattgggcagcactcagaaccaatgggggaggttcgagagctccactctgtaatgtgggcaggaagtttttatagatagaacacagaagtgagatacaaaaaaaaaaaaatcacaattagcttgattttgttactgcttgaaatgtttgccttatatggcatgatcagatcagttagcagcctgtgactggctgagacccagctatttgttccaaaatatactcataggttaagcttttagcttgtttctgtggtacattaggttgcagtttgttgttacctagaaactcaaggcacagaggcagcctgttaattgagttaatttaacagttcaaacaaatacttatgcaccagtgtttataacagcactattcacagagttagtttgaaagcaatctaaattccttctttggatagcctagacatttctcctggccataagaaggggtgatgccctgacacatgctacaatgtggatgaaccttgaaaacatgctcagtgaatgaagccagacagaaaaggcattaacccagaaacaaatattgcatttccttgatatgaaatatccagaacaggcaagtccattcactgagacagaaaagcgaccagtggttgccagggcatgggaggagtgtggaacgggtcgtgactgcttaatggatgggagttttattttggggtggggaaagtgtttggggacgaaacagaggcggtggtggttgcacaatgttgtgaatgtcactgaattgtttactttaaaatagttaattacatgctatgctgattttatcataataaactattttaaaattattttgtgaaaaactgtgatgcttgggatttgcttcaaaataatgtgggtggggtggaggttcgaaaagttaccaaaaaaaaaaaaaaagaaagaaagaaagaaagaaaactctggcttgcaaagaagaaaacggatcggccgtggatccctctccagctcgagggctggagctgcggcggaggcaggagctggaagcgaggcgtctgctggcaaaggcgggagtgcaggttgcgctcgaagccccggcagccgcggcaggaaccggcctggacggggtggggggcgccgcggaggccggcgggacttcccatgtctttctcctcgagctcggaaaaagttcccacccggggaatcccgaccctccaacttcgagaccgccggttccgcgctcggcccccacctggaccaagagctggggctgggctgccgcgcccccggctctgtccccgcgaggccccgctcccagccccacctgggacacccgggactcccgggacacctgcggggcggggcggggccggggcgaggcggggcgggctcgaggccgcaccccggaggcggagccgcgagctacccgcccgccgcgcgccccccgctctcggtgcgcagcggggccgaccctcagccctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtgcgcggggcgcggggtgcggggcgcggggtgcggggcgcaggggaggggctgggattgggggcgctgggctggaggcgcggggctggggctggggctgggaccgggggcgcggggcaggggctggggctgggaccgggggcgcggggcaggggctgggattgggggcgcggggcaggggctgggactgggggcgtggggcaggggctgggactcggggtgctgggctggaggcgcggggctggggctgggaccaggggcgcggggcaggggctggggctgggaccgggggcgcggggcaggggctggggctgggaccgagggcgcggggcaggccccaagagccccgcagagcggacccgggtcgcgggagggcccctgccgtgcctgcgggcgggactcagccttcccagggtcgcctccggagccggcgccgcccctgcccgcaggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggtgcgggccgccccctgccccccgccccgccgtgcaccctaccctagtgggcggagggggcagcggctgccgcctggccgaccgccccctctttctgagcccaggggggcagcgtgttcagcatcatcaccagggtcgaggccacccactcccagacccagggaacctgccccgaggtgaggggatcccgcggcgctgggggaccccgcctcagctaggcgggccagctgtcccttgcggggtccctgactgggccgcctccaccctagagcataagggtccacaacgccacctgcctctccgacgccgactgcgtggctggggagctggacatgctgggaaacggtcggtgtgcgccagctggggctgggcgggtggggcagggctgcgtccccgctaatgcctcagtgacctctgcctcccaggcctgaggactgggcgctgtgtgccctattaccaggggccctccaagacctgcgaggtgttcggctggtgcccggtggaagatggggcctctgtcaggtgcacctgcgccccggcctggggcccagcctcccctctgatccttttcccctgaccagaggccaaacgggcggggcaggagtgacaagatctggggaggggtgggggccaatgccaggcgggggctttgcgggaagaggggactaaacaacccttctgtgcctcctcagccaatttctgggtacgatggccccaaatttcaccatcctcatcaagaacagcatccactaccccaaattccacttctccaagtaagagccgcggggtgtggtgacggcccagcctgagggctgccttctgggaatggggtatttggggtgcaggtctcgcctcctgccgcctcctcaggggcaacatcgccgaccgcacagacgggtacctgaagcgctgcacgttccacgaggcctccgacctctactgccccatcttcaagctgggctttatcgtggagaaggctggggagagcttcacagagctcgcacacaaggcagggcaagcgcaggcagggtggggccagggtgggctcccacctgcacagagagggcctggggtacaggggaccagtccctcctccctcctgaccagctggccccgctcaggcagaggaaaagaaatgcgatcagcgcaacccatccggtgtggcgcttgctgaattattgacactggccatggggctggctgctggcaccccttgtgcctcagacactggacgcccaccagtacccctgagctgccccatgggcccctcagtgcacacctcacatgcagcctgggactgacccgggctctcgaggggcctctcgtgtgcccttgtgacccccttccctggcctgggactgacccgggctctcgaggggcctctcgtgtgccctcctgacccccttctctggctccttcttggcagggtggtgtcatcggggtcattatcaactgggactgtgacctggacctgcctgcatcggagtgcaaccccaagtactccttccggaggcttgaccccaagcacgtgcctgcctcgtcaggctacaacttcaggtgctgtacttgggacaccgctgtccacactggcatagctgtggtggggtcccgagaggcccaatgcctgtggggcagccctggagtgcagaggacgagtgggcactggcgttcccattgcaggtttgccaaatactacaagatcaatggcaccaccacccgcacgctcatcaaggcctacgggatccgcattgacgtcattgtgcatggacaggtgcctgcacctgctgggggtgggtggccagccctgctagcctgggtctgagctcctcacgccccacccctcccttaagccccatcagacgccgtcagacattctgaccacgacccccattctccccaggccgggaagttcagcctgattcccaccattattaatctggccacagctctgacttccgtcggggtggtaaggaaccctctctggggtcccagcgggtgcggggggtccaccaggcccttacacaccggtctctgctggccccagggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaaccttgaatctgcccagactcttcccttagaagtcacaacatactcagtccaataaacctgtgagcagaaccttctggcctcgttccttggggaggagcatcgtgagcctgtcaatatgggatgtcaggccctgtcggcctggagctgggctgcacggtgacctctgtctgggtcatctcccctctaagcagcctgcgaggtgtgcagggcacatgtctgcctgccccatgacacatggtccccacagccagccaggccacggtcaggtctgcccaggctgggagtgcactgggacccaggccacctcctcagtgcacttgcttctgacagggccaccccagactccaaaccaaagctggctcatctcaaaatgtgggaggacagcatgactcaggaagagagaaataggagggaggccgggacagctgcacacaaggaaaacgaaagctcagactacagcagtgctcagaccagtgttcattcctactccatgggagggggcaggaatgccgagatgggaagtcaggccaggcgggggtggaaggacaccagcccgggagccagcactaactgcatcagggcctgggggtaatctggttactgcatcctcagatgctgcagtggttagactggtgcccactgggtggggggaggagcccagaacagcgtcatgatgtcacctgtgccagtgacagatgacatcctgcctctgaagggaaacccagtctcaggagagcaacaccacgcccaaaggtcaaagagcggagaagggcgggtaagacgaccctggtctgaccctaaagcctgagtttggaggtctcagcacaactccagagtcctcatcccagcgctgtgttcaggtggcgagaacatgtcttccgtgggccccatttcccttgactgtggcctcccagcctcgggcatcggcctcaggtcaccccacggcctgcacatgctgtgtggctcacaaatatccagctcatttttggagaaactggctcttctggttgagccgctgcttgggaaccagggccagagcttcccgtttctgacccctccaccactactcaaatgcccgcagctagcctcacagtgaacccaggctgactggcgcccacggctgcaccgggcgacccctggtcctgctaggtggccttcctgggggacgagcggctgtcccctggccccatcactcctcattcctgagggttctccagattcgcttccaggaatgaagcctagtcagccagcctccctcctcccctgcttgccctaatttgatttgatctccactctggaggcctcagcactcctccatctgagcaggcatcaggtttctccaggcaggcggccccagcagcatccaggggccaaacacgtgcccagtggtacccagtccccgatctgaggcgctctgcacaaatacacagtgacaacctagagaaacttcagtatgaaatacaaataaaaacaaagtgtagcagcgatggcctcagacagtagatggcagggacaaactaaggctggctctgggccaaagacacgagcctcctggggagcctgtggggccccctccctcctgtgaggctctcgtctggggtgtctgcatttctgatttacatttcatacttgtttggtgccctgtgaaattggcctttcttctttctgcttccagctggtcctgtgtggaggtgaaggacaagggctgcagtgagccaaaagtgaggtgcacagaggtcttgttttcctgaggctgatagagggttccctctagacccggctccaaataagcagggctcacaagccaaaatccagattctcacgggttagggtctggattcctggggaaaccagcccacaaactgctcctgtgaggctgtggggccagcccatttctccatgcaaacaggtgagactccagccccaccagggccttgggaacccgtctcgtctcagagcccaatctcagggagccagaagcccccaggggcttttcctccctctgggaggcaggacaaagaactaggggcacctagaggacgctcccaccccaccaggtgtggtgcaggaagcaacagaggcctggaaaagcattcactgcgtgagaaacggcgcccagggcactcgcagcctcgctcacggcctgcttcttcaggtgctctggcgaggccagggccacatcctgctcccgctccctcctgtgacgtctgagctccctgaaaatggttttctttggtttcctccccgttccctggcctggggtcacaggtttggacagtcagggtggtcagtggtctggtcactggaagcacggggatgtggccttggcatcaggaggcctggcacggacgcagaggcacccggggcccggggctggctaatggcccagctgtgggttcttctgcagcagccactccagggtctccaggaggtacgacatgccgtagtgctgggcaatgttccggaatattccgatctgttccatgaagacctgcaggaataaacaggcacagtgagaccccagtccactcagagaggaggccaaggaggccaggctgagccgaggcagatgagggagagcccacctgggtgtggatggtgagggcgaagtctcccgcgcagctgcagtacacaggcatgctggtctccttcaccccgcggcacttcaggcagacctgaaagggagcagccccgatgggcgccagccctcccgcgctggccagacctgcctgctgcttcttcacaggctcgcgagacacattcgtgggcccatcagtaagcctcgagcccctgctgtgtgcagccagccctcggttatgagtaaaatgcacgacctcatcccacggtgccagcgccttccctacacccaccctcgctgtggatgttccaccccagatgcccagtcctgaggcctcctccaggccctgctcactccctccatcctgcaggcctgaacgccgtgcaccaccacacggcagcttggcgcgtcccccagcctctgctcagatgcccctcggcaagaccttcctgtggccgagctgtgcaactccctcttcctcctttccttctcttcacacttgggagtgtctgcctccttccgctagaacgaagcacccacaaggccagctcttgacccaaggcaggtgctcaaccagtgtggacagaacagtccatcaggctcagggcatggactggtctgcagggcaggccccttggaagacaccagggcgtgcctcaggacctgcacacaccccggctcccgggagtgcacagaaacccccctgtggactccagggcacacgggcaggcggcatgcacgactcaccaggtcctgcagggtgaaggccatcagcttcttctgtagaacttccaccagcgtcatctcgatggcagaggagtcgtagggcgcctgacagttggagcagagccactgaggcaggaccgccccatcctaggcagagcaagagtgcgagaggtcaccagcccagcctccagaccacagtgccatgggcaggatctcaggagaggaaggggctgtgagaagcgcctggtgacgggcgagtctcctgagtgcagctgcacgcactctggcctcccacctgcacttgagcccttcctaggacaacattccgaacatggtgtggggaggcctgggaaggggcctgttgccaatccatgtgagtcagaggggcagcaggtgtgacccacagagctggagctgcagaagccctcaagacaccgcagtgccctcggatgttctgctccacagtgaagggcccgctggagctcagccgcacctctgagaaggaagagtctttacacaggtccaggtcgcggcagaagttacagctgcggcagatgacctcaggaagcacgtaggagcggcaggggtctcggaactgggcctcctcggagaactcgccgacatccaccaggcgaagcaggtctcggttcagcttattcacctggtttgtgatgttggtgtccagggacagcacctgcagagaccacagcccacatcgggaaggagctcccggggcctccctgctgctctgtctggaccagaaccctctggaccttaggctacagtttcctggtgtcctttcctcccttccttagtccctttagacgcctcagctgacttctctacattagcagttttccatcggtgaggacaggcttccctggggaatttactaaacatttaaggaagaaatgctgctgattctacacagtatctttcaaaacactgaagagagagagcactcaacccattctatgaggccagcatcccctgatactagaaccaaagaccgtactaagaaactacagaccaataacagcctgagcacagacacaaaaatgcgcaacgagatattagcaaattgaatgcaagatcgaaaaaaagaatacataatccagaaagagactcacatagataaggttactaagttatggaaaaaggtacaaagatgattcgatagaaaaagaatagtcttttcaacaaatggttcttgaatacaagcgtatcttggagatatggcaagttcggtttcaaaccacctcaatggactaacatcacaataaagcaaatcacacaaattatttggtttctcagtgcatataaaagttacatgatttttggctcacgcttgttttctcagtacatataaaagttacgtgatttgtggtggctcacgcctgtaatcccagcactttggtaggccaaggcaggtggatggcctgaggtcaggagttcaagaccatcctggccaacacagtgaaaccccatttctattaaaaatacaaaaattggctgggcatggtggcgggtgcacctgtgatcccagctacctgggaggctgaagcagggaatcgcttgaacccaggaggtggaggttgcagttagccaagattgcaccactgcactccagcctgagtgacagagtgagactccatctcaaaaaaaaaaaaagctatgtgattttttttattttgggacaggatttcactctgtcacccagaatggactgcagtggcacaatcatggctcactgcagcattgacctcttggggctcaattgatccttctacctcagccttcccagtagctgggacgacaggcatgcgccaccatgcccaggtaatgtttgtaatcgttgtaaagatgggttttgccatgttgcccaggctggtcttgaactgctgggctcaaacagtcaacccaccctgacctcccaaagtgctgggattacaggtgtgagtcactctacccagacaaaacttaggtttaccctatactgtagtctattaagtgcataacagcattatgtctaaaaaacaatgtatgtaccttaattttaaaatgttttattgctcagaaatattaacgatcatctgagccttcagtgagtcgcaatcgttttgctggtggagggtcttgcctcaatgtaaacggctgctgactgatcagggtggtattgctgagagttggggtggctgtggcaatttcttaaaacaagacaacaatgaagtttgctgcatcaactgactcttccttccatgaaagactctgtagcatgtgatgctgtttgataacatttcacccacagtagaacttctttcaaaattggagtcggtcctctcaaattctgctgctgctttggcaactaagtttatggaatattctcaatcctttgtcatttccacaatgttcactttcatctcaagaaactactttttggccaggtgcggtggctcacgcctgtaatcccagcactttgggaggccgaggtgggcagatcacaaggtcaggagatcgagaccatcctggctaacatggtgaaaccctgtctctactaaaaatacgaaaattagccaggtgtggtggcgcttgcctgtagtcccagctactcgggaggctgaggcaggagaatggcgtgaacctgggagggagcttgcagtgagccaagatcgcgccactgcactccagcctgggcgagagtgcgagactccatcttaaaaaaaaaactacttttttgggctgggcgtggtggcttgtgcctgtaatcccagcactttgggaggccaaggcgggtggatcacctgaggtcaggagtttgagaccagcctgaccaatatggtgaaactctgtctctattaaaaatacaaaaattagctgagcattgtggcgggcacctgtaatcccagctacttgggaggctgatgtaggaaaatcacttgaacccaggaggcggaggttgcagcgagccaagaccgcaccactgtattccagcctgggcgacagagcaaggaggctccatctcaaaacaaaacaaaacaaaacaaaacaaaacaaaacaaaacaaaaaactactttactgctcatccatgaaaagccactctttatctgttaaattttgtcctgagattgcagcaacttggtcacatcttcaggctccacttctaattctagttcccttgctgtttccaccacatctgcagtcacgcctcccacaatagtcttgaatccctcaaagtcatccatgagggtcagaatcaacttcttccacactcctgttaatgttgatattttgaccccttctcccatgagtcacaaatgttcttaatggcatccagaatggtgaatcctttctagaaggttttcaatttactgtgcccagttccatcaggggaatcactatctatggcagctatagcctcatgaaatatatttttaaataataaacgttgaaagtcgaaattgctccttgatccatgggctgcagaagggatgctgtgtccgcaggcatgaaagcaacattcatctccttgtacgtctccatcagagctcttgggtgaccaggtccactgtcaatgagcagtactattttggaaggaatctttttctgagctgcaggtagtggccttaaaagactgaatgagcagtggcttcgacttaaagtcaccagctgcatctgccgctaacaagagtcagcctttcctctgaagccaggctctgaggcctcctctctagctatgaaagtcctagatggcatcttcttccaaaagaaggctgttttgtctacacggaaaatatgttgtcagtgtagccaccttcgccaatgatcccagacagatcttctggagaactcgctgcagcctctccacccgcacctgttgcctcatttgcccttttatgttactgggacggcttctctccctaaaccccatgaaccaacctccgccagcttcaagctttccttctacagcctcctcagctctcagccttcatggaactgaacagagtgagagccttgctctggattaggctctggcttgaggggatgttatatctggtttgatctatccagactcaactttctccatatcagcaacaggatgcttcacttctttatctttcatgtgttcactggaggagcacttgtaatttccttcaagaacctttcctttgcagttgacttggctaactggtgtgagaggcctagctttcagcctgtctcgactttcaacatgccttcctaagtttagccatttctagctctttatgtaaagtgagagacgtgtgactcttcctttcacttgaacacgtagaggccattgcagggctattaacttacctaatttctatagtgttgtgtcaccgggactggggaggcccaaggagaaagggcgagatggcagaatggcccgtgagtggagcaatcaggacacacacaacattgatgaagctcattgtcttctatgcgcacggttcatggcgccccaaaacaattgccatagaagcatcaaaggttatcacggctgatataataatagtggaaaagtctgaaatatcctgagagttaccaacatgtgacacagacacagtgagcacatgctgttggaaagatgagacttgctcaagacaagattcccacaaaccttccatttataaaaatacaggtaaccgcttcgaagcacaataagacaggatatgcctgcaatcagatatcccatgcagaaatatggacttggatctacagcatgcacattgtataaaaattaactcaaatggataaaacctaaaacttcaccaaagaggacagacaccaggacagcaaagaagcccattaaaaaatgccccacagccaggcgtggtggctcacgcctgtaatcccagcactttgggaggccgaagcaggtggatcacttgaggtcaggagttcgagaccagcctggccaacatggtgaaactccgtctccactaaaaatacaaaaaattgggggggcgtggtggcaggcacctgtaatcccagctaaccaggaggcagaggttgcagtgagctgagatcgcgccactgcaccccagcctgggcaatgagagtgaatctccatctccaaaaaaaagctccacatcattagtcgccagggaaatgcaaatcagaaacacaatgcgataccactacacacctactggaatagctgcaatttaaaaacccaatgataccaagtcctggtgaggatgtggaacagcaactcttgccacacactgctgaggagaccctgacacggtgcagccacttcagaaaagagtttggcagtttcttatcaagttaaacaaacacttaaaaaatgacctcagagaattgaaatttatgttcacacaaaaacctacacctacagaatgtttacagcagctttgttattaatcaccccaaagtgaaagcaacgcaaatgtccttccaccagtgaatgaaaagcaagctgtggtttgcccacacaatggacactgctcgcaacagaaagggagttctgatacacacgagcgcgtggatgaaccaattccaggtgtgttttgctaagaagccacatccaaaaggctgcacaatgtctctacttatgtgacgctctagaagagaaaaaaaatgcagggacggaagacacaccagtggctaaagggtgtcaggtgaggagggcagtgcggggaatgttttcgggcggtgactatcctgtatcctgctgatgatgatgcaattccattcacctaggaaaaatcacagaactgcacgccacagagtacattttactgtatataaattacaccttaataaaaatgaatttaaaatatgtaaaagtcaataaaggaattaaaatggtgagctaaaaacacttcttcaccacaaccagaccttgaggctgtcacctgatctccagcgtaaccttagccgtgtgtgagatgcagtttgctgggaaggctgagtgaggaaatggacagtgaagcactctgctctgtaagggctgacacccgcggtcgttatctggtaatattatccctccttggactcagcctgcctttcccagaaaggcctcagcatccgagcaagctctcatctcatcagctctgggtcctggtccagcctactggtctccggtgacccatcctcccagccggtggcactgggtgttcggctgtgccttcaccaacacaccaagctcaccccccagggcctttgcgtcttccctcctcctgcacctggtcccagcgcccctcacaggctccatccccacagcacctgcgcctctgaacggccctctcccttctcgggtcggctggcagcagacaggccccacaaggcaggacctttcctgtcttgctcacacctgagcacagatgccgcaactgtggctgcatgtgacagggacatgataaatgttggtggaatgaacaagtaacttacacctgctcctcaccttgcacacgctggcaccctgaccctacacatgtaggtacctcccccttgcacagctgaaagcctcatcctgcattcattaacatccttaccatgcacaggtatgtcggtgtccttatcttgcacacatacgctagcacgttcatggtgcacgcattacagcctcaccttgcacacagtaacattctcgccttacacatgtacgttagtgtcctctcctcacacgcacgctggcactctcaccttgcacacgtatttgatgaactccagggcagggttattgagcagcaagtgggaaccggggaggacaggaaacatctctgagagctcagtggagttccgagagcctgtgactttcttctgaatcttctgagtgatggtgaagaagctctgagtgagctcatttgcgacataatcctgagagaaggtgatcattcctggaagtataaggatgctgagggaggggtctgggacctgtctggcactggggacctcccacctgggggactggcaccggggaccacccatggcacacagaggagttaggtcactggcacatggcagtggcctcaaaagacaaaagactgctcaccgggaagggctccgaccgccccctcggcctcctgggagagctggctggcccccctcctcctcacgggggtgctccctggagcactgcgcctcagcccgtccttcatgcagtggtacacggccacgatgtacgctgtggagaggcacacacaccacaggccctgagtcgggctgctgcaaacaccctagaatctgaggggacccatggctggtcagattgcctcacagatgaggctaaaatgtcattgttaataattttatctgcagcctttagatgagctaaaagtaaattagagaagtgagaagtggaaatgagaaggaacactcgctgacacctgagttcattgtcagagagaaaactgtataaatggggccatgtacactaagcctctcactgggtagcgcgtgaaagacagctcccaacacaagcaaaggcagggcccctggcatcagcaagcttctccaaaaactactccgggcctgtcacctggcacttacccttttttttttttttttttgagacacagtttcattcttgttgcccagactgtagtgcaatggcgcaatctcagctcactgcaacctccgcctcctgggttcaagtgattctcctgcctcagcttcctgagtagctggtattaaaggtgtgcgcaccacacctggctactttttgtatttttagtagagatggggtttcaccatgttggccaggctggtctcaaactcttgacctcacgtgatccacccgcctcagccccctaaagtgctgggattacaggcatgagccactgcgcccggccaacccggaacttttcaaaagagacatagaaagttgcaagagagaactgagaaagttaaagactcaaggacaagtagacaaaaatataaaatgatcatcaacgaaggcctctgtgaccgcatccacctgtgtgtgcacatcacaacctgctgtttttacttagggcattctttaacttagggctgtcaactacaaacagtgcttcctcgatacacttcatctgcacactaacctgcatagcttgatttgcaaactctaagcctgcagacccaaaccaaggcataggaactcccccaccagaaagttaggcctcacagaccagccagggggcagctgacctgacccagggctttatcttcagctactgaacgtgcacacacacaaatgttccctgggaatgtatgtgactgagttaccgaatcagatggcgggagcagagctaggaaactcctcaatgacacggccaggggcagccgctccccatggagtttcctgagagcaaaggctggagggaagacagtcacccctctccgggccctccagtggaacatgcctggagcctggagaggaggcccctcggctcacaaagtcccaactgctgggcaggctccgcccgatctgattttccctgtctcccttcttgcgataccatggcacaggagccacatctactaaccatgagtcccttcagtgggggctgcgcagccctgggctctgggcttacctgaaacaatcatgaggaagtagttctggcaggaggctgcctgtggcaaaaactgcaaaatgttccagttgttttccagtaaatcctccacgttggattcctccgcctcttcctcctcctccccatctctttcctcctcatcgtcctcattttcctgctcatcctctgctccccctgctttctgggagtcttgctgtaacacatgagacaacgcggctgtgtttgcaccatcgcggcctggtagaggggtaggatgccacagcgaaggctcctccaacctgggtccatctgccccgtttgaccagaggccttcctcgcagtcaaggcatcccctggagcctgcgtgaatcccccagggtggctcccagtacaaagtgctttgtgggaagcgcctggcacacagaagtgctcgtgacctgggactgtgagcttcactctgctcttccagagttcactttaattgttgaactcccaccccccaaggacgaaagaaccagccagagcttcccggtgactgttctctcctctgagtccatgaatctcctgggacggcacgaccccatcacagacccagcctcccgcgcagcctgtgttcgtgccacggcaccatccacgtctgtgtagacaccgacacccactgccacctgccctgaccacacgctgatcccctcctcagagcggtctacactgcctgagtttctaccctcccactttgttctgaatcccttcaatcagggtttatcccccaactccaaccagaatcgctcccatccaggtgtcctgggcagtcttggcttcatcctgccagctcccagaagcgtctgcgtccttacaaagggctttccctctgacatctgagcccctggctctggtacccacagcttcctctcagtccactatgagggcccctgtggaggacacaggcctcctctcaacccacccagccactctctggccactcctgcaccagctgaccacccacgtctcaaccttgcaaacaccatgagccccagccagacgtgaccccttccccagactgctcccgacagccacctccactcacccacagcctggcccgcacctgggcatttacacacatccgatccgctggccccttggctccacttcaaagcccacccaggcccttctcaccaacctcgctgcccagcatctccctgacacaggcactaaccggctttacctgcctgtgccctccaatggtgggttatccacatggggccaagaaagctccaacatcacccacacagaagctcccatccccacgaaagccgaggccctgccctgccatgcccaagttgcctggctctgtcagctctctgcctgcatctgcaaccactgctccactgacttgtgctttgcctccctggtgtccatccgctggaggcgccttatgctcgcacaactatggtgcacttcatcagctctcggattccctgtcaccacctcatgggcctccacctccctgttgcccacggcaagccttgccatcaccagggctgacgccacactccacactgacgtgcttgtctgcgcatggtccctccccgtgttcatgagggcaggatgcgggtgcagtgtctgctgctcacggccaggcccgccggggccctgagcactcagcacttgctgcaggaatgaacgcgacccccaaagctggctcgggtgccacactgcagctcgcttaccagtccacagtgaatacgagatgaaacttttcctttgattccgccatagttagatggatccatccagagaagaaattcccagcatcgagagaaagaaattgtcagagaatggaaggtctcctttgaatggatgctgcagaggaagcattgaagacgctgcttcagtgaaatcgaccttgttctcaactttcctttatttccccttgtatctatctgtaccctccacttacttaacactgaatttgaaagttcattcagaccacatcatccctcaggcttcctggggaaatgtggtaaacgtaaaactaaggaggcccaccaggcccctgggagctggcgccacaaagagagctgggtgcctcctcgtgctggggatggcccacagggtgttctgcctctgctctgcggccttaggtgacctgcacctgctggtaaccaaccacagtgcttcccactgccaagctcttttaagctatcgtcatccttgtcactcctcggttaagcctccctagcgctgacccaatcctctgcacattagatccatttaaggaaaaaaaaaaaaaaaaaaaaaaaaaaagaacaggccaggcacggtggctcacgcctgtaatcctagcactttgggaggctgaggcaggaggatcgcctgagttcaggagttcaagaccaccccaggcaacgtggcaaaaccctgtctctacaaaaaatacaaaaattggctgggcatgctggcatgcacctctagtcccatctactcagtgggctgaggtgggcagatagcttgagcccagagtttgaggccgcagtgagccatgactgcaccactgcactccagcctgggtgacagagcaagaccccatctcctaaaaaacaaacaaaaccccaaaaaatggaagaataaacaaagaaagagaggaaggaaggaggaacatcctaaatcacagtttcaaaatgcagctgagtagcccacatcgcagctcctgcaggagaactttatgttctccctaactctgctcttcgcgctaaggaagaatagcagcctgtttctcgacatgagcaaccccggcctcctcaggtacagggcacccctggagctgcccatggccaacgtggggagaggcacatccttcccattatctcagccatgctccgaaatacaattctagcccaagccagctttcccaggcacacagcgtgaccactgaccatcaaggctcatcttggatagacataaggggccacagtgggtctgcaggaggacaacagtgcttttgtgtttcaaattaatccagtgcatatggtttgattaggaatgaaagtcttataagctctaccttcctacttctcagtgataaggcctattatcaatttagtgtcagccttttctgcagcgcccccagatgctacccctgtaaccatgcaaagatcagacccatgcagactctctgtgcctccacaagcaactcccctctgtgctcagaaagggctgcattcatccccagggtgagcgcacctaggagggagcttcctactatcagttgaacaaaagttgctggtggagatttttctgttgctttgtcttctatttagatttaaatagtgctgagtgtgtgagaagcacagcaaggcctaggagggaacctcaggaacatggcctggaaggcaggaagtcaaaaccacaccaggctctgacagctgagagctgtgcacacctgagcacccgggaaccacaccactccactcgccaacactgacgtctatgaaaaggcttacaacgtcaacacttacggggtgcatatattcagggcaccttgaatctgtgccctgaatatccatggggaaaaaaagcaaacaaacaaaaatcactgtggaaccttcttagcaaaggcaggccacttcctgaacttgcccaactcaagctgcacagctgagtggcctccgatctgctaccgcgcacaggtggcggtaacccccttttcacgctgctcagattcaccatggtgagtcctgcacttctaacgacctcccagcccacccaggaggagagctggcacctcagggggtcattttagcatccctctcaaagccacagtgctgcgtcaccaggaccagccagccgcacctgctggtgatgtactccacgtaagcgatggcatcttccacacggcgcttctttgtacagaggatgatgcggttgaagttggcgtagatgactgatgaccccaggcgcttgaactcagcgatgagcctgtggagcaagttgagagtccgtggtggagacgccacagtcatggagagccagagggcacccagaaaatccaagagggaaaagagctgagggtcctgaagcagaaaagcctccgagatacactagaacccagaagctaatgaagagcaaagatttctgcatggcaaaaatccaccacaaacaaaggcaaaagataaccaaaaacaggaaaaaattagcaaattcttatcacagaaaaatggcaactttttgtatggagacaactcattcgatatttaataagagaagaaccaccaaaactacagaaaaatagacaaaggactagaagagaaaattcgacttcattcattgtaagaatcctaagttaagactgcaccaagaagcacttttatcccagcagttgggtaataatccccggccatgttggtgaggcgcggccagggaagaagtgtccacaaggggcctctgtggggccgctctggtgaagtccatcaaatcaggattcatcccgagttacaacacctctgaggcctgcaagagggctacgccccagcaattaccccacggatctatctgcatgagctcatgcatgaagcctctcactgatttgctatttgtaacaacggcacaaggctggagagaggctaaatgttctttcatatggcatgtcctcacacagatctcctgacacaggcatattttcactaaaacaacaaggcacacagcaatacaatgtgtagcatgactttgtgcaggaaaggggcaggagaggaggtgccacctagtgttctctgcaggatgtgcaggcgacgctgcagcagcagctgcgtgtttctctgggatcctttggattgttatgctccacaaactcagaaatacactacttatcccagaggcactggctggccatgtctctggttctggggagtaagggaccagcccagctgaggacgcggtggacagcccagggaggaggagcactcactgcaggaagagcttcttcatcatgttgtggagtgtgcggtgcagggcagggtcatgaagcagagaggatggcgaccgaagccagcggtagaagtgcatcacctggttgtctgcatagatgttgtggtactgggtgatctccttcacccagcccacgaccatgctcttcaggatcctgaaagagaaggtgcacgacaccctcgtaccctcagcctcccacgctgctgccacgcgggacgctccaactgaaatgggcacaggttttccctacacggctgggtccaaatccgtcactgtcgcctccccttctcactgtccccaccttaagtcacggtccaaatttcatcccttcaccctcatgcctcatctgtttcttcccatttcattccttaaacttgttcaggcttcaccgcatcccaaactctgtgtgttctaaagcaggacgggagggcagcacagtacaaagcagcaagtgtgtgacgggccggggaccctgacaggaaggacacagcaaagccactgcctagacatcagaacaccacactaggccggatgcagaggctcacgcctgtaatcccaccactttgggaggccgaggcaggtggatcacctgaggtcaagagtttgagaccaacctggccaacatggtgaaaccccgtctctattaaaaatacaaaaattagctgggctagtgcatgcctgtaatcctgctactcgggaggctaaggcaggagaatcgcttgaacccgggaggtggaggttgcagtgacccaagatggtgccactgcattccagcctgggtgacagagtgagactgtctcaaaaaacaaaaacaaaacaaaacaaaacaaaacaaaacaaaacaaaacaaaacatcaccatacccacatggccccagctggtcagaaacaagaacttagaggcctctctcccgcctagcaggctgggccctgccttcccgccacttcctttaaatggaccattcaggcgctcgcccgtgaactaacacatgcctacaccccattccctcacacgcctagctgccctgggcaccctccctgtctgactcttcagtcctgccttgcaggacccagggatggaggatggcctccctactcacggcaccctccctgcccaggagctgtaaggaacacatctttgcacttgttccctattgtggtggtgactgattttgtgccttccctctgaagaggcaggggctgccctgggctgggtcttccctacgacactagggggaacacaaggctgggcccctacaccgaagcaatggtcaggcaggtggtacctagacacaggtcacacaaaagccacaagggcgtgtgccagtgtaaacaagtttcccgttccggggggccctggtcacaggccagacagctaggcattggccagtgcactgtacacgccctgtctggcccccttcacttcccatggggcagagatgccagctgctctggtactggaaccccaattcagctaaaggattccaaaactgcacatcaccctactgaagaagcgggaacttcaatggggtcaagaacagaatgttacaagagaacctacagaggtccaagtcccattcctaaaactccctttcatcacaaactcttcaataatttggcaaaccccacattctccagagcggcagtttgggtatctgctgttggactccttctacctttcaggcctgggctactgtctctctgccaagaccctgctcccggctcccaactgcctccctgcctctttccaccagtcctctccctgcctcatttcccagctctggcatgctccctctccccttttgtatggagtcattaaaactacagctgagtacaggctctggaattacaaagacttgtttttgagcacctacccttccattcatttgtggtatgaccacaaaggcagcccctctgacctcagtttccttatctgaaaaacagacaataaccgctccccgtccctgggctgatgtggggacagaggcagaatgcgaagtgctcggcccacctcctggtacacagcaagcattgcccagcatgaaccaccgctggtgggtaatgcgagtagctgccctcaaccatgctctccgcagactgatggctcctgaccctcaaccacgccctctgcagcagaccgacggctcctgacacctaagtgctgatgcctcacacatcatactcagtagagctggctggagatccctgtgatgtacctttggtcacatcgaaaagtggccctggttagaaagactctgtgtgaagtacctctggccacagggaggtcagaggcagcacactgaacagtcgccagggaccaggccggacccccacagtggtaaagacaatagactatggaaaactcgccacacagtggtctctggctctgccattaagactaagggaagcccaatggaccctgtcttagaccttagctttccaaattaagggcaaaggataagacccttctattagtaacactccttcccagagagggtggcacctgaaggtgttagagcacagggctgtctcatcgtagctggccggggcactggcagcctgaccacccgtgatcatgtcctccagggaggcctgctggatcacgtcgaagctgatccccatgctgtcggccccctccatgtcgttgacatggtgagactggagaatggtgttgacggccaggttctgaaggtccagctccacacacactgcacaggaagacgccatgctcagccagcatcctgccagctccagcaccaccagccccctgggcctgactccagccaccaccacctccagaaccagcaacagacctgcccacacccatcctcacacctgccaggctattcagattcccgagggcacaggaggccccacctggaccttgaccccaggaccgtctcctgcagcctcagctctgacctgcgcggtcgaactctgagcccatcctcggcactattgccttgagaagatgtcacagaatggcagaaacaccagccaggtctcatgggcctcgtcctcccgcccacttacctgtggagtaacagcctgaactgttgatctcaacagtggcttggtcatcgaactccatgacaagacagttgtcatcagcctcctttccacccaggtcagggcgggctgtaggggacagccagagcaggtggttgtggcgctggaggtggcgggcaaagaagaggtcggagccgaatgtggagatgtcctctggtaggttcccaatgggaatgtgaaagtacctgcaccagggcacaggtcagcaccggggcacatcgccgggtcacagagaccaccgaggccggctctgcctggggaccactggcccacaacgacagtactgtgctcacctgctcatctcgaaggcctgcgacaggcaggtgtccaggttgaggtagtgacggatcatgcgccgggctccatggcgctgccagtccaggaccccatagttgatcttgtcagccacacagataggcaccagtgggaattcctccaagacaggaatttcactggccagcctcttcagctcccagctggactgaacagcgatgagtgtgggcccccggcgctcctcctgggtcaaggcaaaatggaagaaaagacctgggtggacccagcctcaaagaagatggggctcacacagcaagaccccaaccactctcaccttgtaggcgagcaggaatcgctggatggctctgcagatggtcttcaggtcagtttctgcccgaacttcgaaggtgtgtttggggggtggcaggagctcagggcccaccttctccaggaggaggccgtgctctgctgagtacagggcgccaaggctgggcatctggttgctgcgcacctagaccaacgcaggccacgtcagcctccccctgcgcaggaggaagtgggggcagccctggggcagactccaccactgccacggcactgccaattcaatcacgacaagcactcatgggcaaaggcccttgaggacaagacctggagggcctgggcaccctgggagatgtcctccttccccaaaccctgccccagccaatgtgctgccatggagggcccaggactcacagtgtccagcacaaagacggatgccctgcgctgtgaggggatgaagatcccgaagagcgctttgtgggcctgtgcgtggtggtacaggtagatatggcggatactccctggagaaggaaacaagaccgtcaccccagatgtgtgggaggcaggcacatgatgggcggctggtgcaggccatacctggttccaggtagctgaactgggccagagagcgcatctccaggtgctcaagagcaaaggtctctgcttcccagcctgaaaggtgcctcaccagctgtttattgaccacacacacacagcccaggtgcaccagggcccggaacagtaacggaacctggaagaatcgggcagacaggccggcaagggctggatggtgggggctctggctgcccacgtgacttctgcccgggatgtggctgtgcccctgcagctgcccggcccactgcccaaaggccacttttggcagacacactgctgacattcacctcacctgtgggaacgagtccactgtcgctgctgttccccagcccacaccctgggcgggtttctttcctccataccaccctgctggagcctcccccagttcagtcgagggtggctggggagtcacctgagtctcatatacgccctcgatgtctggcgctgacagctcagcgttgatctcgttgatgtgttcctggtacatgtcctctggcactgaatactcatagagattgtagaccatgttggagcgaggaaggacccgatttacctggcgagaatacgacgatgatctcgtcactgggcgtaagtggtaatgtctgtggtacacacacaaagcacacgctattcggagtcctagacttctggtgcccctagcgacggggtacacccaccacgccacagtccacctctctcaatgattacaactaaaaactctggatgtaatttttatgttatttatttattttttacagacagggtcttagtctgttgcccaggctggagtgcagcagtgtgatcacagctcactgcagcctccaactcctgggctcaagtggtcctccagcctcagcctcctgagtagctgggacaaggaacacaccaccacggatggctttttttttttttttttttttttgtagaaaggaggtctcactatgaggcccaggctggtctcaaactcctggactcaagtgatcctcccaaatcgctggaactgcaggtgtgagccactatgcctggcctctggacgcaattttgaaaagcaacctgcagcctctgagaatagacaagagctgtcagaatacagcagtcaacactgatctggggaggttcccagttcatcttcctccattctctcatgggtttaacctgagggtgtagatggcaaaaactgagagaaatcacattttcctagtcagagaaacggaaagagagcccctgggggagccagagtgtgtgtgtggggtcctggggggctctgggagagctggagaggggcaccctagcttcgtgaatggggtcctggaggggtctgggagagctggagagggggcaccctagctccctgtgtggggtcctgggggggtctgggagagctggagaggggcaccctagctccctgtgtggggtcctgggggggtctgggagagctggagagggggcaccctagctccctgtgtggggtcctgggggggtctgggagagctggagaggggcaccctagcttcctgtgtggggtcctgggggggtctgggagagctggagaggggcaccctagcttcgtgaatggggtcctgggggggcctgggaaagctggagagggggcaccctagcttcctgtgtggggtcctgggggggtctgggagagctggagaggggcaccctagctccctgtgtggggtcctgggggggtctgggagagctggagagggggcaccctagcttcctgtgtggggtcctggggggtctgggagagctggagagggtgcaccctagcttcctgtgtggggtcctggggggtctgggagagctgaagagggggcaccctagctccctgtgtggagggctgggggaattctggagaggcgagctggagaggggtaccctagctccctgtgtggagggctgggggaatcctggagaggagagctggagagggggcaccctagcttcgtgtgtggggggctgggggaatcctggagaggagcaccctagcttcatgcatgaaccagcagcacaagtcccaggctcactacgagctgcacttgcacaggtgacccaaaacaacgcagcagaggctctggaggctgagctgacattggaagctttgcacaaagaggcaaggaagagcttgggcactggaattaaccgtgttggttgttgctaaaacaaacaaacaaaaaaacctgacacgctaaaggatttttaaaaatacccaaagtctcaaatatgtaaaatgtccaggttgcaataaagcgttatttggcgtaacaacaaccaggaaaatctgaataattctcaagcgagaagagaaccagtagggttagatttttccagtaacatgaaattagaccgacacacacacacacccacacacacacacacaaaatcaaagaaatgaaaaattatgttctggtaaatatgaactggaacaattagtgtaattgcactttttaaaatgtatatatttcctggctgttcactgaaggaatctagatgaaatgataccccttgagctctaagcttggtttctcaacataacctctcaacgaggctcaggctctttagaggaacagctaattccacgtctggaagttcaaggtgagcctggcctctcttagtggccaaaaagcaaggaagttttcaaagaccaacagggcatgtcaaaaggactcaggtgccagcttgaagggatctggccagcccaatttgggataatttgagtctcaagaagatattgaccaccaaagagtctactgtctggttccattaatatgaagttctagaaagtcacatgcacacagttacagaaatacagaaatcaggccagcagaaggttgcacagggggacaagagcaccctcccgggtgatggaaacgttctgcacctgggtgggggtgtgggtgacacaggcatagtcatgtgtccaaaaacccaatcaactgcacatttaaaaatctgcacttaactatatgtaaattacagtaagtcctcacttaacatcaatggattcctggaaactgtgatggttaagtgaagtaatgtatagcaggtcctcaaataacatcattttgttcaacattctttcttcctttaaaaaaaaaaaaaaaaaaattctggggccgggcgccatggttcaacctgtaatcccagcactttgggaggccgaggtggatggattacctgaggtcaggagttcgagaccagcctaaccaacacagagaaaccccatctctactaaaaaatacaaaattagccgggcgtggtggtgcgtgcctgtaatcccagctacttgggaggctgaggcaggagaatttcttgaacccgggaggcggaggttgcggtgagccgagatgcgccactggactccagccgggcaacaggagagaaactccatctcaaaacaaacaaacaaacaaataaaaataaataaatttaaaaaatactctgtagagaaggggttttgccacgttgcccaggctggtctcgaatgcctgagctcaagcaatccaccagcctcagcctcccaaattgctgggattacagatatgcagcactgcgcctggccaacacagtttcattatagtttctgagaagaaaaaaaatctgtttcattatacatcatcttacttagtcatttcacttaaaattgcagtttctaaggacctatcaacaacataaagtgagggcctaccgtgtaccttaacatacctaacgtgtgtgtgttgggcgggatttggctacggttgatgttaaaacattaaacactgaggcaggaggattgcttgagcccaagagtacaaggctgcagtgaggcaagatcatgccactgcactccagcctgggtgatggagtgagagaccttctcaaaaacagaaacaaaaaagttaaacaaaaatcctctaatccatagtaatactttaaaaagagaggaaaaatgaaaggaataaacccattttgccatgccctaccttgaaaattaaaaataatttaaagggaaaaagcatttatcttgcttaaaaaaaaaaaaagcgtattatccctctcgtatcttgctttttaaggaatagagttcatttctacctgatctgcacaaagctcttcgttataaaggaaacagctaatacacacagaggaacagaatctgaagatatcatcctggagccccatggaccccacgagacatggatgctgacaccatccagtcaaacgttgaggacagaatattcacacagcgccagaacctccctcgagatgagctgatagtcataaagggaaacatcccaaaagttagggcacttccacacggccacagcaccacagcaccacgcatcgaaaggaaggtgtagaaaccccacagtcccacctgttctctgtggtctcgatgcctctgcgtccgctttcctcttgttatccgcccacctcggtctcccaaagtgcggggattacaggtgtgaaccaccacacctggctctgcgtctactttctatatgcacattctactgaatcacctggctggaatcgagtttcaccttctccagaaaacctccttgtgtaggtacaaatatgcacacctcatctccccaactacgtgtcacttcttacgtgattcacagcatccagtcaagaaatgtgctgagccgacacattaacaacggggagttcgggtggagatgccatctaagagcctcagcgcactcatggccacatgaaaaccctcgcagtttctgcaggtggaagaagcccagcacaaagacccacctactgtagggttccatttacatcaaatgcccaaacaggcaaacccagagacaggaagtggatcagtggctactgagggctgggggaggatggtgacaggtaagggatgccaggtttctttttggagtgatgaaaatatccgaatgggggggtgaggggagggggaatatcaggataaacagctaatgcatgtggggcctaatgcccaggtgacggggtgatgggtgcagcaaaccaccatggcatgtgcttacttatgtaacaaacctgcactttctgcacatggatcccagaaatcaaagtaaaattaaaaaaaagaaaaaaaaagaaaatgtcactattgactggcaatagtcatgccactaaaagtcattgaattctgcactttaaatgggtgagttggatggcgtaactttacatcccaataaagctgttaacaaccaaagagcctacggagacagagttcacaatctctaaccaatgccacttggtttgtccccgcaacatggacctcgcgggcagacaagctcatcgtgacaaggacaccagcagctccattcccggcactcgctctgccccaggctcggtgctcagcgctcacacacgttgttttgaggaattcctagaacatccccataaggtactgaggagatggaggctggaggccaggctagatcatgggaaagccacctcaggctgcccagatgactgcagaggcagcaccagctcctccctaccttgcgatacgaagcaccctcctccgctttagcgactcgctggttcacgtagaacacacgggggatgctcagcctgatgcagtgcaagtcactgccaacgagcgcccacagcctgaacaggccggcctggctggtctcgctgatctgaaaggccacacggacatacagcacatcacaggacacactggaacccacagacggggccaccttccaggtagcttgcagctcccagcacagggccttaggcctccctacgatgggcaggaaactccaggcccactctaaccctcccatcccagacctcagggcccagctggacaccccctccctgggccatcagcagagccactgccctccccttggatcaaggtctatacctgcacaatctgccacggaaggtccaggatgctgcgggcagttcttcgcaagaagctccccagccccgtggcaggaccatcccggatggccccgggcctgagcacaccctctgccgactccagacgctgcctcttcctgcgggcgaggcgctgccgggcctgcagctgccacttcttcttgtggaaccggagccagacaagccattcctcctgggatggatggtgagcacagccagtgtgcaagtggtgagatgggaatgcccgccatgactttctcacaagcagcctccctaggggtcaggacgcatctcgggctccctgggctgtgcagacccctcagagacagacagtatcacagctgtgtgccttacctggctggttcccagggcgggaggctgccccaagatttcctgccagggcacagtcggcgtgaggtcctgggactcctcctggctctcccaaagaactcgcttcctcttcacagtgacaggggctgctgggtgaggcagctttacgaggccgaagtcctccatgtcaggagcacttggcctcggactgtcttctgaggcctcggccatcgtgacctggaaagacccagtgaagccttaaatctcaggatctcgggctgcgcagggtggctcatgcctggaatgccagcactttgggaggccaagacaggagaattgcttggggccaggagtttgagaccagcctgggtaacagcaagaccctgtctctacaaaatatattacaaattagccaggcgtggtagtgcgcctgtagtcccaagctacttggtaggctgaggcaggaggatcacttgaacccaggagttggaggctgcggcgaactatgatcacaccactgaactccagcctgggcaagtgagaccttgcctcataaaaacaagcaaacaaaaatctcaggatctcatccccacaaattctacttctcgaaatctagtataagtatatcacctgaaatgggatgttcgtttacacaagtttattgaacctttaatagtgaaggccgggtgtggtggctcacgcctgtcatcccagcactttgagaggctgaggtgggcggatcacttgagcccaggagtttgagactagcctggccaacatggtgaaactccgtctctacaaaaaatagaaaaattagctgggtgtggttgtgtgggcctgtggtcccagctacttgggaggctgaggtggaaggatcacttgagcctaggaggtaggggttgcagtgagccaaggttgcgccactgcattccagcctgggcgagagggtgagaccctctttcaaaaaaaaagtgaaaagatcaaaccgaaaaataaaacgtcactcaataccaccaataagtaaatctttgcattttgccatgtttgctccagaatgctttttgtaagaaagaaaatattgcaaataatgggtacagccctcttctgtctgcccccacacacctttaaatttttaccacatgtccacagacacatgccacagctgtaagttttaacctaaatagtaacatgtgggacacatctgactgcaacttgtttcctttttttttttttttttttttgagacagaatctcactctgttgtccaggctggagcgcaatggcacgatctcatctcactgcaacctcgcctcctgggttcaagcaattctgcctcagcctcccaagaagctaggattacaggcacctgccaccaagcccggctaattttttgttgtatttttagtaaagatggggtttcaccatgttggccaggctggtctcgaactcctgacctcaagtgatccacccacctcagccttccaaagtgttgagattacaggcgtgagccacatgcctgtccctgcaacttgtttctttattcagccatgtatttttgagactgacaccgggtgaaacatgcacatatggttcgttcattgtaactgatgtgaaatgatttatcatataaacacatcagcctacctacccatgactttgcaaatgaagaatgacaagcgcctactttttcaaaactacaaactgtgactcaatgaccatctctgtatgtgttgcctggtcccggagaacaaccacctccacctctagcaccagggatttcctacttcccacaatcttgctacttgatgccaccacacttacttgccttcagtgtgacctgctatctaaatacatcatgctgcatttacctcatcaacagtaaggctgaacatcttggccctgtgcaggcagctcccaaaatggcccaacgacccccacttcctggtgttcacaccctgtgtgactccttccctgagtgggggtgggacccggtgacttgcccgtaatgaacagattccagcaaaagtcatggaatgccactcctgagagcagctataaaacactgtggcttctgcctggctggcactctctcaaaagtccagtgccatgctgtgagctgtcctgtgaagagccccatggagcaggggactaaggataacgtccagacaaaggccaaggaggaaccgagtcctgccatccccatgggagggagctcggaagtggctccttctccagtggagccctcggatacacgagtgcatttaagttgctaagttttggggttacttgctatgcagcaatagatagctaacacgtttatgagccatttctaacttttatacattctaaacatcttcaaaatgtgactcaggcctttgtttcatggtgacttctgtgctacatgtaagtttgtgtgtgttgacttcctatcaggaaagttttcaaacatacacgaaagcacagtaatgagctcccatgttcttatcaccagtgtcaacaattatcaacattctgcctttcttgtcacagactacacaagatttaacttttaattaattgatcattctttccctttgtgatgtttttcacatgtgccttaaaaaagcccttcccaccccagcatcatagtctcctgagttgtttaccaaagattgtagtttcctttttttttttttttttttttttaaagacacaggggtctcgctctgtcacctaggctggagtgcagtggtcatcttggctcaccgcagcctcaacctcccaggctcaagtgatcctcccacctcagcctcccaagtagctgggactacaggcatgcacaaccatgcctaatgttgtgccggattttttttgtagagacgagacctccctatgttgcccaggctcgtctggaacttctgggctcaactgatcctccttccttggactcccaaagcactgcaattacaggcatgagccatcacactcagccttagtttcacactcagtgtgatacaacaacttacttctccaaatatgaaaaaccattttcaccagcatcactcactgcagtccactctctccttaacgatctgtgacctaccaacttccgactaacaggggagtctgtttctaggctcccaatcggctctactgctctcctctcatcttgtcaagatgccatgatagtgtgtctcgttacatagtaagatcaacgtgccctccttattcttcaaaattctttggttattcttatccttaccctttatatgaattttaggattcgtctgtcaagttctatccaaaaagcttttggcagattcttttttattggaattacactgaattttatgaattaatatggggcaaactgccatattttaatactgagtcctttcatctgtaaagatggtacctctttttgttacttaggtaaatttttatatgttcaataaagttgtgtataggccaggcatggtggctcacacctgtaatcccagtgctttggggggggcccaggcaggaggatcacttgagcccaagagtttaagatcagcctgggcaacagtgagacccagcctctacaaaaaatacatagccaggtgtggtggtgcacacttgcagtctcagctactcaggaggctgaggtgggaggataacgtgagattaagagttctaggctgtagggagccatgatcttgccaccgcactctagcctgggtgacaaaggaagaccatgtctcaaaaagaaaaaagttgtgtaattttttctgtaaaagtcttacacacattgttaccatgaatttattccttagtacattatttattgctattgtaaatggtatctttcaaaaaatattttgtttctagtataaatgaaagcaatagacttttatatcttaccttggtatctaattgttgctgaaatacatataagttaacacaaaatctaggtttccttacattttctgttaacaaattacatcgcctgtaaataataagttgatgtctcccttttcaatccttaattctttttctggtttaattatgctggctaggatctccaaactgttttgaacagaagcagtggttaacaggcatccatttcttactccttacttcaatgcttccagtgttttgtggttaagtatgaggtctgctgttaggtttcaagaacactttatcaggttaagaaacatctcatctattctgattttgattgttcaaactttaacatgagcagatgttaaagttttaccgcatgttgtttctgcatctattggagatgatcttacgagccttctcctttaatgatgaattagtggatttctcccaagaaaaactaacctggcaaattctaaaattaaacagtgcttgctattcccagcataagtcctagttggtcatattgttattgttcatgtatgttgatattttttcatctattgttcatggcccgtaactttcctttcctgttttcaattatgttaccaaagtaacaaggattgccaaggttaccaaatgagctaagggttttttttttcctttttctcttaaaaatcatttgggtttgatgtttcttttacacttattttttttcgtctcttttttttttctttttgtggagaacggggtctcgctatattgcccaggcaggtctcgaactcctgggctcaagctatcctcccgcctctgcctccctgagagctgggattacaggtgtgagccactgcgcctggcctgtttctttttaagtgtcaatttctgtaatggttaaagttctattcaggtttttattacttcttaggtcagtgcataacttgaggatactgtccgttccatctatgttttccaactgtttagcagaaaatgggaatccttccatttttttaggctttactatatctataatgatgtctgttttcattaaaataaaaaactctgtcctgaaaaagatgtgaccagccaggacaacatgacaaaaccttgtctctacaaaaaattacaaaaattagctggatgtggtggtgtgcgcctatagtcccagctatgcaggaggctgaggcaggtggatcaattgagcctgggaggtcaaggctgcagtgagccatgactgcgccactgtactccagcctgggtgacacaatgagaccctgtctcaaaagaaaagaaaaagatgtgactattttcctaagtcttttcaaagaacaacattttggttgtattgtttgtttcactcattctggctcaattttgtaacctctttcttttctttcttgagttgggttctccctgtgttgcccaggctggggtgaagtgcctattcacaggtgccatcatagcccactacaacctcaaattcctgggctcaagcaatcctcctgcctctcagccttccgagtagctaggactataggtgtgcaccaccatgcctggttacctttataactctttataacttctgtctacttcctctgatggatctgttgttctctaactttttcagttggaaacttaattttctatttgtttttctttactaatacatgcatttagatatataaatgcgtatacaagtcctgtttaactgcatactacaaattttaatagcatttgtatttacattcagttccaagtattgtctaagttctatgacttttttgatccacaagttataaatgtgttttttttttcttaaatttccaaacatggtctgtatttaagttatctagaattggttgcagcttactctgtggtatatatatggtcattattttatgtattcttgaaaaggataggtattctctaattttagtgcaagactacatttgttcactaaatgtattatagctagtgactaaatctagttagttgattgtgtcattccaaacatatttttgctgatttttggtctgctccaactatcaattgagggagggatgttaacatctcccaaactgattggaggtaaattcttcttataattaggtaaatgtttacattatttaatgtgaggctacattgttacaattagtatatatttccagagaattgtgactttcagtattatgtaacaatagtccttatgtttcctaatacttttggcctaaagagtattttgtctggtattaatacagccacatcagctttcttttggttaacatttacctggtatacgtattttttactccttttgcttttcctgcgtcctatcttttcaatataactcttgaaattgttatactggcccataagccactgggcgcagtgctgtatttccagcactttgcgaggccaaggcgggtgcattcacctgaggtcaggagtttgagaccagcctggccaacatggtgaaaccccgtctctactaaaaatttaaaaaaaaaattaaaaaaataaaaattagctaggcatggtggtgcgtgcctataatcccagctacactagaggctgaggcagaaaaaaattaaaaaaataaaaattagctaggcatggtggtgtgtgcctataatcccagctacactagaggctgaggcaggagaactgcttaaacccaggaggcagaagctgcagtgagccaaacccaggaggcagaagctgcattgtgccactgcactcctgcctgggcaatagagcaagactccgtcttggggggcaggggaaagaatacatatataactcttacaaataagacagttaaattttaaaatccaatccatctcagaacctttttctttttttttttttgagacggagtctcgctctgtcgcccaggggagtgcagtggcgtgatctcggctcactgcaagctccgcctcccgggttcacgctgttctcctgcctcagcctcccgagtagctaggactacaggcgcccaccactacgcctggctaattttttgtatttttagtagagatggggtttcactgtgttagccaggattgtctccatctcctgaccttgtggtctgcccacctaggcctcccaaagtgctgggattacaggtgtgagccaccgcacctggtcaaagaaccttgttcttgtcatgtgagtttgtatactgctctgatttatagcttacttttaattttcagcatttaagaattttccttttgctcttctgactttcactgtaccttttattacactgtgtcctgtgtttctaagtgtttccatagggaagatattcatttcacattcagaaaactggggcttcaagagacagtgatttgcccaaggcactgagtctaagtagtgcaccctaatattttcacataaggagacagttccttgccctcacctcagcctcacaatggtgtcctattaacaaaagagtgacactcagagttagagagtaaagtgccaatgggcacattttcagaaaaagtccattttcgatgcttgaacagaagcttcactacagcacacacagcagcgcaagaagcctggagtcctgtgtgtcacaaggatcccgcccagcccagccttggggccccaccgtcacctgtctcctgccctccagggtgaagagctcactgatcttcttctgcttgtagacatcattcttctccagcagttttttgtgcagccagtcggggtgtttgacacgtggcactgggttctttacctgtgtgaggccaacacccatcagagagagacccttgtctaactgcacagtttttagccccacagcccgtgccactgaccccgcccttacctgctgcagggccgcagggatggtgatgatcttctggatggcgcttcccagccgctcaatgtagtagtcccaatccagaatctgcatgtgcaggaaacgggcacagagaacagcaggtggcagcagccaagagtggggctcacttcatgctgagcacagggctaaccactgtgtcttatttaatcctctcagaaactctatgatgaaaggtgcccattgcacaacagaggacaccaaggcagggagcttcactgactcctctagatcacagagctagtaggtggctgagccaacacccctggccttagtccatccaatagaacagctaaagggccccaggcacttcatgttttcagttttgccctaaaaggttattaggtgctcacctattacttatcagaaaggaggaagtcaagagtgaagacgccagacaaaaaacataatccaactcagacatattctgctctgtctagctttccttgtaaacttttaagagtagagaacgcaactggcactcactgctcgaatatcaaagtcttgaagggaagagctcttgagccatttccggagaaagtgcttcctcaccgtgggctctgcttggaaaatggcaagtgggatggccctgggtaaggaagacaggcacacagctcagtaacagtgaaaatcacccaaaatctgatcctaactcttatcaaatgaacatggaaataaggacgtgtaacagctgttcacaaacatcaatgtatacatctgcgtgcatatgtatgcacaaacatgcctacaggttcctcggggagtaacacgtgcgtatgtgtaaacacgtgcgtgtgtgcacgtaaacatgtctacatgttcctcacagcgtaaccatgggcatgcatatacataaacacatgcgtgtgcgtagacatgtctgcgtttctcattgagtaaccacgtgcatgcgtacaggcaaacacgtgcatgttcgtaactatgtctacatgtttctcacggcataaccatgtgcatgcacatacataaacgcatgcgtgcgtaaacatgtctacgtttctgagtaaccacgcgcatgcgtataggcaaagacatgcgtgtgtgcgtaaacatgtctgcgtttctgagtaaccacgtgcatgcatacaggcaaacgtgcacgttcataaccatgtctacatgttccttgctgagtaacacacagaagactcaggctgctttctagaaaaaacgagcctgttttcatgtcactagcaaagcaactggcaaccgtcagtgcttccctttcactggaggaaacatctgtggtgaatactgcaaacataaggagacctaaagaagacacgcacactatgatccactcggctccatcaagcttcaacacttggccactctgacttcctttgtgagacgattagagtgaagccctgtgtgaccccaacctattccctcctcacacagaagtaaagacaacccttattctggtgttcatcaaccccatgcaggcatttgtactggtcctatttgtatataaccaccaaaaaaaaaaaaaaaaaaaaaaaaaaagagcagtttccatgtttttaagttttacatacacggaggcataagggtcttccttcaacctgatttttgcttttttctccaaagtggtttcaaactgtcagtgttgtaacctgtagctgcaattcaaccctttgaactctggtatagtgtatctcattccctacaaaatggcaattatccatttctggttgatggacacttatgccatccccaaacttggtgttaaacacagcccaaatctgtaaggaaccccttacctctccgtgacagggcagccctcacctctctgtgatgaggggagccctcacctctccgtgacggagggagccctcacctgtccgtgatgggaggagccctcacctctccgtgatggggggagccctcacctctccgtgacaggggagccctcgggcttgcgggagatgatgtagcggcaactcagccctgcatccttgaccatctggtctcccaggaactcggccaggcgctttgctgtgctgatggacgtagacttctgctccccgtaatcttccagcttccgagacatggaacggttctcagagatgagctcgaatagctcagagtcaggcatgttggctgcctagagaaagacaatgggtaaaacactgcagaaatcaaggggcagagtctgagctcaccctggactgtgctcctctaggccatgcccttctctagcctgagacgcagaaggctgcaatttcaagagctctctaatatgcctgtgtggcaatactttaaaacatacacacacacacaaaactttagcttttatattttttttgagacagagtctcattctgtcacccaggctggagtgcagtggtgcaatctcaactcactaaaacctcccctcctgggttcaagagattctcgtgcctcagcctcccaagtagctgagattacaggcacatgccatcacatccagctaatttttgtatttttagtagagaaagggttttgccatgttggccaggctggtttccaactcctgacctcaagtggtctgcccgccgaggcctcccaagtgctgggattacaggcgtgagccaccacgcctggcttggcttttattttattaaactgtgcacaaaatatcaagaagaatttactgaagagcaccaaggctgcagaaaaggatgttgctcggcctaagacaggaagtttttctccttgaaaggaagagaaagaaggggcaggaagagccagaagagaggaaagagaaactccggccggctggagagtggcctgagcagtggaggcctgagcagttccagtgtggcacccacatccagctggagctgtgctttgcacacatgttcctgaccacaggccccccacatcctgtaaggagtgctgggctcatgaatattctgtgtgataccctggtgctcccttgctcgtgtgtttcactctatacaagacaatatgccaagaaacagaagcccacacagcaaagcaagccaggaaagcactgcagagtgttccagtattccttctacccaagacgcctgtgcctgggaaacatatgcaccgagatatctcgttcaatgcaacaccattgataacaatggaaatgtgaaacctatctggtagtaaataatcgtgggctagttacgtaaattaaggtatgtaaactgtcaaaatgttatgtagcctgaaaaatataaaaaatacaaagtaacatagaaataaacaaatatcccaggctggagtgcagtggtgcagtcacggctcactgtggcctctacttcctggtctcaagtgatcctcccaagtagctgggaccacaggcacgcatcaccatgccaggcttatcacgctatttagaaaaacgtttccctcagagttgtgtccctggatgcagaagttgaggggaactccaagggggtaattgtgctcaggaggtcttgggatttcattaggactggccctgtgttcttcggtcaccttggtctccaggagcccaggaagcacggggtccccttcttgcttcatccttcatccctcagagcaggtgagggtggagggtaggcctttaccttgctgtacagcacgtccagccagtagtcagccaccttggctacagagccatacacctcttccagcgtgctgcccttgaggaaggcctcaaacaccgaggattggaagatcttaatcagctgcagttccccgcggcgtttgacctcaaagcccttgagctcagccagagaaccgtcttcattgaacacagcatacctgaaaaaaaaaaaaaaggcaagcacagcagtggcaaggagcgctggggagccaccagctgtgcctcatcctctctgcccgcctcttccctttccaaccctccacctgtcatccacgaggcagcaaacgtctctctcccttaggccactgcttctctaaaaggaaaatggctgaagggcctgcagccacagagccagaatacagcaggcgggcagacagagctggtgcaaacggaatcagtaagatcacaagaacccaggtctgtttctatcctggctcctgatccaacctcctttctgggctaaatttaatctatctcaatccatgtcctttctaaagcacaaaagctatgagagtcccacctcttcttcaatttcttgccttcttccttggaggctggaagaatcatggcaaggtagggcccatcaacctcaaaaaagatgctgttctctgagcgggtgacgtaggtgagtgaggacggctcagccagctcctggtactggtcattggtgaagccttcctgagaaacaagagtgaagagggggcagcttcactcatgatggcccaaacctggaaaccacctggtgtccctccaggagtggatggattgacaaaccgaggcttttccacataactaacacgacttggcagcaggaaggaaggaagttctgatgcatgcaaccaagtggtgaaactcaggtgtatctgttaggtccaagaagccagacccaaaatgctacaggccgtatgcttccctttacatgacattttcgacaaagcaaaattatagtacaaaaaacacattgtgggttgccagggtttcggggtagggagaggatttgctgacaaaggggttgcagctgttttgtgttgcttcgtggtgctggacacacacactatgcacttgtccaaacccacagggctgtacgctacagagtgaacgtcactgtgtgcaaattacaagccatccagccatggtgctgggatcccaagaggggtgcagactgggccaaatgagcccaacagcactgtggacatacagcagaacatgccaacagggtggggaggaaggagctgcccgtgaactctgctgactggacagggtaaggctgaaaacaaaagtaactatctacaaatgctgtacagtggctggtgaaattatttctcatgggacacaagtctgttagcaattctaaaactactttacatggactctaggattgaacaaacacatatattgagaaattcgaaacaggtttatcactgaaggagaaagaagtcactaataagaaaggggcagactcatgtgtttaaatgcatccatgcagacagacagacacagaaataaacagttctgtgtgcgtgcgttactagagacatacttcctggctgcctccactatgagagactggaagctatgacactcccaggaacagtgagcacagcaagcaccccatctcgggtttttacatcattcttctcggagaactggctgactccaggttggagcagggaaaatacaagatgaggctggtggaccttacagtaccaagaagtaggaaagtgctccagaaacaaagaccagaagagggcgtgtcccaagaacacgccacaaactaggaggccccagtggcccaaggggaacacgtggagcaggaagccactccggtcctatgaacaataaccctgggatgtccactctgatccgcaaatccacactgatgtcaataagcagacaaataaacgagaacaaatggaagagaaggatagcaacgcttccctacaggatcccaattgatacagtagaaggaatgaaggaaacagacaatcgccagagaaaaaccacgacaggaaacctcaggcgtaactgctgcaggtgcggcccaccagcaaacacagcccatcagcaacgctaacacagtgggcagaagcttatggagcagctgtggatacactgtctcgaagcacctgctccacgatatctatttgctgctgtgatggctctaatacaggtccagaaactctgacagccctcctccagggacgcttatatcctccccactgggtgtgtatttacgactgaagagccgtatgggagggggcacaggagcgccacagtaaggcctgcagaagcccctcaggcaggagactaagccgtccccacaacacacccacactcccacaccaccacaaaccaacacgatgcgtgtgagaacgtggggagggtgtcgcacctgtggagctcctccaaaaacccaaatcacctcagtctagtcacgagaaacaacagacaacccctgatcaagggacagccaaccatcgcctggccggcaccaccagagggggaggtcgtgacacgaggacagaccgggacaggacaactcggcgccacgtgggtccttgctgggatcctgggagagaagaggggctatggtgggaaatgggaaatccaggtgaggcctgcagtgcagttactggggcacagacataggtttcttagttttgacaagcgcaccatggtttatgcgaggtcagcattaggggaaggcaggttgaaggggatacagaaattctctgtactatttttgtaatttcctgtaagtttaaaattatttcaaaataaaaagttaaaagcaaaaaattctgggagctatgctgaaagagaaaggagtggaatcacttgatacctctgaccatggtcttcaggctatagaaaagcaatgtgagcagtgctgggtgccaggaaggcatgcacactgtgaggtgctgcagagccagtgacatcagggcactgacgccaggccagccagagcttcaggaccagaggccccagactcaccttgaccatgatgttcaacatggcgcctgggtaggagatggtcactttgggcttcttcacattggtcgtcttgaagacaaaattttctgggaagctgttgggcaggacgcaccatataccatctgtgtccagctctaagggcctccttcagagaaagagaggagcaaggtcgtgagttcccctttccttttcacccagtgtgtggcctccagccttccctccttccttcctgcccagtgtgtggcctccagccttccctccttccttcctgcccagtgtgtggcctccagccttccctccttccttcctgcccatgcttgcccccaggacctgctcccagccccacggctccccttctgcactcacccaatctgctcgatcagctcccgtgcctgggtgatgatgttggcccctgtgaagcagacgatgccagccatctccatggagtaccagcgagccctgagaggacaccacaaactggtgggtggggctggcatggctcctccagggggtatcagaggcagtgaggagtagggaggaggaaaggagagatgcgacagggacaagggaagcagccaaatgtgcgtgcaccaggacagaactaaggtggaatctggctctgcccgaggacacctctctgtccccaccttggtgcccaggaaggatctggaagggtgcagtatgtgccactgcgtccagccgttcaggactccagcctcagcaggactcttaataccacccagacccattcacgccttctctactctcttcacacctcctcccaagccccattctcacctccagcttctcagagaaagcccaggcctagctgccaggcccaaccctcctccagcctgggtcccagccctgctgtcagctgtcccaccctcccctcccggcaccagccccatgccccttgtcagttgcttctctgcccctcccggacacgcagacatgctgtgaagcaactgcccgacactctgcaagtccctgagtgaggatccacgctgggagacatgaacgcgctggaaaatggcaagtcgtgtctccagcccatgatgcagagacacatacaccccacagcacgcatcactcatggacacccagaccctcaaagtcagcgtggcccccactctcttcaacctcccagccccaccccagcccaaagccttctccctccaacattccttgaatcagatgaacggccctccatgcacagcagcctacacctgaagctgccctaaacgtggactcatccattcctcccataagcctctcccgggcccgggcccacctaccccttgcgcatgacatagccatagaaggagttcaggatgcacttgtgggccagctgcagcgagtcatacagcacctccatgttcttgcagcgcttcacctcagccgcgtcgcccacctccacggccgccgagagcttctttttccacacctgagaagcacatgaacatggagcacctcacagattcttccatttcacattctacaaagtcaatagcccaggtttttagtattttgaaaattttcaaatctatagaaaacctaaaaaaccagtacaatgaagagtgtacattcttctcctagactggccaactgtcaatattttgtcacacttcctttattctgtctctctgtgttgacagaatcatttgaacattgtagatttcacggtctgacatcctaaacgcttcagcacagtttctagggaacaagagctactcgggggtgcctggtaaaatcaatcaagaaatgcagctaagaccacagatgtctcatcaaattccccacccaacatgagaaaaggtttttaaaggctgggtatttaaggaacaaaagcaaattccttaagataattactgagtgcctagtatgtgccaggaactccattgtactctgaagcacgagacagtcactacacttttggtgcttatttgatgagggagacagatgaacaagtaatttagcagttgcttaattaaaataaagtgagatagtaaggcagctccttaaaaggtaaatgtagaattagcatatgacccaacaactctactgctgggtacatatccaaaatcaccaaaagcagagacctgaagacgcacttgcagcccatgttgaaaccaggattgctcgcgacagccaaaaggtggaagcaacccaagtgcacgtcggtgtatgaaggatagacaaaatgtgacaaatccacacaatgaaatattattcagccatttacaaaaatacagtacagatacacgctgtatgttgataaaccttgaaaacatcatactaagactgggcgcggtggctcacgcctgtaatcccagccctgtgggaggctggggtggatagatgacctgagttcaggactttgagaccagcctgggcaacatggtgaaaccccgtctctaccaaacatacaacgatcaggcgtgatggtacgcctgtggtcccaggaactggggaggctgaggcgggaggatcacttgagcctgggaggtggaggctgcagtgagccaaggtcacaccactgtgctccaaccttggtgacagagtgagaccccgtctccaaaaaagaaagcatcatgctaagtgaaaaagccggtcacaaagatacaaatactgcacggttcacttacatgacatccctagagtcgtggaattcagagagagaaagtggaatggggtcactaggggccagggaggaggtggggagctactgtttgatggagataagagtttccgtttcagaaggcgaagaattctggaggtagatggtggtgatagttgcacaacagtgcgaatatgcttcatgcccctgaactgagcacttaaaaacactaaatgtcatattatgtccgccttaccattataaaaaagaacatgtgacgatgagttcagcagggcagtgcaggatgccagggggccgcacagcaggggccgtgctgagtctacagtgaaggtctctcagaaaaaaaatggctcaatctgatcagatataaaataatgacccgttggtatcaaaacagaggtgttgctatgcattttccatgttcctaccggatgaaatacgtcagttaaacacgaggggccggatggtgaataccatagatgagaaggccttagagtttctaggaactcctcacctcccatgacagcgggaaagagataaacaataggcgaaggcagttgggttcgtaaaacttgatgtactcaaacggccagccagctgtagcttgctgacccctgctctaaataatcactttagaaatcatcctttagggtccttctgaggcctcagaccagggtggatgatggtctgcatccttcgtggccatcaactcttccaagtcaaaaacaattgcacgttaccatccgagtgcaagtgcctgctcagaggatcccaggcaaggagccaagagtgcccacttcatgagccgactgaaactgccctcacagaggccaaagcttgcagcccctcagagctcaccttgtggagccctttgaactcgtaacgcctgtcccggaaggcacgcacggtgtccacgtagaaggagttttcccgctggcagatggtggtgagacgctcttccaccttggtgatgtggatcttcttgtaggctttccggcagtaatctaagcacgacggagatgggcagagcaggtgggtgagatctcccagagcagagggagccagggcacaggggtgctgaagaacatggcttctacgtcaccacaaaggagcaacagctcagatacactgctagtttctcataccgaaaaaggtgggcgggcacggtggctcacacctgtaatcccagcactttgggaggccgaggcaggcggatcacttgagcccaggagtttgagaccagcctaggcaacatggcaagaccccatctctacaaaaaatacaaaaaattagctaggcatggtggcgcacacctgtagtcccagctacttaggaggctgagatgggaggattgccggtgcctgggaggttgaggctgcagtgagccaagatcacaccactgcattccagcctgggtgacagagtgagacctcatttcaaaaaaaaaaagaaagaaataggacagcccaggggtaggaacaggccaaataccccaagaccacagagcagcagtgtctaacacttgcagatggggaagcaaataaaggaccctgcagtgagagcacagcttacagtgacctagagcagcttctggtctgctgtgacaacacctctggggccccagctgggatggaccaacgcagcccagtaagaacagaaagtgggagcaggagccacatctttacagccgtgaccatgcccaggcactcacccgccagccttctcttctcgtatttcgcctgttcctcgcgggacagttcatgaaaggcccgagctggcccctctgggaacaagggggggaacttctctgactccagctggtgctggatccgatggtattcgctgcgactggctggcactgggaaggaggcaatgggggcaagttcaaaaggaggcacagacacaccggcttcccaccaagtggagaaaggcggccgacactcacccacccgtttcccaccgagtgcccacccaggcggccgacactcactgaactcgcccctccactgccaggccatcttccgctggcagtttgctccaggcttattgaagtcacaggcagcacaggtggcttcgtccaccatggcagagggctgggaggggtgagaaagcacttagggctgggcagagagagctccgactctgacacgggaagtaaagtctcacctgcaggcggttggtcaggatgatgttggggtacatggcccccacgtccaggtggtagatgagtggacactcgatgcggctgggaacgtccttcagggaggcaagcttgctcttaatctcatcacacacctgcagagaaagcgaaactcagtagaggctggtgaccaagcttgcctcgtgtgcagttcaccaaccccttttagacattcaggagaggaaaaagctgaaaaatatataaatagagcaaaaactagccagaagaaaaaagttaagaagggttgccatcatttctatgaaatacattaaatttggtggagtcattagaaaattacttgaacactaaactctccttagtattaaaaaaaatccttaggccaggtgcagtggttcatgcttgtaatcctagcactttcggagaccgaggccagaggatcacttgagcccaggagttcgagaccagcctgagcaacacagtgggacccccgtctctataaaaaataaaaaattagccgtgtgtggcggtggcacctgtagtcccagctactcggaacgctggggtggaagaatcgcttgagcccgtgaggtcaaggctgtagtgagcccagattgcaccactgcactccagcctgggcaacagagccagatcctgtttcagaaaaaaaaaaagaaaaagaaaaatccttaaaaccctccaaagtagtaaaaatagaaaacacacctaaaattttaagaaaaaagtgattacaaggaataacatctattccatagaacaggaaataccacaacagtaacacctattgtttctacttgaattacagataaacgaatcagccggggaagagcctccactgcacccttctctgcccagtaacggcgtgttctgaaaggctgtccagtcaagaaggggaggatgggctgggacaagtgaatggccaagtttccatggtggggacaccacctggacatgccccacgtggctgtgagcccctgctgacatccccccagccaccctccgcccaacaggtgacccttcagggacacaaaggcgatcctgggcttccctttcaagggcacttgcgaggacttaggaatcgctaacaggacaatgtcatctacagagctcccttcctcactcaccagggagcctggcgtcctcacatctacagagctctcttcctcactcaccagggagcctggcatcctcacatctaccacacctccagcctcactctacctgcccatctcactgtttcttaaagactttaaatatctgcttctaggtcgggcgcggtggctcacgcctgtaatcccagcactttgggaggccaagcgggcagatcagctgaggtcgggagttcgagaccagcctggccaacatggagaaaccctgtctctactaaaaatacaaaaaaaaaattacccaggcgtggtggcaagcgcctgttatcccagctactcaggaggctgaggcaggagaatctcttgaacccaggaggcagaggttgtggtgagccgagatcatgccattgcactccagcctgggcaacaagagtgaaactctgtctcagattctgagacgtctcgccaccacgcctgggtaatttttttttgtatttttagtagagacggggtttctccatgttggccaggctggtctcaaactcctgacctcaggtgatccacccgcctcagcctcccaaaatgctgggattccaggctgcccaggctggagtgtagtggagcgatctcggctcactgcaagctccgcctcccgggttcttgctattctcctgcctcagcctcccgagtagctgggactacaggtgcccgccaccacgcccggctaatttttttatatttttttagtagagacggggtttcaccgtgttagccaggatggtctcaatctcctgacctcgtgatccacctcggcctcccaaagtgctggaattacaggcgtgagccaccgtgcccggccatggccgacattctttaactcctatttgttattcagacaaggctctcttcctgatcggttcataagagttccctgaagtataataatggatgtggctgacaatagccaaacagtgcttcacagcttgccaagagtgtacacatattcttgtttaaattttgactagtgaatctattacaagatgtttcttgagggcaggcacagtggctcacacctgtaatcccagcactttgggaggctgaggtgggcagatcacttacagtcaggagttcgaaagcagcctggccaacgtggtgaaacctcatctctactaaaaatacaaaaattggccaggcatggtggtgggcacctgtaatcccagctactcaggaggctgagacaggagaatcgcttgaacccaggaggcaaaggttgcagtaagccgagatcatgccattgcactccagtgtgggtgacagagcaagactccgtctcaaaaaaaaaaaaaaaaaaaaaaaaagtttcttggcatcaatgtgaaaactgttaaaaactctaaaccagcaacctcactgaacatgatgtagtgctgcacagtgcctgacataaagacctgagataggccaggcgcggtgcctcacacctgtaatcccagcactttgggaggccaaggcaggcggatcacaaggtcaggagttcaagatcagactggacaacatggtgaaaccctgtctctactaaaaatacaaaaactagccaggtgtggtggcggatgcctgtaatcccagctactggggagcctgaggcaggagaattgcttgaacccgggaggcagaggttgcagtgagccaaactcatgccattgcactccagcccaggccaacaacagcgagactccatctcaaaaagggaaaaaaaaaaaaaaaaaaaaaaaagacctgagatgtgccatgtcctgaggaacagggatcagagaagaactggtgtctccctctccagtcacataacacactttgtaagtgtgctttctaaccattatgtaaacagattttacagtcactaatcctgtcatttgtaggaatttactgtcatttttaagtctcaacaacaaaaagtaaataaaatttaaaacctccaatggctccccagtgcctataaaataaagtcctaatgctttaaaacaggacacgggatacatcccaccaggacccaccttccatgttactgcatttcaggagcagctcacaccccacctctcatgaagccctccgaccttgtgacagcatcacacgtcacaaccatgactgccctgtcccaccagagaccctgtgtcatccgtccacagcaccacacgcagcaggtgcacaataaacgtgctgctgaaagacgtggtctgtgaagaaggcgccaaacacagactggctcttcctgcctccctgatggttacctcttcaaagttggtgacttgctccacaggcactttctcctcttcctcaagggcgtggcgcaaggtcttctcaacccgctgcagcaggaagtcaaaggcggcaggattctagcacaacagtgagacgacggggtcagaggggaaacacacccacactagcctgcctcaggtttgacgctgtggctgcacgtggcaggttgtgcccgagaaagctccggaaggactcatgtgcacaatctgcagtgcactgccctaaagaagcccccggggggtgctgggccagagaagccacacccggtgaggggccgtgggacaggatggggagaaggggctttatttcagcccctgcagcttctgggtcctaccacagcacaagagtgggaagaatctgaatcccagggaagaagcacaccatcctaaaccggcaagggatatcgctgcggaaaaccccagactcgagggcctccacgtggcccccgacgtaggtctcagagtccagcacgtgtccgtcgtccgtcagcttattgaactcctgctcttgcttgttggggaagatgatgttggcgtggaaggcctgcaccatcagcaaggcctcacacagagtgccagagcccttccgcagcacctgcaagagaaaccaaggcttccagccaaaagcaacaccaaaggccctgacttgcaggcaaagtccaggaacctaagctgaacttcagtgtgaaaggagagaaaacctcgtggtaaatggctgcaaattctgcctcctgtggtttcttcctcacaccagggccagagaattcccaaaggacatccctgacgtcacacaccagaattctactgccgcctctggtgccagcactcctgggacatccacctccattcagctccagtgcatttggaatggggcaagggctgaggaggccagggtgccgacaggacagataatgctcacctcgtcgggctccatgggaataatggtgcacagagcaaagatgaatgggtggacgtacttcatgtacaggtagtaagtggcgacagcatctgacacagaatacgtggccagagtctgaggagagaacgccagagagcagggccatcaaaaatcaagagcccagggtcaagtgtgaagcacagaaagcaaagcctggcctgaccagcctgccgcacacacagtaaggagaccggcacaggacaaaacacgtgtgtcccggagacacagcctgctgggtggagcgggctggcatacatgcgtgcacacggcagcagggggagccgggatgtggctcacatgcctggggctgctccgtggccatctggatgcgtgcacacggcagcaggggcagccgggatgtggcttacgtgcctggggctgctccgtggccatccggcacatgtcctccgggtctagctccacgggatcatagcctagcttggccttggcggccgccttgagattatgactgcccacaggaaggtaactgtccctcttcacccacctggaaggagaatgagaacagaagccaggatgattctaacatgcagcccgggaacccctgagaactggcaaaactgggcaccacacagacagatgcaagttcctaacaggcacccaggagcctcacaccaaggccccacatggtgtagacaccttgtgaaaacccttcatcaggatctagttaatctcacagacctatccacaacacaaggaagcaccaggactggtccttccggccctcgccttcctcccatcctcagcagagtttgtggcctctccgacgggcgccccacctccttgggcctctccccagacctcaggtctgcacccctggggcctagttctatcaaccacactgatcttctctcctcacactgtcccttcagcacggaaacactcaagcccaccctcctttaatagaaggcaagatgtgatcagatgccaagaagaataaaaatttaaaaaataaataaaaaataaaaattaagaaaagaaggccccccacactctacccggaacctgtctctacctcctccctacagacgcattccctggagcagctgtccaggggtcatgtccggtctccaccccccgcagcctccaccctgtggccttcttctctcactttacctcttgccttcagttcatccactaccccagctttcaccaagacccacccgcaacccagtgagtcccaatctacagtgcgagcccaaaccaagcctcatggtggtcttcagggcccccatatgggtggggcttccaggctagcatatcggtagcagggtcacctcctgcctcaagccccttctctacccattccctgtctccacggatggcacaaaaaccccaggtgccaacccctccctaagaaccagcatccctgggcctccccctgccccacatgacagatcctgaatcctcacaaccctcactccctgccttggatcaggactgtcacaccgtcacacgctaaaccggccccagcctcctggcctccctctccaagccaagtgctgagcatcagagctaaacagaaacgcattcaggctgcaagcaccccagtggcactgtgcagaatacagaggccgtggaggcccctccattcccttccttccctccctcccttcccttccttccctccctcccttcccttccttcccttccctcctttcctccctcccttcccttccttcccttccagcctccttctgttggcatttccacatccacctgtcttcccaaccagtcatgtcagagcccccgaacgccgtgactctccgaagctctgagctgcctcccaccctagctcatatggaatctgtggttgtcccgtgaggcttgtcctgtgaggcagccgggctgccacatcccaaccttgcctgggcagagcagctccatgaggtcctaggtctgggacctgtcagctgagtgcgtctttccagcggcttccccaccccagaggctgatgctcaatgtgcctggtcactgatgaattgtcagtcaacagtcaaagacagcacatcccgggccctggcagggttgcagctgccatactcttgggtgacctgaaacggcctctcggaggccaccctcctcccatgagatgtggtgacagcacagtctgcaagaggccttcagatctcgctcacggacagcagtgaggagccatgctgctctgtggcccctacctgaggcagtccatgtggatgcactggggcgccttgtactccccctggctgtccttctggaagcctatctcctgctgcatgctcagaccgtggactgctgcccgggcctccacaaatggcctgggttggaaagaggacagacaagcaagtgggcaggtcaggctctaatgcccctttctccattcctccctcagacccagggaggaacccagacacgggaggtgcagagtgaacccaggagccacctcctaagtcgacatgggaagcgcccctgcaccacgcaacgccctccctctcaaatgctgcccagttactcatagagaagacacagactcaccagtcaaaaaagtccccgttgtaggtgaccatgatggtgggtttggtctcctggacgtgttcaaaccacctttggatcagatgagcctgaacccaagtcacagcagtcagaggtctgctctttctcttcttcaagctattccaaattcctctcccaaagttcagaagcagcagcctcatgttggcccttattcctgccccgcccctccgcccgtctctggcagaaaagacggtcataccctgagaacaaagctcatggagctgcaattctgatctgacggaatgcctgaggccttggaaagatccacatgtccgttcttcccacaataccgggtagtttcccaagtgatacctccttacctcatcgggttcattgaagacacaaaaggggccttcatattctggcttgggggtgaactcaaaatcttcaatatcttctgaaacaatctccctgttggtgatgaggtagccctagccaagttcattagcaatcagcacaagtcagaggctgcaaagccaagaaatggcgttcccaccctgcccacacactctgcctagagattctcactacaaagaagtccacagcaatgtgaaagtgctttaagcttcctgagaagagacgctctgtgtgtggattcccactcgaaaggggagggtacagctggaggtcggaacggcttggttgctcccattcctggactaactcattattcactcaacaaatactaacagtggggcagatgctgctgtagtatggggaccagacaaggtccccatcccaggagcttacttcccagaagccacctgctcacctggccatcgatcatgtaggaaatcatcataatctggtctgtctcagcatcaggaaacttgaggggcagtttggtcgtctcaatgtcaaatgccaaaaccacagggtcctgtggggacaaaataagcataaagccaagctctaaactccccattaggcctccctgaacacccacccccagcctgctctacctccctctggttgttaaaagagtcaaaaggctctagagctgggagaaggaccctaagactaaccaacctacatcaagagtatcacgactccctatggtatgaaaactgacatacctaagagagcagctgatcacaggacaagcctaaaatcacagaactttaggagaaaaactcttcaaaagacatcacctcattctggtggttatgacaactctgaaaggtaactgtggcacagagatgatatcttcatttcggaaaagagaaaactgaatacaaagactttcccaacaccacaaagtcatgtttgaaccaaggccttctagttacaaatccatttttcaccatgtcccttcactatcaactacccaaacggaagtcccagctttccctcgagtgtccaaatcctgcctagctcaaacactgatgtcatacagtgatatacaacaaaaaaggaaatgatactgtcagaaactgatgaaaaattctaactccatatttcctttaataaagtatttgggggaaaagcagcaaacatatctttgagtcagattcactctccagcactgaagaatattctctccagaaaactggaaattttaggatgaaggtaacacaagcaaaacttacaggtcgttcaacaaggtcatctcggcgggtgatttctaccggaaaagcatttcctcggtatctgacattgtaccaatgagcctgcaaaacacacagtgtgctaactagagttctacatccaggaaagtctattcttctgtggattcacccataatgatcatctcctggctgttaggaaattcatgtgagcagcgacccaaccctgccccactcaccacgtggatcttcaggtcaatggagaggcggatgtggtagggaacatcgtactcgcgcatgtccacaatgttgtccaactggtcagctatcttcttagaggtttcctcttcatcagtaatgacaccgcccctctgcagaacactaggaattaacaagagagcaactaactcagctgccagggtctggaggaggtgagaccagagttccaactcagtaggaagaggtgagaccagagttcaaaccgaggaaacacaaaaggtaaattgatgtggtttcaacgaccaaggcagtccttcctttaagaatggcttggactgggccaggcgtggcagctcacgcctgtaatcccagcactttgggaggccaaggaaggcggatcacccgaggtcaggagttcgagacgagcctggccaacacgacgaaacctcatctctactaaaaatacaaaaattagccaggcgtggtggcgcatgtctgtaaccccagatacctgggaggctgaggcaggagaatcacttgaacccaggaggcggaggttgcagtgaacccagattgcgccactgcactccagcctgggcaacagagcgagactccatctcaaaaaaataaagaatagcttggatgataactctacagacaggagaaaattcagtgtaagatgtattcattttatatgatgtgagttacaccccaactagaaaaaaaaaaagagggccaagcatggtggcttatgcctctaatcccagcactctgggaggcaggaggatcgcttcggcccaggagttcaagacaggcctgggcaacatagggagactcatctctacaaaagtaataataataataataataattagccaggcatggggtacacacctgtgatcccagttactcaggaggctgaggtgaaaggatcgcttgagcccaggagttcgaggccacagtgagctatgattgcaccactgcactccagcctgggcaacagagcaagaccctgtctcaaaacaaataagtaaatagaagaaaaaagaaagaaaacattaagtgctgccagtcaggagagccaggcatgaccatcccaccatggtcctgatactcaggaggctgcctcatgcaggctgaagagcaggcctgggcttcacacagcctgtgcatgggtctctgccatgtctaaagaagtggcccaccattgcggccactattggcctataagctcaaatactgaacgggctattcagggggaaaaagacagacgagtctcagatatggctcaagtctctgaggactcagtctctgatcacaccttccaatatttcaaaaagcaacttgtggcattgccagggaaggcggactccgggtagggactgtagaaatgttcagcatcccaaactgatcctcttttgtcagagggtaaggtaggttcttccgaagtcatctaaacttcattactcaagattttctcttcctaactggttactttgcatcctattattgttgatgctcaaatacttgaagaacagtgtttagtgttctaggcttaaatttctgtggacgatacccaaggttctctggagatgtgctgtgtaaatctcagcacttaatgaaattcatagatggattgtgttagggcagtaggatgagggatcttttcccctctaaggtgactttactattacaaccactcaattttagagccataaacccacccctccattggaaaagagagctaacacataaaatataacctgggaagccactgtttatttaacacagaacatacagaaatctctacctaattgctcaagttttccgtatcaaacagagccagccattaaggtaactttgttgctacgtgttcctgtctcctatccatcttgtcgttctgaaccgctgatgctttgctcacaagaccaaagtttacctggaaagcagagctgtgtacgcgtcgctggcgtgatcctgctccctgttcttcttcacggcaggggagatctccttcctcactttgacaagatcctccacagtgtggaaggacagcctgatgtaatttcgcttcaaacccaccaagtgatttggctataatgcgaagagatcacgctcattggttcaagagaaataggactttatgggtgagagggtaaacactcaaaggtaaacacacaagtcaaagagttggcgacttcaaggcaccttgtccaactctgcacgtggcaccaactaacaccactagagctctttggaaggaattttatagacggtcaccacaccgccccatcacccaacagatgacctgaatttctacctcttccgatcccacctgccaggaacaatgtagactctggcctcatttacccctggaaagtctgggtgatactcaccaagtccagatcctctttggggacagtctccacttttgcaattttgccctgaaacttcttggagagaaaagatgaaacttctcgctcacaaccctaatcaggatcagaatgaaaaggctttccattggtaaaatacatttccttccttgcctatttcccagttgcaaagcccaccacagaatgacacacaggtcgtctgacctgagtctatgaaacacactcacctttctggtcgcaatgtagaaatacggtttatagggcaaagccacctgttaagagtcaccaacccatccaggggtgatgagaaagaagaaagcgagagaaaagtgaaaacacattgcttgctcctatatcccatgaacagcctagggccagggtagccttgaccttggtagcatacaggaagtcagaatgcgcacttttcacaggggcaagaatctgaaagacacgctacttctcaccattcagagtcttcctgaactgacctctctcaggacatcttacgtgatgactgatggggcctccaggggcccgagttctgctgggctatgggctgctgtgcactggaagcctcccatgccctccctgacagtcacagagctacatgaacacccataaaagtgggttttagcttgtcgcagtcaggggcttaccttaaatctgcttccgtcatcttgaataaagtagtaatccactgcactgcctaagcgcttatcttcatctaaaatctcggtctacaagagaatcagtcaacacagacacaagaccatcctctacacagttagagaaactttcctcctacctttcgggaaactcagcactttagaaacaaaccctctcatctaggtctttactccacccctacattaacactaccagccttattcacaagaaccacactgtaacggcctccaaatggggatctctctcaatttctccctcataatccttgaaagctttattctgatggctaaaagagatgcccatcacctccggcttctcacagtggcctctctgtggccctcaatgacgttaaagaggaaaggagagctgggaaccttcacatctcccacctgattcactcaaagttccctcatgtgtcccccactctttagataaggaccacgctatgaccagaagggttgcagccatattcctgggtgggagaaggacctagtgcttacaggatgcatgttaatgagccagcctgtcttctcaccaggctccttcagccgctcaaaaccaaaccgcaaatccatcttatccgtccactgactccgttccaggcgcttgagtgccgaaactgaggaagtggcgccatcatccctgagtgaaagaagggaaccccgtgcttaatttgtaatgccacctgctgctgcttctttttttcttttttttctttttttttgagacggagtcttgctctgtcgcctaggctggagtgcagtggtgtgatctcggctcactgcaagctccgcctcccgggttcacgccattctcctgcctcagcctcccgagtagctgggaccacaggcgacagccaccacgcctggctaattttttgtatttttagtagagacggggtttcaccgtgttagccaggatggtctcgatctcctgaccttgtgatccgactgccacctacttctgcaaccctcatcccacctagtgttaagtgtttcggatatgacagggtatatatattcctgaaaaaccccgagcttggaaaaaggctcattaagataaaaggactcattggaaaaacacaattagggcaggcccttcaaaacctgttcaactttataaccagaatactaacaaaaagagtcatgatggctagacactgttgcctcttgggacactaaaaatgcataaaactagccagacgcggtggctcatgagagtgcatgtaacactgacatgatttgaataaaacagacggattgtcaggccaggcacagtggctcacgcctgtaatcccaaaactttgggaggccaaggcgggtggatcacctgaggtcaggagtttgagaccagcctggccagcatggtgaaaccctgtctctactaaaaatacaaaaaattaaatcccagcaccgtgggaggccgaggcgggcggatcacgaggtgaggagatctagaccatcctgctaatacagtgaaaccccgtctttactaaaaatacaaaaacttagccaggcgtggtggtgggtgcctatagtcccagctactcaggaggctgaggcaggagaatggcgtgaacccaggaggtggagcttgcagtgagccgagaacgcgccaccacactccagcctgggcagcagagcgagactccggcaaaaaaaaaaaaataaataaaaataaataaataaataaataaattagctgggtgtggtggggtgggcctataatcccagctactcaggaggctgaggcaggagaatcacttgaaccctagaggtggaggttgcagtgagccaagattgcgccactgcactccagcctgggtgacaagagtgaaacttcgtctcaaaaaaataaataaaataaaataagataaaataaattagatgggtcgtctcaatgtcaatttcttagttgtgacaattgtactctacttacacaagatgttatggtgaagtgatacgggaatctctgtatcatttctgacaaatgcatgagaatcaatctacaattacctcaaaaaaaggttgagggccaggcgcagtggctcacaactgtaatcccagcactttgggaggccaaggagggtggatgacttgaggccaggagtttgagaccatcctggctaacatggtgaaaccccgtctctactaaaaatacgaaaaattagccgggcgtggtggcgggcgcctgtagtcccagctactcgggaggctgaggcaggagaatggcgtgaatccaggaggcagagcttgcagtgagctgggatcatgccactgcactccagcctgggcgacagagcgagactccgtctaaaaaaaaaataaaataaaaaaagaacaagataaaaaaagaaaggaagacccttcctttgtctgaaggtattccttggatcaccttcaactcaagagcagaatgaccatattccaagactaggatccttacttctcatgaaagattataaccacttgtggtaggcaggcaggatgacaccccccatgaaagacccacatcctaatcccccaaacctgtgaatgttatcttacaagacaaaagggtctttgcagatctgactaaattaagggccttgagattctgcttagctgggtgggcgcagtgtaatcacaagaatccttgtagagtgaggcaggagagctagagtcaggaaggagaaagggatgggagagagagggtaggggggagaggagatgcaacccttggttctgaagatgaagaagcagcaaggaaacagattctcccccgggaaccatcacaataaatataaccaaccagacactttcatattacgacttctgacttctaaaaccgtaagagaataaatttatatagtcactaagtgatcatgtgttactgcagcaataggaaactgatacaccaccatactgtataataaaggtttaatcttttaaatagttgaatgcacccgtaatcaaaaacacagaaaaactatattccaaatcttgctagagaacagcctcagttctgagtcccagatctttatcaaaatcaagagtgaatgaagtgctatttacgaggcatcacctcttaacaggggcgcacggccctctatgccagtcctccaaatatccttgcctcaagtaagttggattaagtagactagaaaactgctcactgggaccatatttcctcccaaaactgctttctctgagctgtgtatctcacttttaatccagggacagtaagaaatctgaaaaatggggataagtgtcacacagggagctaccatcgactggttactatatcacaccgtcccagtactccacacaggctctcattcacagagagctaccattgactggttactatatcacaccgtcccagtactccacacaggctctcattcacagagagctaccattgactggttactgtatcacaccgtcccagtactccacacaggctctcattcacagagagctaccactgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagctaccattgactggttactatatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagagctaccattgactggttactatatcacaccgtcccagtactccacacaggctctcattcacagagagctaccattgactggttactgtatcacaccgtcccagtactccacacaggctctcattcacagagagctaccattgactggttactgtatcacacaatcccagtactccacaggctctcattcacagagctaccattgactggttactatatcacaccgtcccagtactccacacaggctctcattcacagagagctaccattgactggttactatatcacaccgtcccagtactccacacaggctttcattcacagagctaccattgactggttactgtatcacaccgtcccagtactacacacaggctctcattcacagagagctaccattgactggttactgtatcacactgtcccagtactccacacaggctctcattcacagagagctaccattgactggttactgtatcacaccgtcccagtactccacatatgctctcattcagttttcatgacaacccctacgagggaggccactggtgtccccatttcacacaagaagaaacgcaggcaaacagcacccactgcctcctggggcacactcacctcccaggactgttttaaggatgagatgaggtaacccacataaagcatgtaaggtaaaagccatcacttgtacttatcccagcagcagccttccccctgcctggaggccatcactgagcttggggcagggcagtggagtggagcacgtgagtgcagtcctgtgtcctgaagcagggcagtcagtaaccgtctctaagctccaagttccaacacaccatgtagaccctaagggtacctgcctctctagggcttgcctgatatggacagacagcgatgagcacaacagcagttagggatccttaccacttggtttctcctctgggaagaattttgttcagctaagtgtctgtaaaaagcttcacgttctcacacgttttttctatttttttttttttgagacagagtttcattctttgttgcccagcctggagtgcaatggcgcgatctcggttcaccgcaacctccgcctgccgcgttcaagtgattctcctgcctcagcctcctgcgtagctgggattacaggcatgcgccaccacgccccgctaattttgtatttttttagtggagacgggatttctccatgttggtcaggctggtctcgaactcctgacctcaggtgatcctcctgcctcggcctcccaaagtgctgggattacaggtgtgagccaccgcgccgggcctcatccgttttctgcttatggcaggccagtcctccggtcatgtttaccgtttgctctggccaccaagcagccgcgtcttatccttgctctattttttttgagactgggtctggctccgtcgcccaggctggagtgcggtggcgcgatcccggctcacagcagccttgacctgccgggctcaggtgaacctccggctcggattcgggagtattaatagctgggacctcgggcgcgcaccaccagcctgtctaatttttcttgtttttacaagagaagggccgggcgcggagtctcacgtctgtaatcccagcactttggaaggccgaggcgggcggatcacctgaggtcaggagttcgagaccagcctggccaacatggtgaaacccggtctctactaaaaatacaaaaactagccgggcctggtggcgggcgcctgtaattccagctactcgggaggctgaggcagcgggatcgcttgaacccgggaagcagaggttgcagtgagccgagatcgcgccactgcactccagcctgggcgacagagcgggactccctgcccaaaaaaataaaacagaggagacgaggtctctctctgtagcccaggctgatctagaacaggatcctgggctccagcgatccgcccgcctcggcctcccccagcgctaggcccccaggcagggtccccggccccgcccctccccgcaccctccccagccgcgcgtccaccccgcagggcctggcccgggtcccgccgctctcatcgcccccgccgcgcggcaggtcccaaacgcagctgcgcggaaggcgaggcccgaaaaacctcagaaagagccgagcagggaaaggccgcgcggcccgcctcgtttccccgcaaagaagccgcgcccgtagcgcctccgcccgccccgagcccctccgtcggcggtcggggcgcgccgccctaccccagtcaggcgcggcgagtgcgggcggctgcgggaaccgggcctccctcccgcctcggcggcgccagccgaggacggccccatggcaccctccggagggccggcccgagagcctcaggagggcgcccctcacctgctggcctcgccatccgcgcctgggtccgcgcgccgccgcccgccgctcctcagagacatggagccgttggctaccacctctgcttcaggggagaaatttggcgcgctcccacccagactcgcgagagccggaaatgccgccgtccatcaagaggcgcgctccgcccctcccccgccccccgaggcgctccaattggcgccggcgcccggcgggggaggtggccggcagggaccggggaaaagtgtgtggtaggcgcgcgcggcgcaccgtggggttgggaccgggcggcgctgcgggccgcggtggggccggaaatgtcaggcggtccccactccgctctcggcgcctcgggctccgcgcccggccagcctgaggtggggtcggtgcccccggcggcacggcgctggggaggcgatggcgccggccgcgtccaggctgcgggccgaagccgggctcggggcgctgccgcggcgggcgctcgcccagtacctgctcttcctgcggctctacccggtgctcaccaaggcggccaccaggtgagcgggggcgcgggaatcggacgccgccccggccccaggtcggccgcagcggcgcggggcctggacgggagcgccgggccgggaccaggctgggggcgcgcccgggtcagaacccccggagcgggcgccctccgacccggcgctgaacttcccgcggcgacacccgcgtccgcagtcagcgattgtgaggcgccttgcggatcccgccctcccagcgcgtggagggcccgcccagacccgggggtcggcgctgaggttccacccaaggacccaacaggggccccgcgcgcccggggaagccacggcaaggggagcgggtccgcaggcgcgggtgaagacagggcgaggggagcgggtctgcggggcgcgggtgaagacagggcgaggggagcgggtctgcggggcgcgggtgaagacagggcgaggggagcgggtcttgggggcgcgggtgaagacagggcgaggggagcgggtctgcggggcgcgggtgaagacagggccaggggagcgggtctgcggggcacgggtgaagacagggccaggggagcgggtcctcatggagcgtgtggagacagggccaagggagcgagtctgcggggcgcgggtgaagacagcgccaggggagcgggtcttgggggcgcgggtaaagacagggccaggggagcgggtcctcatggcgcgggtggagacagggccaagggagcgggtctgcggggcgcgggtgaagacagggccaagggagcgggtctgcggggcgcgggtgaagacagggcgaggggagcgggtctgcggggcacgggtaaagacagggccaagggagcgggtctgcgtggtgcgggtgaagacagggccaggggagcgggtctgcggggcacgggtgaagacagggcgaggggagcgggtcttgggggcgcgggtgaagacagggccaggggagcgggtctgcggggcacgggtgaagacagggcgaggggagcgggtcttgggggcgcgggtgaagacagggccaggggagcgggtctgcggggcacgggtgaagacagggcgaggggagcgggtcttgggggcgcgggtgaagacagggccaggggagcgggtctgcggggcacgggtgaagacagggccaggggagcgggtcctcatggagcgtgtggagacagggccaagggagcgagtctgcggggcgcgggtgaagacagcgccaggggagcgggtcttgggggcgcgggtaaagacagggccaggggagcgggtcctcatggcgcgggtggagacagggccaagggagcgggtctgcggggcgcgggtgaagacagggccaagggagcgggtctgcggggcgcgggtgaagacagggcgaggggagcgggtctgcggggcacgggtaaagacagggccaagggagcgggtctgcgtggtgcgggtgaagacagggccaggggagcgggtccacatggagcgtgtggagacagggccaagggagcgagtctgcggggcgcgggtccgcacggcgcgggtggagacacggccagggaaggtgttttgagaaggtgacattgaacaggctgtgtaaagaagtggagcagaggctctcctggcacagggaacagcagggcaaaggtctctgttaggttttgaagggaaggccggcgttaaagaaaggcggagagaggtgcagcttggactcagtcccgagggagggaagatctgtgtgtggagaaagtgaaccctgagcaagaggcaggagatgtgaagggaatcgccagggatctgatcgagaaggtgtctaggtccgtgctaggaattttggattttatagtccagagagcttctcagaaggcaaatacaaaccaaggcctggagggagccactgggcctgttccacctttttatggaaatttttattgtgataattgtagattcacaaacagttacaagactaacatggagagattccttgcacaccttcccagtgtcccccattggttacattctgtgaaacgtagtgcagtatcgaccagggcattgcgtggacacagtccacagatcctattcggatttctccatttttcttgtagctgtatctgttctgtacagttttatcacatctgtacattcttgtgttcactaccacagtcaaaatgcagaacagcgtcatgatagggctgtcctgttgcccgttcataaccacacagcttcccaactcccaaactgccaaattatagtataacatcacagccaggatgttgacatagatactggaaagccacttgtccttacctgtgtgtttaagtccaccgtctccaccttttgatacaagaactatacattgcagccgctttaacaagaattcctaccccccgcccatctgctgcatggcctcagaacggccctgctaattcacctatgggaaagggacaccctcctgctggtcactgctgttttctgatgacctccctctccacagtggcattttgtcagcacttgggaacttcctggcccagatgattgagaagaagcggaaaaaagaaaactctagaagtctggatgtcggtgggcctctgagatatgccgtttacgggtgagtgccatacaaggggtgggtttaccttgtagccgctgagtgcaaccaagctgggcaccaaaaccgagtagttggagtactcttatttggaaatataattttttaaaaaccattgtagtaatcatcatgggaaaaaactcgaatggttcatatagtttgtatggcatatatacgcatacgtggttttttttgttttttctttttttttggagacagagtctcactctgtcacccaggcttactgcaacctctgcctctctggttcaagtgattctcctgcctcagcctctcaaatagctgggattacaggcacacaccgccatgcccagctaatttttgttatttttagtagagatggggtttcaccatgttggccaggctggtcttgaactcctgacctcaagtgatccaccttccttggcctcccaaagtgctgggattacagtgctaggagtacaggctcacatttgtggttttatcatgtttctttttaattggatgggtaggggtgactgtcttaattgggctgagaggcaaacctgaggacaagtaactcaacttaacctaaagtcagacttcaggattcaaaaaccctgaaagcgtcctagactgggctcatggaaagggaaaactgactccaatttgaccagttagtttctattgttattttaattttttttttttttttttgagacggaatctcactctgctgcccagactggagtgcggtggcgcgatcttggcttactgcaagctctgcctcctgggttcacgccattctcccgactcagtctcccgagtagctgggactacaggcacctgccaccacgcccggctaattttttgtatttttagtagagacggggtttcaccattcacaggatggtctggatctcctgacctcgtgatccgcccaccttggcctcccaaagtgctgggattacaggcgcgagccacagtgcctggcctctattgttattttcatagtgtaaacatccagaaaataaatgcttcggtaccctgaaaaatgtccagtttctgaaccactttctgagttgcaaaagcacagtaattcaagagttttaccaatttaatccaccgtgagctctcggccaacagtaatgtgaagtattttccaactacagtgatgttttctttaattcagaattcctgaagatcatttttatacttccaagcttgctaacttgagtcatcatggatttttccatactgtatttaaagcagtaatccccccaagaggggcaggtgatgagatcacctagcaggcctcatccaagtacagttttcccatccacaggacttcagtccccttccccactgagaatccctgcataggccacataaccccctatgactgggtgggaaaaaacactgagaaccacttatctaaagactgtcaacgtcacaagttgaaagacccctctttttgttgctgaattttatggaactgcaggcctcttgtcccagtagatgtggcagctggttccattctctcccaaacacacaggggaatgattagtagcaacgcacacaacctagagtgctgcaccaggtcctgcccttgccagttagttagtgagctcccttgccagttagttagtgagcacccttgccagttagttagtgagctcccttgccagttagtgagctccctgagccagttaggtagtgagctccctgagccagttagttagtgagcgcccttgccagttagttagtgagctcccttagccagttagttagtgagctcccttgccagttagtgagctcccttagccagttagttagtgagctcccttagccagttagttagtgagcgcccttagccagttagttagtgagctccctgagccagttagttagtgagctcccttagccagttagttagtgagctcccttgccagttaattagtgagctcccttagccagttagttagtgagcgcccttagccagttagttagtgagctcccttgccagttagttagtgagctcccttagccagttaattagtgagctcccttagccagttagttagtgagcgcccttagccagttagttagtgagctcccttgccagttaattagtgagctcccttagccagttagttagtgagctcccttgccagttagttagtgagcgcccttgccagttagttagtgagcacccttgccagttagttagtgagcgcccttgccagttagttaagtgagcgcccttagccagttagatagtgagcgcccttagccagttagttagtgagcgcccttagccagttagttagtgagcgcccttgccagttagttagtgagcacccttgccagttagttagtgagctcccttagccagttagtgagctcccttagctagttagagagctcccttgccagttagttagtgagctcccttagccagttagttagtgagctcccttagccagttagtgagctcccttgccagttagttagtgagctcccttgccagttagttagtgagctcccttagtcagttagttagtgagcgcccttgccagttagtgagcgcccttgccagttagttagtgagctcccttagccagttagtgagctcccttgccagttagtgagcgcccttgccagttagttaagtgagcgcccttagccagttagatagtgagcgcccttagccagttagttagtgagcgcccttgccagttagttagtgagcacccttgccagttagttagtgagctcccttagccagttagtgagctcccttagttagttagtgagctcccttgccagttagttagtgagctcccttagccagttagttagtgagctcccttagccagttagtgagctcccttgccagttagtgagtgcccttgccagttagttaagtgagcgcccttagccagttagatagtgagcgcccttagccagttagttagtgagcgcccttgccagttagttagtgagcacccttgccagttagttagtgagctcccttagccagttagtgagctcccttagttagttagtgagctcccttgccagttagttagtgagctcccttagccagttagttagtgagctcccttagccagttagtgagctcccttgccagttagttagtgagctcccttgccagttagttagtgagctcccttagtcagttagttagtgagcgcccttgccagttagtgagcgcccttgccagttagttagtgagcgcccttgccagtcagtgagcgcccttgccagttagtgagcgcccttgccagttagttagtgagcgcccttgccagttagttagtgagctcccttagccagttagttagtgagctcccttgccagttagttagtgagctcccttagccagttagttagtgagcgcccttgccagttagttagttagctcccttagccagttagttagtgagctcccttgccagttagttagtgagctcccttgccagttagttagtgagctcccttagccagttagatagtgagcgcccttagccagttagtgagcgcccttgccagttagttagtgagcgcccttgccagttagttagtgagctcccttagccagttagtgagctcccttgccagttagttagtgagctcccttagccagttagttagtgagcgcccttgccagttagttaagtgagcgcccttagccagttagatagtgagcgcccttagccagttagtgagcgcccttgccagttagttagtgagcgcccttgccagttagttagtgagctcccttagccagttagtgagctcccttagctagttagagagctcccttgccagttagttagtgagctcccttagccagttagttagtgagctcccttagccagttagtgagctcccttgccagttagttagtgagctcccttgccagttagttagtgagctcccttagtcagttagttagtgagcgcccttgccagttagtgagcgcccttgccagttagtgagcgcccttgccagttagttagtgagcgcccttgccagttagtgagctcccttagccagttagttagtgagctcccttagccagttagtgagctcccttagccagttagttagtgagcgcccttgccagttagttaagtgagcgcccttagccagttagatagtgagcgcccttgccagttagttagtgagcgcccttgccagttagttagtgagctcccttagccagttagtgagctcccttagctagttagagagctcccttgccagttagttagtgagctcccttagccagttagttagtgagctcccttagccagttagtgagctcccttgccagttagtgagctcccttgccagttagttagtgagctcccttagtcagttagtgagtgcccttgccagttagttagtgagcgcccttgccagttagttagtgagcgcccttagccagttagttagctcccttagccagttagtgagctcccttagccagttagttagtgagcgcccttgccagtcagttagtgagcgcccttgccagtcagttagtgagctcccttagccagttagttagtgagctcccttgccagttagttagtgagctcccttagccagttagttagtgagctcccttagccagttagttagtgagctcccttagccagttagttagtgagtgcccttgccagttagttagtgagctcccttagccagttagttagagagctcccttgccagttagttaatgagctcccttagccagttagttagtgagcgcccttgacagttagttagtgagcgcccttgacagttagttagtgagctcccttagccagttagtgcccttgccagttagtgagtgcccttgccagttagcctagtgagtgcccttgccagttagttagcctagtgagttcccttgccagtttgttagcctagtgagtgcccttgccagttaacctagtgagttcccttgccagttagcctagtgagtttaatgaaaagctccacaaccagggacatgtctgatgattcattattgagtgcttctcgaagcctggccctgttctgggcactgcagtggacagaagacgtagcctcccttgtggagcctgccttctaggggggacgagaggcacagactaacctaacatatgagataaggacagtgctaggcagaaaatgaaccagggccaagagtgttagcacaggcgtgcacacgtgctgggacgacctggaagctgacagtgtgaggaggagcgagccaacatagctaggcggggacgcgctgggagcagagagtcaacggcaggagcaagtctggtctgttagagcaacagagacagagcgcccctgaagccgacttatctgtacagacctgtgtggccaatactgagggacatcaggaagcaggggttaggacctgggatttgggggtgaagctagaccagagaagagcacatccagagaaccacaatctggctcacaccccctgggggcctcaggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggtgggtgtctgccacagcacttactgcagctcttcgtttagcacagggattcttcacctgacattctcggcagaattcagagggtctgcagatttttcactcaaattgaaattttgcattttcttttatgaatataggaagcaaacatctagtattggcaggacctgtttgtacccagtagagtcactttatttatttatttatttaaagacagggtttcactctgtcacccaggctgcagtgcagtagcacaatcatagctcactgcaaacctcaaactcctgggttcaagcgatcctcttgcctcagcctcccaagtagctgggaccacatgtgcgtgccaccacacccagctaatcagatatttttatatcacatcagttgttacagatatctcgaaatataatttatgctcattactacttggacctgccattagaggtcttgtcactgtgtaaagaaagaaacaggccgggcacagtggctcacacctgtaatcccagcactttgggagggcgaggcgggtggatcacctgaggtcaggagttcgagaccagcctggccaacatggtgaaacctcgtctctactaaaaatacaaaaaatttagctgggcacagtggcagtcgcctgtagtcccagctacttgggaggctgaggcaggagaatggcgtgaacccgggaggtggagcttgccgtgagccgagatgtcgccactgcactctagcctgggtaatagagccagactccgtctcaaaaacaaaaaacaaaacaaaacaaattagccaggtatggtggtgcgtgcttgtaatcccagctactcgggaggctgaggcaggagaatcgcttgaagccgggaggtggaggttgtggtgagctgagattgtgccactgcactccagtctgggcaacagagcaagactctgcctcaaaaaaaaaagaaaaaagaaaaaagaaacagggccgggcatgatggtgcacacctgtaatcccagcactttgtgaggccaaggccagtggatagcttgaggccaggagttcgggaccagcctgggcaacatggcgaatacccatctctcaaaaagtaaaaaatgagccagtgtggtgatgtgcacctgtagttccagctgtttgggaggctgaggtgagaagatcccttgagcccaagatgtggaggctgcagtgagcagagatcacaccactgcactccagcctgggtaacagagcaagacactggttcaaaagacaaaaataaataaataaataaataaacacattagtctgtcaaaattttttctgaatattttgataactg

SEQ ID NO: 540 - DNA, 38499 bp, Homo sapiens
ccggaggggtggaggttgcagtgagccgagatcgagccactgcactccagcctgggaaacaagagcaaaactctgtctcaaaaaaaaaaaattattaacactgaatggaaacatttttctatatgtaatcactggatggaaaggatataaaaaaatgcataactgtctatgagatggaatgttgtttaatgctgggtctatgtggtacctaaaatcatcctgtccaggggcacgtggcccacactttgggaaacatggctttaagtagatgggatgtctgtggggtcagggaaagggagagctaacacggaactctgctccatggcagaacaaaagcagaacttgggtctcccttccacacccactttgctcactctgctgcagtcttttcatgaacagagactattacagaactaattaaattcaacaggcagattcaccaccaagtgcaagatacactgccgtaagatacagaacaatgtgaccttggaataggcacgcaacaaaaacatccaacattgcacagctttttactatgttccaggcaccattctgagtgtttcatatgtattaacatattttatcctctcagcaagcctatgagatacatgctattattatcccactttatagataaagaaatcaagaggctgaggaaccttcaagatcacaggtctagtaagtaaaggagccaggattcaaatgccagctgtccgccccagagccaggtgattaatcaccactctaaccagactcagaaacatgacacagaagtagcccctaaaggtccacaatgcaaccctgtgggactggatacataatttacagggttcagtgcaaaataaaaatgcaggctccttatttaaaaagttgagaatttcaagatggtgacagcagagcatgaaaccaagtgtggggcctgagtggagccctgtgcccaggtgtacaggtcgcatgcccaggaaactggccttgcagccaggtgagccagctgtcaattcccagagccgggcattccagccgagcttgtgtagtgcagctgactgtgaacccagacaaacctcagttggctaaggaagaaagttgtgaaggatgaaaaaaaggtcatagggcctttgagagggatgctagtgtttcttacagaaaatattcagacccagccaggtgcggtggctcacgcctgtaatcccagtactttgggagactgaggcgggtggatcacctgaggtctggagtttgagaccagcctggccaacatggtgaaaccttgtctactaaaaatacaaaaattagccaggcatggtggcgggcacctgtaatcctagctacttgggaggctgaggcaggagaattgcttgaacctgggaggtggaggttgcagtgagacaagactgtgccattgcactccagcctgggcaacaagagcaaaactccgtctcgaaggaaaaaaaaaaaaagaaaagaaaagaaaaaaaaaagaaatgaaaatattcagaccccaggggacatgcctgtattaaccatcactagattttcagatgaatgttgttgaaggttcctctacactagaggctatgggagcttggttcccactgcacagcttggtgacaggtaggagagagcccaactccagcagcattttggaatgctgtccccaacatctggagcacaagatgtcagagagagactgggatgggttgataagggagaagatgacttcctagcctctttcgaggtctgatgatccacactttgagaatagacgtaggaaagaccttctactcctgtgtcctacaggtgtgagattctctagcaactgcagagtggttaacagcaaagaggacatgcgtacccacttctgaatagcagggctggctgcttcaatagagcgagaaaaaggtgggagtagaaggacaggggagaggagaggagatggaagcatggatggaggtgactgcagtcagataaacagttgtttggcacacaaacccagcgttccataaagtcctatgtggactctgtgagttcacaatagtttcccttgccagcagctcacaaaactgtgccttgattacaaatctcatgacaaatcaagcccttgaccaacagggactttgtcttgtctgctgttgtactccaagtccctagcacacagtaggttctcgaatatttgttagaaaatgaataaataaatggtcccaggaagtattttcacttctaaggcttaattattggcagaattaaccactgaagccatctcagtgttggcttttctttgcgagtagtttttcactaatttaatctcttcacttgttatagatatattcagattttctttttctcttgaatctatttcagtaatttgtacctttctaagagctgtccattttatttatctaatttgttggtacacaattgtttgcagtattctcttataattctttttatttctataaggtcagtaatgatgcctcctctcttattcctgattttagtaatttaagtcttctctctttttttcttggtaagtctagataaagatttggcaatttcattgatctttttgaggaaccaactttggttttccagtctctagtgtgataattgctactctaatctttattgtctttctcgatcagatattattctacatcatttttaaaaacagctaaagccacaaatctgccttgacccttttgtttttgcttctgctctgtcgatcttccttgaggcagcagatctttcatgacctattgcccaaaaaggatagagtcacagggtcacagacaattcttggaaaaatttacattggtgaatatatcaaaatgatattctgctacatatgcataacttatcttcactcttggaccacaaagatctatttcagagacaaatttggagtggaattttccttaacattatcctcaatagagcctaaagtatagaatacactcattttctcactcatatcctgagacctcagtggtcgtttaccagacgttggaattcctaaatgaataccattgccttaaaaatcatattcctcaggtcagaaggctagagtgctctagtacaggagtcctcaacccctgggtgagtgaacattaaacctgagctccatctcctgtcaggtcagctgtggcactggattccaggagtgtgaaccctattgtgaaccgtgcatgcaagggatccagactgtgctctccttatgagaacctaactaacgcctgatgatgtgaggtggaacagtttcatcctgaaaatcatccccctcaccactgtcccagcactgtactggtctgtggaaaaattgtcttccacaaaaccagtccctggtgccaaaaatgttggggaccactgctgtagtagattcctagtcagtttgaggtgtctttttttttttcaggtggacagaaagtaggatttattgttgggccttaggaggggcagcacagtggaagccctcatgagtgcagggcccaccacttgtccagagggccacgactggggatgtacttgaccccgcagtcatctggaatgagccgtttctcagccaccatgtcttcacattgaacttggtaatgccccacttctttgagatgtggatcttctggtggccagggaacttggccttggccctgtgcagggcctcaatcacatgctccttgttctgcagcttggtgccgatggacacgatgacgtgaccaatgtgaaccctggccacagtgccctggggcttttcaaaggcacctcatatacctgtttggagcctgtcagcccagcacaggacgtcttgttgatgtgcataacgtggaaggggtggagccgcacttggatatgaaagccatcctcgccgcaacttttcatcatgtacttattggcacaaattcaggcagcctccagggcttcagaggagagctgctcatattcatctgacaccatgtggccacagagtggaaactcatccacttttaccttcttccaccccaggtcaaagatgggaatctcggcatcagcaacacctcgccagaagagaggctttgtgttgttcttacaataatggtaacactgggtggggcagcggcccatggtgacaccagaatcttcagtggcacacgaaagggaaagagcttgagatatcttttgaacttaagagtcatccctttctctaagaactgacccccatctagaagatgggcagccccaattgtactgcatgaccctgtcctcagacccagcttaatggaccagaagtagacagctgactgaatctggacaaggtagatttccttcctgaaagtctgaaattatgactaagaggcagccgtacttgtcttctggttgttggaattgttccatgtgaactcaggagctgagggcaaacatattccaccatgagaacagagaaacagggaagactgctctgttggaaaacagaaacatgttgcagttctcctaagagaaacagaaacagaagatggtgactgggtccctgacagcttcctgctttccctgatggctttctgatctagtcccatattaaaatctagtggcatttctgactttgaattccataagacacccctgtgtccttataaattctcctttgctttgtcatcataattatcaacattgtcaacattatcaacaaaaaagataaaacttcctgaacatttactatgtgccaagtaaagttccaattagcttacacaaattatcttatttaatcctcccagtgaatccatgtattacttcattttacatatgaggaaacagggacaaagaaattaagtaacttgtccactacagtcagcaatagataaaatcaggattcacaccaaggccatctgacttcagaatctgagctctaaccaccatgttatacagtttagcctgctcacgttggttcttagcacttgcaactaagacgtattagctaaatagggctcctcagtctggccctactctgcctaacaaaaattatctgccattttccccagtgtgctgaagccagcattcccctaaaacatactatggtcaatgtcacctccatgcctttttgctccttctccttcccacccacccccacttttatattctaccaatgattcagggtccacttccagttctatcttccccagggaaactggtcacccgtatgttctatcagtcagtaactatgctgccttgcaatggtggttaatagcttactgcatgtatgtcaggcctctatgatgagattgtaaggtctttaaaagcaggggctatattttctctttcgctgtgtccccaaaacactataattcattgtaagcatgcaataaaagctccttgaattgaactaaaggcagtaatcttagtggcatagacaaaggcagggagagaaggtcaggcacagagaggcttaactttaaaggagagcttaatgtcttttcataagtgtcaggaatggccttcacatactcatcttgttttaaaattttatgtgtcaatattacattttaaaagttttaaatctctataggaaaaaggatattatattgaaacataaatcttccataattgctgaattctcacccagcccttgatctccttgttgagtggtcccaagtctgacattctgaaagtgacatacgctgctccccacagcctcaaacacatctctgatctcactcttgggcacaccccaagccctgggatgaccatcacaactcccctctgccccaccatctcagaggaggtaggtttcttccccttaagaagagtatgggggtgatgagagtatcccagtgcctgagtcttcctaggccccaggaaggccttggaatcctctctgatccttagcattcaccctcatctatgaaagcaactgtttgcattatgtgtccacttagtgtcctgacaacagtctaaactcaatccatccaaaagcaaatcaacatcttccccaaagttgttcctcctctttttacggtaatagctgccaccatgatccaatcatccaggcttgaagcctgagtcatctttgactcagaacatcacagtgctaaaaaaaaaaaaaaaagtattttaagccatttgcctccttcccccagtatatgatttatactcagactctgtctctcaatatcttaaaatgcatctgaggtctgtcccttcctgtgtattcccccgataaggctctggattttggcaacaactcctgaactactactctcttttcctgctggtttgaatagggagagaagcaaaagtaaactggaaagtggaactagaagtctctaaaaccacaagtgttaaccttacccttgccagaatggggcacatgaattgtcctactagcaggtaacagctgagtttaaccaacatttaagaattaccaactacatcctggctaacatggtgaaatcctgtctctactaaaaatacaaaaaattagtcgggcgtagtggcgggcgccttgtagtcccagctactcgagacgctgacgcgggagaatggtgtgaacccgggaggcagagtgagccaagaccgtgccactgcactccagcctgggcgacagagcgagactccgtctcaaaaaaaaaaaaaaaaaaaaaagaattaccaactaaatgtcacacatgtggccttgtgtggggtgctggggccacagcaataagtaagacttccccagccctcaagtgcctagcgagggatgagagctgaggggggcgatcccagagggctctgcgagtcctgaaggggattgttcaatgctgagggcgaggtgaaggccaggagagtgtgcgtagggagaggacatgtgtactaggtttgagggctgaataggatttcaggcctgagggctgaggggtggagggcaattccaggctattaagcaaaggcttagtttacaggctggactaatccgatttgtgtgctgtgtcctgggctcccctgtggcagtgatgcaatcatgtgacagttggtggtcatgtgctgggtaaggacactttcaggaaggatgatatcacagaagtgatataatcaccagataactttctgagtaggaggcacatgtcagggcatgaattcaatggtgacagacgtgaaactgctgacagcattgttttcacttctacctcaagatttgtgtggatgtctacaggaaaccagggggtcaaaaatagaaagagaagaggtgctgaacattggagatggactcaatttccccctccaggcaattcttctccccaggatctctcacgggtttttgctttatacatatatgtaatgctatttttcaaacatataaagagactgttgtggctaatttttaaaacctataaatttatctaaaaatcctattgaaatccaaatgtcttttgccttacatacaccattagataataaaagcacaacttccactacgtaaggtctgattctttggtggggaaaagggattaaaagaggtcctcatcttgagaaaccactgctatacaccacaggtgtgtaatgacagccctgccttggtgatcctccaggttggggagtggcaccacatccaggttatgttgaatctcaatttacaatgtatagtgtactttttttttttttaagatggagtcttgctctgttgcccaggctggagtgcccattatgagtcatggagactcagattttgagtaagagagaaataaaactttgtgcttttaagtaataataagtcaatcctgactaatatcacatggtaagaagtctggattttattctaagtgggataggaagtcatttcaaattttgagccagagagtgataagatcttgtatatgtttaaatgacctctttactgtgtgtaggttatgaggcagaaggactggttgtaagtccattgaagttaatttagaatgaagtagtggtggcttgaaattagcggtggcagtagagattgtgagtcgaattcagaatatacaggcatgcaccatataatgacattttggtaaacaatggaccacatatggtggtcccataagattataatggagctgaagaagaaagtttgaagactaccagatatcaaaacttactgtaaagctacaataattacaaccagatggtactgccaaagggtagaaaaatagaaccatcagacaacagaaaattcagaaacagacctacatctataggaaaatttgatttgtcacaaaggataagctgaacactagtagggataggataatcatttcaatagggagtgctcagtcaattggatagccacatggaaaataatgaatcttggcccttagtcatatatacaaaaaccaaatccaggttgattgtaggtctaactttgaaatgtaaaacaataagaaatctagaaggttattgggagagtaccttcaggggaggaaaagatttcttaaacacgacacagaaagcacaaatcagagacagaaagattgataaaccattacattgaaattaaaaactatgttcatcaaaagatactatttagagaaaaacaatacccacaaaagtaggagaatatatacatatatatataaaatctcaataagtaacagaaggacttttaacctgattatttgaataactcctttaagtcaataagaaaaagcatacaggctgggcacagtggctcatgcctgtaatcccagcactttgggaggccaaggcaggtggatcacttgaggccaggagttcgagaccagcctggccaacatagcaaaatcccatctctactaaaaatacaaagattagctgggcatggtgatgcacacctgtaatcccagctacttgggtggctgaggcatgagaatcacttgaaccaggtaggcagaggtgagccaagatcgcaccactgcactccatccagcctcaggacagagccagactctgtctaaaaaaaaaaaaaaaaaaaaaaaaaaagaaagagcaatggacaaaaaaaaagaaacaagaatagatacttcacaatagaagatatccatatggccaaaaaaaaaaaaaaattgaagaagaagaaaagaaagaaaagctactcaacccatcaggaaaataaaaatgctgctaaacatgcccaaataactaaaattaaaaaaaaaaagataatgccaactattgctgaggatgagaagcatctggaactctcatacagtgcttgtggagatgtaaattggtacaatcacttagaaaaattggtcgtatttacatacccaatgcctgagtaattccattcctaggtatatatccaagaaaagtatacatatgtataccaaaagacaggtacaagagtgtttatagcagcactatttgtaattgccccaaggtggaaactatccaaatgcccatcaattgtagattggataaataaattgtggtatagtcatacaaagagcacacaacaacaaaaatgaaaaaactattgagagggagagatgcccaaggattcccagctgtttcagccctcatctgtttgagtcttcccagacaggtgagtaaagaagccttacagatgattctagactgagccactatctgactgaaacaacatgagaaaccctgagtgagaaccgcctagctgagcccagtcaggtcccgcactcatgagcaccacatattattaggacaattttaagtcactattttagggattgatattacacagcaatagataactgaaatatatgttgaagtatttaaagaaaaaggaaaatagaatatattacatttataaatctactttaagatgtttaagaaaatctaattaactaagtttgtaaaagtccctctaaaaactattgtttaatactaggttcatcaacagaaaaagagatttgtaagttgaatgtcacagcctaagggaaaacgaggtttttaaatttccacttccataaatttgaatcttaattgaaaaataaaaaataaccaccagtgaaaagctggatctttgactccattgatcctttcagacaatgcaaagaaacaacatagggaaaggagttgagtgatttattgagtgcttacttggtgccacggcatgtgctaggtgcttacctaaatcaactcattggatcctcacaacaaccctgtgaggtgggtttcataacccccactgtttaccgatgaggctcacagaggctatgtaacttgcccaagattctgcagctggtaaaggacggaatctgtgcctctgcactaccaatgcctgctcctgaaggaaggtttgtgagggtgaatttctcaaagtcacttcaggtccttactgtagcgacagtgttggcaccttctgtgtcctctctcaccttgcctgtgagccttccagtgggtgggaaaagaggcatgcctatcagtggccattctgtgaacacagaagagagctgcgctggccacagagaagatagtccaatgatccttaaagttcaggcgtgtgggttggagccaaaggggcctgtcccctggatataacttgagagtagctctggagaggaattctagaagctgtggaaagaaaaagagggaggattttagcactatgtctctggacagtttgtctaacttcaaagggttcttttcagtttttttctttcctttaccaattcccaatgttttaactgtactcactgcctgacatgataggggcaggtgtaccttcgaatcatttcatactagaatattagggcaagtcagctttgaaggtatctagcccaatcctctcctattgtagagaccaagagatcaacttttgttgcttcctatgaacgttctatagaactctacttcttacctaaccctatctaatttaaagaaaaaaaccaaaagcctgtattgaataatggtaagtttcataagactcctgactttcatttttacagaaagatgggtaggaaaatgaggcctgtaagacagaagtggaaacatgactcaggagcagccccaggctgctgttatccagagggcaggtggggaactgctgcctctaacttacctgaccgacaatggaacctgtggcaggtagaggtggcacgaccctctagagacccctgctctggccgtgccactttcaagagcaagttttccgagccaggactctttccagtagttctgtgagaaaagcactgtttgctagcactgacagctaccaaaaaccttacagctgcttctgaggggaagagcatgatgacagtgtgactctaatctgcctcctcccaaacagatgaaggagagcaggctgacatgtgacttagctattcaggggctaaagagctagcacatgttttctttaggcctccactttttgctgtaccttttgttgtcaggggattctgccagctgccaccttccctgaaaagccaaactggtggaaataagagggaaaatcatctatctctgataaaagaaagagaaagaaagagagagagactgctaaacaattgtacatacaacagaatcttaaaatacgctacacatttaactagtgcttcagagcttaaaaactgcctttatgtattttatcacaatcacgcctcacagcaacccggtaaggtagacagagccatcttggtcctgtcctgcagatgaggaacatgttcttgatggcaggtgagtggcaagactagagtccagatcttagaaacacagaatcctagagttagaagttaccctgacacaataatccaaggcatccttttcccagagcatgaatcaccttataaaatccctgagatttcttatggcccctgcttgaactcttccagtgatgagtaactctcaccacccatgagcaatccagtatcaatactgagctaaaatccttcttataactttcagcctattcaattcaatttctgcccacaagaactacaccaaattaagtcaaattctaatttacattctttctaaaatttgaagatattacacttgcccttttcttgcagataaaacattttcagttctttcaactacttatcatgtgattacctagaaccatgcctaaaatatatagtaaatagtgtttattgaatcgtttctcttgcccttggtactatgtcctgatcctcctgtcgaggggctccttcccttacctcgagtgtcctcaattttgtaatctgttcatcatttgcttatttaaataatagggagaaaagaaacagtatagttttcagaacaatgtgaaacaaaataaaaattgtccaaatgtcagacagctttcaatttattttgtgataatggattcattatttcactcaacagactacctcggagctgcatttctagaagataagtccctcattcattgagcatctcctgtaataagacacagaatggatccctgtggagagtggccatcgaattaaacagaaaaattctagtgaagggagggatgatttggggtctggctggaagaccctgcatgaatacattatcctgcagcatagttttgcctattaagagaagcagcacccattttttgttcaattttgggtaccaccagactaaaaaacatatgtctcttcaaaaaggagctccagaggaaactctgactattttcagttggtcttaatttggattggtgtgagagacaagcactggtgtcaatgtgatgaggctgtgtcattcctaatgatgcagaattcagccagcttcatgcctctcatataagtgctgtgccgggatgaatagcaatgagcttaacattttgataactaaagagccaggaaatagatggtgaatggtgccctactttatgaaagaaataatagtaaattgctcccaattaagggaatatgcttattcattagagtaataaccttatagcaagtttgatggtaaataagtcaaatcaaacattcaaaacacaatttcagaaaaagaactgaggctaaattatcccatgatcacagactacattgaaaactatcagaagtttggctaatttgatcatgttttcaagttgttctgaaaacctctatggcctgaaaagtaaacgacataagtttcctttctctctattgcttaaacaaagaaacatgaaaaactattctccctatattgcaaattccggtattttagaaagtgagcctcatcagcagttttctcatcttgagttttagaaaaggctgaatttggaaagaggcatttcatacgatagtatgtattaagggttgagggcttggggactgagttgtgatctcctctctcataaaatatccgcactgtaggccgggcgcagtggctcacgcccgtaatcccagcactttgggagcccgaggcgggcggatcaccacgtcaggagatggagaccatcctggctaacacggtgaaaccctgtctctactaaaaatagaaaaaattagccaggcacggtggcgggcgcctatagtcccagctactcgggaggctgaggcaggagaatggcggtgaacccgggaggcggagcttgcagtgagccgagatcgcgccactgcgctgcagcctgggtgacaaagcgagactccgtctcaaacaaaaaaaaaaaaaaaaagaaagaaaaagaaaaggaaaaggaaaaaaaaatctgcactgtaatcacatggtaggtgatagattcttcacaggcatagaatggagggaactgctagttaaacaagacccaccaccacaagggctgaggagagtcccaaggtgccagagaaattgtagtgaaatatcacagagagttcttgctgaaagacactcagatgtcctggggcttgtgtctactgtactgcggactgactactcctcttttcttcctttgaaaaacttatccttgccttctcagatcaatccaagggggttcctggggacagctggtccaacacgctcaaatgaagaaagtaaggtttagtgaggtatggtttgcaaaaagtcacatatttgattagtagcaaagccagacatagaagccaggactttggactcccagtcctggcctctttctcatttaccatgctgcctgcctcctgatgtttggaaaacattcctaaagctggggattttacaccttcacttgaatggttttctttataggcagagggaaaagtactgatctttggaagagttaggattaaaaactaataagatgggggtacagggtgtttaggaggaagaatagatacagcaaggcaaaaaaggtgggaaaaagaaaaaaggaggtaataggagagataaatatatgaacaataaaatggaagaaaacaagagacaagtgaagagggagaaatgaactgagaagacatagaaaatggacacttaagagcagcaaactggccaggcatggtggctcatgcctgtaatcctaacacttcgggagaccaaggcaggaggattatttgagcccaggagttcgagaacaacctgggcaacatggggagagtttgtctctacaaaaaaatttaaaaattaaacattatccaggcacagcgacatgtgcctgtaatccctgttacttgggaggctgggatgggaggatcgcttgagcttttggaggtagagattgcagtgagccgacatcatgccactgcactccatcctgagtgacagagtgagaccctgtctcaagaaagaaaaggaaaaaagaacagaacatcaaactgaggcaatcaaggactgagaagaaattggagaagaaagaagagaaaaatagaaccaagaaaagagaagaaaaccaggaagaacaacatgagaaaacagagagctgctgtgagtcgaagagagagtgtataggtggatgggcaagttggaccaagagggatccataggacataaggagcatgcgtggatgcaggatgaacgagtaggaaggcgaacagctgcacagagggaaaggagtgatcagagttgtcaatgcacacttcggggaactcaacaaagtgatctggggtgttagattgatccttggaattacctcagaatgagctgaactatggttctaaggatgctggtaacacaggagattgtaaattccatatctacaaaactaaatctctaacctttcatcagtcatctctatggcctctttcatcatttatataacctgtttttcaaaatagacaaacattcactcattcatttcatgtactctggaggccttcctcactgggctagtttctcaggtaatttattggtgctttctgaagaaccatgggaggcgccttccaaattgggaacaatgggattttcctcaggaaattcaggcctacatcatggttgggtggagttacagagaaaaacatcacagtattatgagggcagccagggaaacatgagagcaatttcccagaaccactgggcacagcctttcttgtagactctctgggagggaaattctgtgagggaaatcctgcacgcactgttaggccctccaggatttatgcacatcctacctcccacaggtgtgggtgactggggaaagccaggctgccatatacctatctgatcatagtaacatttaatcatagcagtatctagtcctctgtctgtgtgatcaacaaacacattctccactgggtgagaggaaagcaagatgaggacattttcctccccgagctattagctcataatcacaatcctctttaaaatatgcagttttaacagagatgcctgcccagtctaggctaaataacaactgctttccaggacgggctctgtatcaggaaagacaagcaatcagaattagaaccctgccacattctttttcttttaaaatgcatgccacaaataaaagccccttaagccccagctgtggcctcagctattagaataaacttgcaaaaaaacagcaatctaccttcctgctcaacgtatcaaccagcccactttctaaaatgcaatcaagttaataacgaatgagtttttaaaatcccttcatgccttgcatgcacccggagtgagttgctatcttcaaagttgggttaatgccactttctgtgagtcctctaagaggaaatgttccacgaatgattttttttgccctaacaagctgagttaaggccagccattgacaggaatgtgcagcggctgccttctgagtacttacataggatcctgagccggtggctgtgcccatgttagttctcccttcacctcatgtactccccatcactcctataatccataaacgattctgatcctgacacctcctcaaaatcctccagcaccagactggtggagtcctcacccagtatgccactgtctggcctggacaacctggcccgggtaggaggtgcaggaaagttggtggtagctggaggggtagaacaagggggtgtttgctggagagaggtgggtgtggcctgaggaggggacacagctggctcacagacttcctcatcacccttctcggactctggtccagcatctgcagcagtgggacccaggacatggtagaggctgggaaggcggatgtcaaagcgcagcccaaacttagcaaagagcttgtcattgagagtgtagagcttctctgagatgtcatatcccagcagagccgagaagaggcaggagatgtatcgctctttggtcagaagaagatggagacttttccggggccaggaaatgtagctacatgaggtctcagcagtcagagtgacctgagaggggtcagaagcagacaataaaagtttaaactagaaaatttgtccatgctgagcacagagatcattcagtcacttggcaaacagctgtacttttactgaagaagctgtgtgggagtacccctctatggccttgcctggaggaggtctagtggatgactttcacttgtgtgcactgatatgggggggtcctgtgtcaggagccctgggatcagccattcactcactcacccatcacctcctgaagcctcagtttccacatccactttcctcaactgtaattctgtggttccgtggctaatgccactaatgactgcagaaagttctgagtcttatgattttaagatagagaaagaaggggccttcttgtgctctgaagagtggttgaaatgctgacaactattcattttaagaatgaggaagggtaagatattggggtagggacataaaaagagttggaaagttgagtttgagaaaaagcttctgatgaggtatgccaagctacatcaggatcccaagcctgggattcaggttgggatacgagcaagttacgaaattgctcgtaacttggccatttcaagtaaccaaaaggatctgatgactgaaatcagaaaaagggcatagcggaagacaaactctaaagggtagaaaatcaaagggcaccccattctccatttgtttattcatctaggaatttctgagtactcactatgtgcccatgatgcaaagctaaattacgcttgcatgggaaataagcaataacgtgtgcctagcatgcagcaggtgtttgataaatccttgttaaaataatgataagtggtaaagctggggttaaaatggaaacatgcttaggacagtgcaggaaaagggtgcagaatcacacaatttttaataatctaattgaccctaatactttgggctggcagagttcatgatatatttttgtggatggagacagtggaaatgatgatgataatgatgttagcagctaatatttgtcaagaggtgccaggcgttgtgttaagcactttatatgaattgtcaaatttaaagtagggtagctttccaaacattctttattagagattatatataatccttttcattcctgtattgcctactggatctcccattaccctcctcttctcttctttcctttctgctatacccctcccccacgtcctttattcatttcctcctctcaacttttctccactaattgctagcactgcaatcaggacctaaactacgttatcgaggccagaagtggtttcatgtttcagctttacctctatcagttgtatgatgtcagataaattacttaatctctcttgcctcatgagaaagaattctgaaaataatacaatctgtccattactaatagttcagcaagtagttgtcacatctgccatggcctgtaccttagatgtacttatgaacaattcccaaacaagaaatcagagtaccaaatatgaagcacatgtgtttgagcaagaactacgccgaatgtaaataatgtcttaaagccaaacacaaagactgtgaaccttcttagaaatatgctgtacttcttccatcttaaaataaaacaaaattttacaaataaaaattctttttctcgaattcacttccctggctagctatcactccactaatttgcttccctttttagcaaaactcatgaagaaaaaaaaacctgtttatacttaactgtctccaattcctctcttctcactctcttaaaccaataagactttgtccctagcagtccacaaagactgttcctgttaaggtcaccaatgacctctaagctgctgagtctgatggtcagttttcatggcatccatcaatttccccttcctctttgatatatcttcttcacttggttcccaggatgccatacactccttgcccaatctcatgattgttccttttcaagctcctttgctgcttcctcctttcctctccaactcctcaccactaaagtatcccagggctccgctcttgaaccattccctcttccatccacactcactcacttggtgagctcatcctatccaatggctttaaatatcatctgcatacaaccaactcccaaatttatgtctcaggcccagatctcattcctgaatttcagacttaaatatccagttgcctatgcagcatctccattcaaatgtccacagatgatgcaaacctaacatcaaacactgaacttcctagtcccccgaaagcagctctacctgcagctttctttgtctcagttgacagcagcaccacctgtccagttgctcaggccaaaagccttagagtcttccttgatcttctctttctctcacatactatatccaaccctttagaaaatccttttggctgtatctagacaatatatgctatggccctacatgatcttgctacctcgtcacctctccaactttctctcctgctattccctccccttcctctctccattccaggtccactgtcctcctttctgtgcatcaaacacactggccccacctcagggcctttgcactggctctttcctctgtctgatatgcttttcccagatattcacagacctcacctgtcatctctctcaggtttttgctcaaatgttatctgcttaacaaggatttccatgaccaccctatttaaaattgccaccatttctcccttgcactactctaggtttttttttttaaactagcagtgattatcctctaacaaattatataatttacttattcattatgcctatggctttttgtctcccccattagaatgtaaattgcatgaggggagggaccttcatctgttctgttcactgatatatttcaaatccttttaacagtgcctggtatatactaagttttcaataaatattattgaagtgaataaatgaatcaagggaagacagccaatcttgtatattgcaaaacaacctaatgtcactttcttcccccaccccaccgcccccctgagacgaagtcttgctctgtcacccaggctggagtacagcggtgtgatctcagctcactgcaatgtccacctcccgggttcaagcaattatccttcctcagcctcccgagtagctgggattataggcacctgccaccaccctggctaatttttgtattttctaatagagatggggtttcaccatgttggccaggctggtctcaaactcctgacctcataatccaactgcctcggcctcccaaagtgctggggttataggtgtgagccaccgcgcccagcctctaatgttgctttctcatgtcctgtataaaatccttccccaaaggtcctcctgaaatctgcttcttgattggttctcccatatatatagacatatctgttgtaacgttttgacaagtatttagctttttttttaatactcatctcagatgttggttgaatgaattaaatgagataacctatgtaaataggacttaggtccagtaagataggatgcaaattagaaaaacagtgatgatttctgtgtgatccctcctgtgctgtgttcttggtgactaatgagtgtcacagtgccgaacacacaatgaattctgacttaattgaattgtcgagaggtgtgctggaatgctgattgatttatattaggtacaatgtgaattataatttaggctgtcactgtggattgctctcagtcaacaaagactatgtaattgcaaaaggcaaggacaggatgaactctaacttaagataacacttgacatttgcaaagaggaaatgggactttacacagccaatagcaaatgtgtggctctcattactcccaaaggaggtacacgctaaaaatataaatgggaggaacatgaccatacctacattccaggctgagaggccatgtgaggttacagcccttcctcttgagcgtaacttaggggaggacacccggcttacccaccacctgttcctccgtgtcagtgtcagaaagaggcctggtccagctggctcaggtcctgactgagccctcctggaggttctcatgtgcctgagagagttcctgaagaaggtttctggactagttagggagggtgtgtggacggaggtcagggtaggaacatgatggaagtggatctgtggctggtgaccctggcagtgggatcaggactgcctctcaggctccatcatcacagagccaagtgtcagggtgggggcagaagcaggccctgccaggtagcactgcccggtgtgtgtctgttccggggttggctcatatgttggcttgagggactccctgataaaagtagtaggagacacatggaatccagtgtttccaggtccagcaaactatccaggcaggggagtccttaaaagggtgagtgagtgtgtgtgcgcgtgtgtgcatgcgtgtgcatgtgtgtgtgtgtatgtgtgtgtgtaaactctactcttctggtgaccttcccattttaataaagaacagaaatggtagatccaggcaacttggctttgtcactttctagctgaagaccctgggcaaattacttgatgtttttgggccttagtttcctcagttgttaaatggagtaataatcatattcaacccatagagttgttatgagaatcaatgaggcaatatgatacgtagtgcctgccacatgctagccattcaataagtgagagctacaaagaaagtgaccaaagcctgagggattggcagagataagaagagtaggggccaggcagccaggaacctgcattggagcatgtatgtgaatgccccatggagtcctctgggacaccagctgcccagtggcaaaccagttcagcaattcttttttttttttttttgagacggagtctcactctgtcgcccaggctggagtgcagtggcgcaatctcggctcactgcaagctccgcctcccgggttcacgccattctcctgcctcagcctcccaagtagttgggactacaggtgcccgccaccatgcccggctaattttttgtatttttagtagagacgggatttcatcgtgttagccaggatggtctcgatctcctgacctcaggatccacccacctcagcctcccaaagtgctgggattacaggcgtgagccaccgcgcccggcaagcaattctttactgaacagctgctgtgctccaggtactttcctttagagtctgggaacagagagggaaaagcctagatttgtacttcagagttcactgtgcagaagacagaaaggagaccagattattagaacagacagcaagatgtgcaccagttagcataagtaaaaggactagaacaggcacacaggagtgctaggctgtggggtggaagctggtgaggctgtggggtggaagcaggcttcacagtggaagtgaggttccgtggtctcatctagaaggggaaatgcatttcagaggggagagtaggggccaaggcatagagctgcaaaacaatgtggtgtgtttagggaagtactagtggttcagcatggctagtatgagcaaaaaatatgaaggagggagagctggaaatgcgactagagagcactaaaaggtttaagttaccctataacaagtgtgggtttttatgttgtggcactagggtcttccagaagagtttaagcatacaagtaacatggtctacccaggggccagcatcttcctaccctacctcacctatggctaggagcccaggaactcttttcagaggaagagtgcccccgcctgtagcttcacactggcaggggtgcgaaggacagatgtaagaggggaaacatggaggcacggatattgctgggctacagtgggatggggtgaggcggtgctgccaccaggctccctgttacctggaacaccccctcctcagaaggctgtagtgattcccactcaggagagtccatgaactggtatggaaagatgtagtgcagaaactgcccatcctggctcacacgaaccctggcaagggaagagaagagatcatgtgggaaaaggaaaatggctctccaagccacctatgctgaagttaggtgtcgctgattaacatgaatcttcctgtagaaatactttgcctaaagcatggtaaaacccaaagctagactagccagcctaattactgcatgcaagtagttcagaaaaggaacccattgagacttccagaaccctcatttttcctcctccttctccttactggtggttctcaatttcaggctgcagagtagaagtcccagggaagcttttaaaaaaaagcacctaggcttgggccttatcccagagcaattaaacaagaatctctctaggtaggaactggatattattagtatttacatctccccagtgattctaatgtgtagccaagatagaaactactgcttaagaactctgctgctggcccggcgcagtggctcacacctgtaatcccagcactttgggaggctgaggcaggtggatcacctaaggtcaggagttcgagaccagcctggccaagagagtgaaacccccatctctactaaaaatacaaaaattagccaggtatggtggcgggtgcctgtaatcccagctacttgggaggctgaggcaagagaatcacttgaactcgggggtggaggttgcagtgagccgagatcacaccactgcactccagcctgggcaaaagagcaagattctgtctcaaaaaaagagaaaagaatgctgctgcctatttaagtttacatttacattaattaaaattaaataaaattaaaaattcagttccttacctaattacaatatgggtgttcaatagccacatatggcctgtgactaccatgttgtacaacatagatctagaacgtttctgtcatcacagaaagttctgttggatccgctgctccacagattctcctttctcccttcccattagctacatgaagattcatgcttacatttaaccactttgtagactttgaaggaagtggcaagtctaccatatgccagactctgctagacactttaccagtgttctcttatataatgttcacaacaccacaaggtagattattcttttctgtattttatagctaaggaaactggtgctcagaagggttgagtggcgagcttaaggctacatagcgatcaagtggcggaactaaaattctatgttcttagcacaacaccatgttgccaccctattactacagctttgggtagatggtagtggactctcctagcatgaccctttcccggacctctctaaccgtaggtgacaataacagcttgtttctttagacaatgagatcccatgcaccctatccagctgatggtcctagagtgaacacctgactcaagctgagccaatcaaactccttccctgggaatttggaaatggaattgcgtgtaaatcatgccttggatggggacaattatcaggcattattaacaaaactaacacactcctccctgaaggaactaaaaaaaatttttttttatcacgtaactcagactttgaaaagcatgggtcccaattggctatagagaaaataaacttgaaatcacataaaatgtcctagtaggacatgttcttgtttctagcactacctgaggcttaggtgcatgtctttccttgagtttcataagaaatccttgtatttttttaaataaagaccttttttcccccttctgttggctagagtgggttactgtggctgcagccagaaatccgaattatttgctttaattttatgaatattcttaagtcttaagtcttaagtcattaactgctcttgacttgcccatgaccacaggcttggtttcacaacttaaggggttaggagccttactattgctgcttggtgcctttgtacccttgtggctgtacctagcctagtgctctgcccctgcagggtaaaaagactgcattccatgagaacttgttagaactgatggcatgtcattgatgatgcctgaggacagggagtgtatttcagatgtgaggccacatctggaagaagattagaatccagtatgggctttatccttcccccaacccgacccctgcccagaaaactcagagtttcatctttaacctctcttctaaagtgagttatatcaggcaataggggtgcctctattaggcaaagggggaagatgaaaaagatctctaaggtacaccttgttcatttgggggagatatccttccattatttctggaggtttattggctaaacaaatatttctggagcatctctcatgtttctggagatctgggaatgcagagatgggcacaatctggtctttgtctttgaggatttcacaatttagtggaagtcacaggcacataaataactggctgcaagtcaatgtgataggtgctattgtggaacagtaacagaggagagagaaagattggttctctttgggcagcagacctctcgaaggagatgacatttgagctgaattttgagggatgcaaagggtattgagaagcagataaagatgagaatgaacaaagacctgggaaatccagtgtggcagtctgttctccagtatctgctttcttctcttccttaatggtgctagattttaactggacacatgactgcagagaaaaaaatcaacatttctctacttccctggctgctaggcataggcaagtgataagtcctggccaatgggatatcagcactcctgagccttgctcttaatgaatgcctaggtatacatgcgtgtatacaaattaccaaagaccagcaccaattaaaaaaacaattgcacctattatctgacaacctaaagctggaagacaggagctttattcaagactctgaataaatatgtatggaagggggaaaagaaggaaagaaggaagcaagaaagtaaggatgaataaatgaacaaaggaaaccaaggaacaaactcacttgtgtcaccataaaaggggatcaaaacctcactgaaaagcttccatagcaaaggaagacagcagaagagaatggcgctgctgcagcatatgtcagctccttaggcgaggatttcggccacccaggcaagccaccaaagagtgacaaccgtagagtgtagataatgtctaatgatcttcgtggctcgctgaagccatttaaatcggaatgctgtgccctttatcatctgtttcttcttccttcttgatctactggaagatggatgatcttctcctaaatgaatagcttagatagttagttgcctgctcagggggttgtatatatggaagtttgtgttttgaattttatatgagagaaacgtctaagttaagcgctgcttaacagggtgatagactttgagaaagtcactttccctctctgagttttgaaagagattggtttcctttattaaaacaaaacaaaaagacttctgaggtttgagtgaaggactctagagaacagtgtgcatgtgagatgtggaagtctgcacaagagtccccacttcctggcacaaagttcttgtctgctgctttgagatgtttggtcccttactgtaaccagcccaaggttcagtgattctcctttaaaactagagcccagtcatagactagaagccttttcctctatgtccagctcagcaaagctgagacagggtgacactgaaagataacaaaactcttactccaaaccttgaaaggcaggaaaaaaaaaaatcaaaattgtctaatttctgactcagccttttgatgctaagtataccaggaaaagctacaccaagggcaagcccccctctccccttcactgggaagtgatcttatacaagttcacagtaaatctatcctaactgaactatacagtaaccatacatgcttccagcaaatgggcaccctacactggagggagcacttctgctgctctcaatttcctcctttgaacagacgagctataacatcatgggtctcatgaatgagcaagttccctaaattgtctttaagcatggaactataggtgcaaacattttcacaatagttatatgtatttgtatttacatctatatctgtttacaaataatcgcattggtttacactttcagttcaccaataaatgaaatgaaatgtaccctcacaaaatgtctcccctcctagctcactctatccaggacctctgagttcaaacaaaatcaaaacatatatacatgatacttcaggttctataaatgaatacacaaacacgtattattactattagtggtagttgtagtaccattagcatcattgtcaaacttttttctccattgtgtggttggcagtattatctggatttgctttttttttttttttttcttggaattggagccttctaattgccatcttaccttttctatcacattctcctggtctcaagaaagctggtggagtgggggttgtggggctcaagagccactagggcagtataaaaaaatccacaattgcctactaagtgtgtagcacagagccccgtgatgttttctcagaagaaatcaatgcccaacattcacatccaggttgactgggcatacactgatcctgactaagaccatttctgcccatatctgactgtcagccttctccaaaagaggcggtgcttccacaaaagccttgatgagataggtgtatcacttctcttctcccattgttgggccctcagatttacagtactgtacttgacttcttagtcttcaagaacctcaatagaacaactggaaatggaaaggtgggcaaggggtattcactctccctacctggctacatacagctaccccaaacacaagtggggctgtttgcttgatgccttggcagggaacaggggttatgagaaccaccccgctatcccgacctcccatttctggcattgttccctgaatacagttggtgcttagcaaatgttgaatttgagtaaggaacagattaaccttattgaaatgttagtttttcaaagcttacagagatattgctgcagcttaggcatgacacactgatatgtgtgtggtgatggtagaggggttatttaaggcccaggctcaagacacacgcactgcacaccttccagcagcaagtgcacatacaatcattcttgccaaccaagatgcctcatgaactggtttcttcttggaaaatgccaagaaagaggaagcaaccccactcttagaaaaatctattttggtttgtttgacttgtcacatccttccctcaatggaaggggacacgaaatggaaagggacatgaaatggaaagggacacactaggaaatgagaagtgtgggctggggaaagaaattctgggcaatggatagagtagcttaccggccagagagcagcagggacaggcggttgatgggtgtctcaccctccacagcataggtctgttcagtggccagagttaagacctgctcctcgcagcagtgaacaatctccttgtatgtctgtaggggcacctgcaagggcaggcacagcgtcttgtagaggaggtcaaactcctcagggagggtgtcctcacgcaggcggtataccaggtgtgccagctggagcaggcagaccacagccagcaggaagctccaaagaacaatgtccaggccacaggcactgaaccagccccacagcacgcagcacaggtaacctgcactcaggaagccaaaaagatagaagcatccatacaccccactgccccccatgaagcccaggagtaagaggcagttggctaggtggtagacagccccttccacatcctgcttccacctaatgcacgctgaaccctgcaagagaagctggcccactctgctgctgttggcgctcatctttggggcctctcaaagcctcactgggctctaatactgtcctcacataggaaattcagaaaatgaatgaatccatccgctcaggggtcttctcacctccggcttctcactaccgactccacctttcctagaaggaatgcttccggtggctttgggaaggaatgatggaacatagtacacttcatggagaatttaaaaacctctttctctctctctctctctctccccctctccccccctctctcctccccaccacccccgctgtctcagcaaggctctggctctccctgcagagctctggcaagcttccttggttccatgtttcttgggagtcttcaaatttggttcttagcagaaaaacctaaatagtcccaagggaaagtagcactacaggactgaaaagtccagcagcgtgggatgatgcggccacatcctgctctctgtttttcccaagcagaatgaggagagccagcatgggaggcacatttgtgttccatttggaatgtgttctctcttggcaccggaagaaagggtgaccccagatggataccatgtttggaattggaatccaagaggtactggcagtgagaaaaaacaggccaggcacaggcagcctggcagagcacttaacatacctcccagaggacaagataagacctcagggtcagagagacagacaaggagagagaaaggaaaagtgagcacagaattcacctgaacacctcaggcaggaaactgtcccgagctccctttggggagagccagacagtgcttctgagtgaggacacatcagagtaggaaagtatgggactattatcagaaaaaatcctaacagtgaaagctggaaaaccccctgaaggcctttattaagtcacactgcaaatatcattatgtatttatttgacatccatttaacaaaagtagctatgtaaagtggctttttgaattctaagctggctttcccctgcatatatctggatctggtaatagtaaacaaataataatacattgcccagatcatcatcccacccactccggtgcttccaaattataattcccacctattaaacacccatgaagtgccaaacctagattaggcattttatacacttataagttagttgtgacaacaatccttcaaaataaatattattctccttctagatctggaagaaactgaggctcagagaggtaacaagctcccacagatggtctaagtggcagagccaggatttgaacccaagtctgtcaaacttaatactctgtcccaaggggtttgccagtaagtggaagtacagtactagatccatgactcccaactccacacttctatgaagtctgacaattttcaaggaacttctggttgaacctaggaatctactttgggctgccaagagataaagctggagtatgcaaacattaggctaagaaatgttagttgggcacagtggcttacgcctataatcgcagcactttgggaggctgaggcgggtggatcacctgagtgaggctggagttcgagaccagcctggccaacatggtggaaaccctgtctctactaaaagtataaaaattagctgggcgtggtggcgggcacctgtagtctcagctactggggaggctgaggcacaagaatctcttgaacctgggagtcagaggctgtggtgagccaaaattgtgccactgcattctagcctgggtgacagagcaagattctgtcaaaaaaaaaaaaaaaaggaaggagaagaaagaaggaaagaaggaaggaaggaaggaaggaaggaaggaaagaaagaaagaaagaaagaaagaaagaaagaaagaaagaaagaaagaaagaaagaaagaaagaaagaaagaaaaagaaatgtgactctctggattccaaatgactccttgattcttcctccctgctgctgggttagcacttactcccattactcctatcgcccctgaagtacaggcggggtgctcagtaacctcccagaactaatcaaggactcaattcataaggacttttactatactgctataacttgatgaaaatttatgagaaattcaaaattgtcaaatatggtgagaaggagatgttttcactcaacaaatatttattgagtgccttttatgagctaagcccttgggcatcaaagatcctcaagagaaactttcaccctgttagggtaaagagacctcaaaaaacaaaggcagttcagtatgtgaagcacaacaaccaagttaactttgaaggatggtggcagcctagaaggaagggtggcatcagggagggaagatgcaaagaagggctggcctctaatttgaggtttaggggttgaattcaccaggcaggtagagggagaatagcatttctagtggggagaacagcatttctagtggtgagaacagcagaagcacgggcacagaggcatgaaaatgcatggcatgttgaaggaagccagttttttcttaacctcattaaaatcatctgaccaacaaatatataccttatttcctcctttctaagttaagaggaaaaaaatcagtaaagagctagagtatttggagaagaaatgtcactgaggtcactccatggacatgatttggacccctgacatcattttaacagtggggtttggggatttccatatactgtttttacatcacttgcctgcctcccaaacaacccccctactttaacaagcagcagctgctcatccttctatcacagacatgcagcccctgagcttccagagtagctgtccctgccagctgtaagcagggaagtcagaagcatagaaatgaagaagcaaccaaagctctgcccaagatacaatttcaaagcagctcatctttcttaggagacctgccaaataggttggccctgacccattaaagagacaggcagacccattaactctatggttcacttgtcctgctgtccagactgcactcagcctgctttcctgtcaatccacatatgtgctatctcagcagaggggactaacatttatcaagcagctattgttttatgttatcttactatacctattttttgttttaatagaagcagcaggctcagagaggctaaggaacttgcccaaggtcacaaagctagtcagtatgtgaataaggattaaagcctaggtcagtgtgtctctgaattgtatattctctacagtatattaataacatcctaccaggtacttttgggagtttacatgtgtgcatatacaagctcatctattgctgctggaaatttgagtacattgccagggtggcatacgtgtcagagaatcatgggtgcatgtaatagtgacattacactgcagtaatagtggcctgcagtaatagtgacattgatgcccacaggataggacctgtgatcagaacacaacaatgaaaagttgtgtcttgtgtaagtccagatttgatagaaaaggaaagaaaaaatgtattgtctgtcaaaatggtatgttcttataaggaaatacacaaacatgaaggcagaacacaataaaaaacaactgggaaagaaaaaaggaaagaaacataagttttctcatttgttgagctgattcaattcaataggcatttattcaggacagactatgtgttccaagaacaggggatataaagatgaataagacaattatcacttcaagaaactttcagtctatcccggatactgactcagaaactgtaatccaataaaataagtgtacttaggattcaaagaaaaaacacttatgagggagcaaataattcaatccatagggacttttactatactgctataacctaactaaaattcatgaggttgggggcgtgatggcttatgtctataatcctagtattctgggaggctgagatgggaggatcacttgtgcccaggagtttgagaccagcctaggcaacatagtgagaccactgtctcttaaaaaaatatttttttccacgagaaaacatcacagggaaggtgacttttaatctggtctaaaaagatgagtaggttttccccagctagaggagggcattccaggaagaaagaacagattgtaaagtcagtcccagaagtaaaacaaaatacgtggcatattctggtaacagagaacagcttgttgtaggtgaatcaaaaggagcagcagacaagaggcaggcgaggcaggcgggggccatcttatgaagtcaccagagtcaacaagtgtggtcatgaactcagcctggtcttcaaactgtttgttacttgtccatgctggttcatgctggggtaaggacagaaattgtgactttagacattttttatagcaatttcacagagaaactatggcctttgaactaacaaaaattctgggtttgtatagcatatttttaaatctatatgggtttatttcattttcctagtgttgggtctgtgatgaattgaggggaaaaaagctggttcttcaccacatacagtttgagaaacactgagcttggggttaacactttcctagtatagatactaaaatagaacagaggcataattttatgctctggacacatagtgtcaagttgaacttaagcagacactattggttgtcttccatagccatttcccctttttcttcagtttatgcaaatctaattttgcttgggtaatatgttaaggaaggtgggcttttccccaagttgccagagcctgaactaagattggttgaagccaagcacaatatctcattccccttgatagcgactggcacaaaagtagacctgtgagcaatgagatgtaagaggaagtacgtgggggagcttctgggaaaaagtatactccctggtagatagcaggcctacctttcatccaggcttgaatagttgcgtgacgatgtaatgcttgaagttaccatagtcatgagataggatatgcctaaggatgagaagggtaaagagcagaaaaatagaacaagcctaggtttttttgtttgcttgcttttttaagacagggccttgctctgtcagccaggctggaatgcagcggcacaatcacggctcactgcagcctcagtcctctgggttcaagcgatcttctcaccccagcctcccaagtaactgaactacaggcatgtaccaccatgccgagctaatgtttttattttctgtagagacaggttctcactatgttgcccaggccagtcttgaactccaggattcaagcaatcctctggcctcagtctcccaaagtgctgggattacaggcatgagccaccacacccagccaagactaagttcttgaaagcaccactgagccactatctcaaaccaggagcttttaatttccaaacttcctaacagggaggtaaattacttttctgtattgcttgtgtcagtgtagttgggtattctactgcttccagttgaaagcatcctaattcagatctcactaaggacaactcttcagggaacagttctctgaacatctgctaattgtcacattctataaaaactgaacatcagaattattttgctctaccaataattttctttctaaagtttgagcaaactatgagaggaattcctccataaactcaatttgactgttcagggtgacctgttaggtgaacaagatggtgtagtggaaatctggttgtctattcaatatccatttacctcttcctcaattgtgacggaatttgttttgtccagatatcaaacctgcacatggatctaagcaggggtgggatgaagggggcggatcttgtgtaagccaatcagcataaggtattctgttgataactattactggtccataaaaatacatataacctaatttggctcaatcagacctttaaaaaggggactaagagtccatgcccagggaatggtttctctctcttccgctggactttaacaagcaagcacatgacgggcttcatcagtcctggacgagaaagctgagatgaaaataacttgagtcttggatgaaatcagtgaccctatgatatcatcacatctagagctgactctaactggacttccagctatgtgagttttccttatgaggattttctattacttgctatcaaaagcaccataattgacatagatggaatatctagcagtttttaatacctaaagaaataaacgctgggcataatcacacatgcactgtttaggaaagcatcttggaatatccaccataccactgagcattcaactttatatttctacggtttatatacatatatccactagactataagctctttgagggtagagtctatgtcttactactctttactactctgtatagttggcatatagtatgtcctcagtaagtgatgaatcaaatagcctctcatcttgaaaaacgtgtctgattcacacatgaattatcaacactagggctgttccctgcaaataatagaccttcactaagtatgcattaagtgaatttataactacaaatacatgatgtttatactggataactagtacaccaaagaacaccgggcttcaacttacctcgcaggttaccagctattggatcagggtgatttccttatcctctccaagcacctatactcacctgtaaaataaggaccatggtttttccatcacatcataggtcatattagacctatgaaagacatagtattcccaagataggccttacttaaggatatgatcctgttttcatcaaccttcaagtcaaacatttcaaggttagacaaacgggggactagagagaatagtgtgaatatatccgtattgagttgtcattattgtgaagagcaagggcttagcaaagaggtgcattagaatgtggttgttacccactaggaggccaagttcttcacttttcaagtgactgtggtgatatctcttttcattattaccgaaatgctgtacctcatctttgggaagacttaagcactaggaaagggtgggcagagggtcttgtgagatgtacttttaagtgttgcagaggccaaaaagggtgctttcagttcccttacaaatcaggcaagcataccaaactggcaaaagtttaaaaaaattgtgttgctcagagattaatcagtgctctcagacactaaggtgtaaatggatatattttttctagagatcacttgggggcagtcctcactcaaagccttgaaaacacgcatggcctctggcccatccttagctgaagtgattagtaaaggacacttgtaaagactttccataaggagacttctattgcagtgttatcagagtagccaaaaaaaaaaaaagaaagtaaaaggtgtacacacacacacacacacacacacacacacacacacacacagagagagagagacagaggtgagaatgtcatcgaagagaggtcctattgtagactgatgggatttcagatttcttccttattatgtttccattaaaccaaccaacaaaataaaacaaacaaaaattcggaatttaggttatctgacatatatcctgttccagactgagacccaattcctagaacggcatctgacatacagaaggcactctatatgaagtatttgtttaatgaatgaatgtccaaatgcgcaaaaagaaaaaatagggtattggttaaattatggttaagtcacagatgaatttatacatagtcaatacaaatgacaccacagacctatactcactgatggtaaaataccttaggggcaaaacatgataatgttataacctcattaaaaatatgtagcatagaaaaaaaattttattttgttttaaaaaatgtataaaggcataggaaaagtctagactagtatatatcagaaattaacaatgggtgataaggttatcgatttttttgttttcttttttgcagttccaggacatattcaagcagagtttggataaccacctgccaaagatctgtattgggtgggaagttggttcatacctgtcttaattgtccaagattctattcttcacctagattatctctgtaaatcatgaagtgcttactaaaagtattatatccaaatgaatattcaagtaaaaatataaacaataaaataatagagaatgctaataacagtgctaaatactgtgtatacatcatttttaattagtactgacaatctcgtaagttaggtattacttctatacctttttttttttttcagctgagaaaaacagacccaaagaagctatgccttgcttgaggtcacatagccagctattgaacctaagtctgtcatacatcaaagccatgctcttaatgaattaggaaagaatcttaaggaatcatctgattcagctccttattttataaaggagggacttttcccatcacacaatgatacatgaacattatacatcctcttaattatgttctcagtatcttttgttcttgagattttagactcaatgtacttacaagcagaatatgatcatacttcattagcccatcagcagctacgaggatgacaaggttgctatactaaggaaatcacactctgttcaactccaggcatcaccatggcatagcactgagctgtttgattagtgacatttaataccaattcagtctctagcctaattaatttctaattaattctaatttctaattagtttctaattaataagagacaactgtctaccctgtaggcacgaaacttaagatcctagtctattttaaaatgtaactacccatgtacagattcataatgccaaacagttgagatcttctaagccaaattaccctaatctggtccaaaatctaaactaacttttccaaaagacagctagtaaagaataacaataatggtttaaataataagactaaaggcttgttcttacctttaagaaagttaaaaaaaaaaaaaaaaagagtgttgaatgagatgatatggctaccacactgattctgaattggtaaagggttattttacttctatgcacctaattctggagatttcattggttgaggtcagtatctgctttctcctgacaacagatatccagagttcccagaatgacatagtaataagaacataagaaccttatgttacaagatttgttggtatatatcctttgggggaaaaagccacgtgagcaaatgaggaacacaaaaaagaaacacaactgaagatcttccactagtaatattttactttcttcttacaataaattataaatactttttccacatatcaaagttcgtcaaagaactcccaaaattaatcttcttcattcttcaggaattatttattcacacagcagaccacctacagaaaaatatttattttagaaagtcagatttcaaacatcatgccagatctatggagtcagggaattaagaccactagaaatgaatgcctcagatgagtaattaactaattgccagaattattccaaatcagtcataaaattcaaaatcaacattttaaaattctaggtttgcctaactaaaaacattagtgaaattattcatgatattatttactctttaaaagtttttgaagtaaaaactctctctgcgtgtatatatatataatacatatgtgtgtgtttgagaaatacatatttctcaaaaatatcctccaaaaaaggctaaagcagttatttttacagatattcaagaaacaagacctgcaaacccctctttgctgattcaagtatgcctggcgaagatccacaaagtagaaggcagaaggtcagctcagtacccaaggcacttcctgtggaaagttactcacttaatcccaaaggcaagacaagggcaaccctttaatattcatttggaaaaatcaaaaagggagagtagcatagatagggttgctgatccagtcaagtcaataccaggcttctcacacctctcccagtgcctatcccagaagattgagaacaatgctaggaaggtaattaaattggggtagctaactcttcaagtctaatgcaaatatttccttcatttagctgttcacttcatttggtttaaataaagataaaccacatcaagatacaaacatctaaactcttttctaaaagactcaaaggaagaatacatttatagaaaagtttggaaagataaccaaaaacgaagccattcaacctttcaattatagcagcccatagcattgttacgacttttgcgactgactacataacaaaaggggc

SEQ ID NO: 541 - DNA, 124994 bp, Homo sapiens
ccactgggcttctgggttggtggagacttggagaacttttctgtctagctaaaggattgtaaacacaccaatcagtgctctgtgtctagctaaaggtttgtaaacgcaccaatcagcactctgtaaaaatgcaccaatcagtgctctgtgtctagctaaagatttgtaaacgcagcaatcagcactctgtaaaaatggactaatcagcactctgtaaaatggaccaatcagcaggacgtgggtggggccaaataagggaataaaagctggccacccgagccagcagcagcaacctgtgggtccccttccaggctgtggaagctttctttttttgctcttcataataaatcttgctgctactcactctttggatccacaccaccattatgagctgtaacactcactgcgaaggtctgcgactttacttctgaagtcagcgaaaccatgaacccaccggttggaacaaacaactctgcacacgccacctttaagagctgtaacactcacttgcaaaggtctgtggcttcactcctgaagtcagcaagaccatgaactcaccggaaggaagaaactccagacacatctgaacatctgaagtaacaaactctggacacaccatctttaagaactgtaacactcactgtgagggtccacagcttcattcttgaagtcagcaagaccaagaacccaccagaaggaataaattctggacacagaagttaatatcaataattacacaaaaacccatataagaagtcactctggaacaagatttttagcctttgagccctgagtctatttttattgttaagtatttcatgtttatttttttctcatcctctacaaaaaagcagcagtaaacatgtgatgaccagccctttgtcagttaaactttttcccctggggcattagaggaattttgtatgagaactctcaaaatgccttacatactgctacgactaagatgttacccagagaatcttactttcttggtatcatttattcactttggggaaaaaaaaagcaacccataactggtaacactaatcattgtttcagaaaacacaaaacattctaggctgcattaaaaggtatatagaatgcataaataaagaggtactggtttttgttttgacatgaggcaaatctttactatattcatttggaggctccatagcaaacaacataataaaataatttagaaaggactttaagtaaaaatctcaatgattagtagaattttaggaggcaagaattatgcaaaaagttaatttattataaaatttatttctattttgaaaagaaatgtattactttttataccgtaagatttatgagaagctctctgaatacaatgatcaggtacatatatgttaaaagtaagctaaattttaaaaacctggtatttaagttagatatgttaagtctccttttttggagatccttaaaacaaatatattcttttatttcaaagatattacatgggcttttggaacagagcagagagacacccctcaaagtgctttcaaatgcagtattagaatgctgacaagatgcagaaggcctgtgatttccaggaatccacttaacttctctctaaactttacttaatgcagtaagtaaagtggaaagaatatttgttttcctcacaggatgttgtatctattaaattcaataaacatgaactgttaatgtgcaaaacaataatgccaacattgtcataaaacaatctgtgttctcagtgagtttataatctagtaaaagagataatatgaacaattctaatacaagtcagaatgacctaaagactataatggaggaataaatatatagtgctattcacctctcacagaaaagaaaataattgatttcaatgtgaagggctggggacagaaaaggctgcatttgagctggactttgaggataagtaacagttcaagaagcaacacgataagagtgaaagggacattaatccttgaatcaaaagccagagctcttttctacttctgcctctaccactcactagaaactagcaggaatcccttgcacagaagaggctgtgagcatgtggtcttgtctgagttgctgttgttcacacaagaagggacagctcagtctacttgctgatttcacagtaggctcagctgtttctgtccacctgtggacagaatgctcctgatgcatgagattctggcctgaatcctagtattcatgttctactctccaactggggagaattcctgcattaggatggtaatccctggtcttgccaactactaagttctcctagaaggctacagatgcaaatcagccatccaattttagctgctttaattaggtaagactcattgtttggcattctgcatgattcctttcaaaactgtactggtactactatttagccattttcaatttacagtgttattaaaagcttaaacatttttatcttattttcatttttaacctttaaagagaacaggaagcaataacataatagggacagtcctacagctagtcctgcctcaagcagagaaaattagtatattcccaccctggcttccttagttagcttggcataatattttcaaggctgaaatttagatttctgacttaaaagtgggctaatctctttaaacttggatccagtattgaggatccaaacttagcacctagaactaaggaataccattataattgataaaaacattaagatccagtggataaactggcaaagaaaagacaaaggacattcatagaaaacatcatgactagtaaatatgtagggaaaaaaattaaacctattaagaagaccataacaataataaaatattctatcctgggaagaataggaaagaagaaactagaaatctcatatattgccggtggcaatataccttggaataagccttacaaaaacctatttggctataaaatgttctctatttccaccttaggaaatttatagaaatctcataatcttctggtttccatccctgctcctgcccccagcacaatcggttttcaaaaccacagtgggaatgatctgcttctttgttcaagaccctccagtggcttctcatttaaccagggtaaaagggcaagtccttagatgacccataggccccatgtgtttccctgctccctcttgggcctcatctctgcttctcttccctgctccctacactccagccacacaagcctccttgctgttcttggaacaaaccagctgcactcctgccttaggacttttgctcttggcattgctacttcaatgctccagacccacatgggctcagtcctgcttcccttcaccactttgctcagttgttatcttcccagtgaggcctgccttgacctactcaattcaaaatttcaatttgctgctcttacccttgaactcaacctggattcccaatttctccttactctgtttttccttttacatattagacaaattatttattatgtttatgatatgtcttccccacacaaaatgcaagttttacaacagcagggattttgtctgttttgtactcatgcacgctaaaaacgtaaaataatagcacctggcacatacacataggcagtcaataagtaatggttgaatgaattatagaaaaacgtaaatgagaaatcatgtctaaaacagcagacttgctaattaaaatcactgtagtggcatggcttctggatggatccctcttatctttctgcctgattcaatcttttgcggccaggtactcaaaagaggagaaagagccccaactatctatatattgggtattcttgaatggagaagcaacgttgacatttttgctctcggggtgaacaaggatccttttagagtcttgtttactagtcatagtatagaggggcataatttgagaaggggagtctgctcttaacaggtcatcagaacagggtaagtgtcaggtcaaccacagaaaccttgatctgtggctaggactcgcacattttacaaagctcttctattttctgtggccaccactgtcccctcccacccattaaagcagagctacttcttcactattctaactcctccaaagctgccacatcagaagcagaggcttatccctcattgcgttctaggaagacataagtctacatgtggggctgatactttaacacagtttgctaacttagataacaagttattctcatcaagtaaatttttaagttttaacccaaaccacatttaatgtttaatactaaacttagagtaacttttactcctttttttttctaacaggaggtaataataatattctatgtatgaatccactacacaggcagacacctcattttttttctcctcttcttggtggggagataaactcaaacagaacattaacactgaaaaattcccaatatgatctatcctgtgaatatctaagtctaatctaagactcatgggggaaatgaaaaatgattgtggctctaccccagaaattctgatgaatagatctttagggaacaccaggaatttgtactttaagaagcattcttggtgattttgatgctggtgtttcatacagcccactggtaaaacagaatatggaaagaaggatgaaaataatagaagccaacaggaatttaaagatttgattcaccatgtaagacattataagacagtataatgagtaaagataaactagtagtggcaagacataccttgacctatggcaagacaatgatgccccttctgaaactaaatcatcatattattaataagcatataagctgctaaaaaggcatgtagtcattggtggaggaacagactttaagtgctcctctgtagactgaagaaatgctactaaatatatcgtatatgaaatgtttgtcttatgtgaaaaataaatgaaagctcataaaaatttcagattttgtacttatagcaagtttgagagtgattcttggatagtccaccccctttactttttcacatccatgggaactggctgtgggtattacctaaaattgcatctatggatcaattttagtttcctaatttgttttaggcagttttaacaataattcactctgaattttcccagtagttttcctttgtaagtatttagtataatgtctattcaatttgtttcatgggattggactggcaaaaattaaattagctagtatggaagacattctgaaacaatcatgaaagagccacattgtcatcataataatagtgatgactatgtagcaacatagaaagatgcctataattttaaaaatttcaaaattatatactaagattataattacataacatcacacactatgaagataatcattaactggactaatgtagacagatggtatattagtttgtttttgtgttgctataaagaaatacctgaggctgggtaatttataaagaggtttattttggctcacagttctgcaggctgtataagcacagtaccaacatctgctcggcttctggtgagggcctcaggaagcttacatcatggtagaaggcaaaaggggagcaggtgtgtcacatggcaagagagcaggcaagagagggtgggtgcaagagagcaagaatgggagttgccaggctctctcatgtgagctctcgtgtgagctatcagagtaagtgatatggcctggctttgtgtccccacccaaatctcataatgatttgtaatccaagttgtaatccccatgtgttgagggaggggcttgtgggaggtaatttgatcatggaggtggtttctccatgctgttctcctggtaatgagtgagttctcatgagatctgatgattttataaggggtttttctccctttcgctctgcacttttctctcctgccgccatgtaaagaaggatgtgtttgcttccccttctgtcacaattgtaagtttcctgaggcctccctagccatgtggaatggtgaatcaactaaatctctttcatttataagttacccaggctcaggcagttcttttttttttttttttttttttttttgagacggagttttgctgttccccaggctggagtgcagtggtgctatctcggctcactgcaagctccgccccccggggttcacgccattctcctgcctcagcctcccaagtagctgagactacaggtgcctgccaccttgcccggctaattttttgtattttagtagagacgaggtttcaccatgttagccaggatggtctcaatctcctgacctcgtgatccacccgcctcggcctcccaaagtgctgggattacagatgtgagccaccacgcccggtcggcagttctttatagcagcatgagaatggactaatatagtacattgagtggagtgctgctataaagagacccaaaaatgtagaagcaactttggaactgggtaacaagcagaggttgaaagtttggagggctcagaagaagacaggaaggtgtgggaaagtttggaacttcctagagacttgttgaatggttttgaccaaaatgctaatagtgatatggacaatgaagtccaggctgagttggtttcagatggagatgagtaacttcttgggaactggagcaaaggtgactcttgctatgccttagcaaagagactggtggcattgtgcacctgccctagagatctgtagaactctgaacttgagagagattatttagggtatctggcagaagaaatttctaagtggtaaagcattcaagaggaagcagaacacgaaagtttggaaaatttgtagcctaatgatgcacaaagaaaaacccattttctggggagaaattcaatcctgctgcagaatttgcttaaataacaaggagatgaatgttaatcacgaagacaatggggaaaatctctccagggcatgtcagagaccttcagagcagcccctccaatcacaggcctggaggactaggaagaaaaaaggttttgtggtttaggcccagtcccccttgcactgtgcagccttgggacatggtaccctgcatcccggctgctctagccatggctaaaaggggccaaggtccagttaggccatggcttcagagggtgcaagccccaagccctaatggcttccatgtggtgttgagcctgggggtgtacaaaagtcaagaagtgagatttgggaagctctgcctagatttcagaggatgtatggaaatccctggatgtccaggtagaagtttgctgcaggcgcagagccctcaaggagaacctctgttagggcagtacagaagggaaatgtgggtctggagctcccacacagaggcttcactagggcactgcctagtggagctgtgagaagagggccaccatcctccagaccccagaatggtagatccacctacagtttgcaaccgtgtgcctggaaaagccacagacactcaatgccagcccatgatgaaagcagccatgaggggggctgtaccctgcaaagccacagggggtggaactgcccaaggccatgggagcccacctcttccatcagcatggcctcgatgtgagacatcgggtctaaggagatcattttggaactttaaggctcaatgactgccctattggattttggacttgtatggggtctgtagtacctttattttggacaatttctcccacttgaaatggctgtatttacccactacctgtacccccattgtatctaggaagtaactaacttgcttttgattttacaggctcataggcggaagggacttgccttgtctcagataagactctggacttggactttggggttaatgctggaatgagttaagactttgggggactgttggaaaggcataattgtgtttgaaatgtgagaaggaagagatttgggagtagcaagggacagaatgatatggcatggctctgagtccccacctaaatctcatcttgaattgtaatctgaattgtaatccaaaagtgttggagaagggacctcatgggaggtgattagatcatggcagcagttcccttatactgttcttgtgacggtgagtgagttctcgtgagagctgatgatttttataaggggctttcccctctttgctctgcacttgtctctcttgccaccacgtgaaggacatgtttgtttccctttcctctgtaactttaagtttcctgaggtctccccagccatgtggaagtcaattaaacctcttttctttataaattacccagtctcaggcggttctttatagcagcatgaaaatggactaatacagagagaacttactcattaccaaagagattacatttcaccatgagatttggagcggacaaaacatctaaaccatatcaaatggatttacctccctagcaaggctcactaggtagcatctgagtactactgactgctagaaggagagggggaaaaatactaggtgtgccttgccccacaagaggaccaccagacatagcttacctcttccaacttctgagagactaacatgtcacatgccataaatccactatctatctcttgataattccagctaacttgttacaactattgcaataatagtactctattttctacctttctacaagttttattttcacaatttaaacaatatatctataaaagtaaaaagaattcactcttctcttacactctttgttgtccctcaaagaggttcatacatgaccaaagacacttcaacagaatatttactcctggaataatcatttaaactctctgtgcctgttttcttgtctataaaatagaggagagctctgagctttgcctacattacaaggcggttgtatgcgagaaactgaatgcatagaaggatggaaaaaccataggatttacagcacagagtaatgggctctatgtaatcctggctctgaaactgaactcgctgtgtgaccttgggcaagttatagaacttctcaagtacaggcatatagggtattatgtacacatagtatccaaaacagtgcttgatatacaataggtgctcaataaataataacctgttatcaaaacagtcttttgtaaaccacaaagcactataaatgcaatttgttaatgatgatatatagaaaaagggagaaaaagtagtgaacaaaactggtaagacagaagtgcagtatttggagtgtgagtataagatatgtttgaggagtgagtagcattgcatggctgtaggatgggtttcctgacaaaaggaaagagtctgatttttattgtcaagaatatagaaaactatgcatagagagcattttgagaaaaatataacaagataggatctatgctgtaagaaaatcactgtttagaaatgtggaagatggtatgaagggagaaaaactggaggcaagacaaccacttggttaggaggtaagagtgcatgatactgagcatggggatgaggcagaggggctggatctcagagtcatggagaagagataggagcctgttaacaagagtctagtgaagtaagggaaaactcaagagagtagggatgtcaacaaatgaggacaacaaataaccatttagatcatcttcatgaataaagagaagttccataagatttcaaggcttcaagtggaagatttagagaaagtcaattccattgttcaagaataaggagaaaggagcatatgtgtaagtgaagatgaattcaggtttggacaagagaagtcaaaggcatttaaactgatgaccaataggtagacaccagaaagagacctgggctgcttatggagatttgggagtcatcgttatagaggtcaccatcatagagggagtagtcactacagagtgtcatcctgtagagatgatgagggtcatccccagagtcatcaccataaggggaatgaatgagaatcaaaaagagattaggatttccaaaacaataaattacaggaaggagccttaataaatgtaacacatttacacaggcactaataagagagtagaggttggccaaatatttaaagcctctaccagcaatggacttgaaaaggaataatatagtatgaaaatgaaagtaacagttgtctacacaaagtttattaatttattgaatctgtgatttttacatccaatctacagaaataaaaactggtaaaatcaatgggttccttcaggtatagaaactagaaatggtcaactcaatgcctctaaatttgtgctatgaaatgaaacaaaatcttttttttttttttgagacggagtctctctctgtcgcctaggctggagtgcagtggcacaatctctgctcactgcaacctctgcctcctgggctcaagcagttcttctgcctcagcctcctgagtagctgggtctacaggcatgcaccaccacgcctggctaatttttgtatttttaatagagatggggtttcaacatactggccaggctggtcttgaactcctgaccttgtgatctgcccacctcggcctcccaaagtgctgaaattacaggcatgagccaccgtgcctggccaaaatcttctttttatatcaataaatgtccaaaggagagtaatttaaaattcttactgtttatttatatattgcatagctcaaaaagtttgaaaaaatgaagttttaacaggaagtcagtaaatgctcatagacccccttgtctctagcacttggagtccttagagatgggaatcttgacagcagaatttcagatgtttcaatcacttgccaaggaagtgccacacttgctctgcatttaaaatggggaaagagggtattagggaagggataagaggagggagaagggagtgattaatcaaatttaatttcgacttttaggaagtatttaggcagatacaaacagtcataagctatctaaagttgcatttctctatttaaagctatttcccttcaaactttcgtcccaagttctctcatttggcccaagccttatataaagctacattaaaaattctagagccttcctactttatttcttgtatctttctgggtcattttagtctctagcagacaacatagaagtgctataatatgaaaggtttagataaagcttgtattgtaaaatttgactacacaaaaaatgccccaaatgggatagtatcgcaaagaaacaatttgttagcttaccatataaggaatacagtttgctttcccatgaaatcatgtctatggatttactcctttctaaacatgtcatacttgactcacagtaaatagttctcatatttcttccaaatctgcaagttgaatgttcttctaatattttatattaaaacaaaaagccaaaatcttgcaatattttgaaagacaaatgatgtgtgcacatgcttaaattctgaaaattcactacagagcatttttacttgtttattaaaacagcttcaaataatggtaataaaaatattatatttatttttaattctataactatagattttaagatcttcagctaaaataagtgattcattaaaaaaagataaatatctaaatgtaagagtttttttttaattaaatcttttaaaattaaatgtatcagaactggctggaatatctcagtacttcagcgaaaaaaaaagtcaccgtacaatcaaatcattttctaacctagaaaagtagttaaatgcattctccttattttctgagttagaaaatatttcatctgaaattttagcgactattttaaaaatatttcacttagcttatacagcttttcaatttatctattttatttttagttttagtttttggcttccactactgtaaacaaataaatttatacatgttactcttaatgaatcaaaatatactataccttcttcattactttctttatttggtgaagatgatacctggaaataaaaacagagaaagaatctctgttacaataaatatttatatgtggaaagcgcatccagaagttttttcacgaaattatagaagaaagtttacacacaatggatctctaacctgaaaaaggtaaatattcccctttgcttttcattatcattgttcattctttcagataaacaaacaacagacttagagtaaaataaaaatacttgaaaatattttttatcttaacccatggaatccactgaaggtcttgcagctaggaatgagaagagaggttttctttcaatggcttccgcagctaatgtcttgaaagttaaaatcaagcacacacacacacatatttaaatatatgtttgttcatgcttgctataaaacacacacttgctaaaaaatttatctgtcttctagaactttaaattattgtttctatttattctgatggctgggccaagattctgagaacagacaagtttgaagaaacatttttatgcaatagtttttttccccataattaagaataatactttttagcactccattggaagatctattttccataaggaagaagccataaagatttagtttaaagaatcattagaatttacatctatgtgaccaccatccaagtagagaaatgaaacatgccaggcccctccccaactatgaccccttccttcctagcaataaccctaccctaccctgattttataacacacttttcagatttcaaatttaataattaacttctaattctctgaatttgctgaccttcaatagataggaaatacctgcctctagcatttaagtctgaggcagaggtccaaatgtacaaatatatatctaaatatttaaaagttacaataactcaggctaacaactgatgaatatatatatgaaatgtgttccatctcactatcttgatacaaatacctttgtaatgacctggaaactctcatttaggattccagacaccttagagacatgtgtctggatgcagcagaggaaggaaaagaggccctcatcctgctccacttctctccctattccaggctcctttctgtatttcaagggcctcatctgcacatgggtaataatttagtagcccacatatctaggcaccttttacctccaaacagccacccaccggcccctgcagaagtaacggtgggtacaaagtccatagagtcaggagcgtggacctggggagatgtgtagcctggtttctacacaggccccagaaacaggcttaaacctgtctgggcagaggattccagggtcctgggtagccaggatgtggtctagaatgggggcatgcctcctagtgagtctaactttggccccttgtggggatgtggtctagaatgggggcatgcctcctggtgaatctataactttggccccttggtcttcttgccctacggtgagatatgtgactgaataacggccaagtatgaccctccaaaaagcaggatctgaggaaggctctccgtgcttaaatctaagggcagtactgaatagccaccactccaccagaagaaagatttatatttcagcaatattaaaatattccctatgatagctaattttatgtgtcaacttggagggtgtttttagatgagattaacatttaaaccagtgaactctgaataatgcagattaccctccataatgttggtaggccccatctgatcagttgaaggctttaatagaacaaaaagactagtctgtcccaagcaaaagggaattctccaggagacagccatcagatttcatctgctcaactggctctcctgggtctccaggctgctggccttcacactggaactgcatcatctgctttcctgagtctccagcccaccagcccaactgcaaattttggacttgccaagccactataatcatgtaagccaattccttataataaatctctttctgtatatgcacatccaattggttctgactctctggagaatcctaataaattcccccaaatcataaatagtttaaagttattactctttctactctgttttaagaaaaaagctgaacaaacagactttgttttattttctttatatcaaagaaaaggatagtgtaaccatgtaaataaaattacaatttttatctttttgtttgtttgttttagagatggagtctcgctaagttgcccaggctggtcttgaacttctgggctcaaactttcctcccaccttggtctcccaaagtgctaggataacaggcatgagcaccgtgcctggcctaaaattacaatttttaaaaacatcctttagtttttccaagtacttcaaaaagaataaaatctctactcagtttgtgcacaaagaaaaattcttaaccatcgttggttttgaggatggtagaatttaaatctgggtatgacagtaacacaacataaaaattgtactccttgagattaggcatttgggatttgacggctctgtttttctaaacagaccataaaacgggttaacctgcttattctatgaaattgctatatactccttaaattgtgcaggatgcctatttgtgtcctgcacaatttaaggacagtataacaatacaaaattttttttctcaaattagctgtttagatttcctgcttaaaattagcagctgcttcttgttggagtgccaaacatttcagaggaataaaatgtacagtgtataaaaatagaataattgagcagcttctcgttaacctaaaaagtattacagtaaagaaatgggcaagctactctaaaacatttatcattacattttattttaaaataatttccagaatggttttatttcttcattcttaaaatacatttctcaattgatagaatatattcagaatatacaaagccatatgatatatatttaaatacacacacacacacacacacacacacacaccccatcataggtaagtctgacactcagagataatgataaagtttgaaggtaatttaaaaaaataccatattaaaagagaaactgtcatttaaatttgaaaacatcagtaataatggattcatgataaacatcagctatttgactctttatctacagtcaatgatttcctggtgcttaaacataacaacaaatataacatttacttacagaaaatggaacaaagagatgtatggagcagtacccaaaagattactaatcccaactcttcactctcaggggatactatgattacattttcattgtaagaaactaaaaaaataacttttagttacttacttctaaatttcttttaatgtaattacttacctcatctaatttcttagtaggaaaagaatgtggacatcctctactcacccaaaataaattctccaccaacaatgagtattgttttatagtctcattctaaaaatgctacttccacggctgggtgtggtggcttacgcctgtaatcttagcactttgggaagccaaggcaggtagatccacttgagctcaggagtttgagaccagccccggcaacatagtgagactgtgtcttttattaaataattaattaataaaaatgctatctactcctcttcctcatcccaaaaatccttctcattatctttatatctttaattgctttcaaaaactctaacggtttcattgccaaagtattcctttcttttctgtttatatataaactgtattttaaacaaatataaactgttaatacaactgctctgtacttaagtgtctctctctcaaataactctaccaggtccctataagcattttcacctgtaagttacatttgtccaaatgaacaaacatgacacactgaaccaatataaagtatcctgctttactatatataacaaagggattgacattctgtcattttactaaaagagttcaaaattaaagggaaaaaaataggttcccaatttttcattcaggtgatgcaaggttttagttgaattaaagtgccttggacattgtctttctttttcttttttcttttttttttttttttagagacggggttttaccatgttggccaggctggtctggaactcctgaactcaattgatctacccgcctcggtctccttaagtgctgggattacaggtgtgagccactgtgcccagccggacattgtctttctgcattgtatttccacacttcataaagcagttatgctacattcattttacttttcacacaatccttttctgatttttcgctttagaatcaacaatataggttcaattcttagttattcataaagaagacataaaaatattttaagttcatgtaagtttaatctattaatacttcctcttcaagaatgcatttaaatggctagtagctaagtaaatgattggttttactttcactaactttgtctaccatccggtggtaatgcacagcaaagctgttaaggggcaaaaagagaaagaagagggagaaataaaactaaaataatgtcttttcttcataaatcagggtctggttctaatcagaccctgatttatgaagaaaaggcattatttaaaacatttttaaatgaattcccataaggatgttcattctcagggtcataaataaaacaaatctgtatgacataaatattgtagtgtgatcttactagaaaattacatcctaagatcagttctactctaaaagaaaatgcagtcctctttgatggagatacagctttgattaaagtgcgtgcccatagagggaagtatttcttgtataggtagtctgaagggtcaaagcaaccctggtgataagagggtatcccagccagattaacctcagagattagttctgagctgactcagtttcaataaccagatgccagggaatgccttctccttgtggaccatgcaaggaagctgttactgtcatgttatcaggaaagccctaaatagagataaaggagatgcccaaaggaaccatttgaggaacatgctgttacaagtcctatccgagaacatgacaatgaacttcaccattcttctgctggtcattacttctcctacttataactatttaaaatattaattaattggttattttcttattaaaatgcagaacctctaagagtgtggttctaagctgactgctttattaatccatcttgtgatccttaggaaaaataaaacatggctttggtgtgattttaagtgctattattccaaatgataacaatgcctcagactcacatgaaatgcttatattgatggattcagctaaagtccttcacccggattcatctttgagtctctacatcaatgccaatatgcatttatgggatgactgataacgttttgggatgaaatagatggccacactacatgctgatgttaaccgtcactgggattcactttatggccttggcctcctgaatgcactgctttttacaattcagctaagaagtcttgcatcaactataagacaaccatccaaattttatacaacactatggatactgttgctttactgagagataagatctaccaaatgtagcaagaaataatacatttatattgaagttccaattcccccttgacttttttacttcaaaacaccatccatttagcatcctatgtaccatcatcactatcatctctgagtcttgtgtgctccaggtttatccgagactagttttagtggaaatctgtcgatgaataggcaaaaacagtcagactgagggtgctgagacctctctgggaggcattctatctgctcagttttagaagtcattaagcttttgaacttcttccatcactactatgagctagaggttcacagtggcatgggtctggttccctagaactgagcaagtgtatagctacttactcttcttggcctgaattctagattgtaagagttttaaatccctggagttaggctgtgcacatgtctgaagcaagtctgggaatcctttagcactgaatatggctctctcctcagttctgtatgccaccagtttgtgtgtggagcctcataaagttcgatcatttttccagtaaaatgactacagtaccaagtattagagaacctcacacattgtttaattcatatttccccaactttgcataatgcctagagtgttctatttcctcaaagaggaaagtgcttaaacaaagcacatgggagaattttggggaaaagaattcccagatgggaagagtggttaaaccaactacttttcccctccacttgttccacctcttcttcctccctttcttcctattaaagtctctgaaagtaggactaattctcatatgtctagaaaaattagtaaggctgacttttccaatacccaacaatggaatgggtcaactcataaaggagtgatatcctcatcattagaagtattggaaagaagaggctggaatagaagggatttctctctctttgatcgatttaactcaactacacttatagcagtaatgacaataaaacccaacatttattgaataccttatctgctggacatttttacctggattagctcattcaattctccacaacagcctgataagatactattattataagccccattttataaataagaagtcaaagatgtaaataaattaaaatttgtttcaggttataaattaaagaactgagatttggactcagataatctgacttcagaaaaaaaaattttttttcaaaagatgtgtcattagactaacattgacctgaaataaactacatgtaaagtctgtaatttgataagttttgacatatatacactcatgaagccatcaatataatcaagataataaacatattcaccactattcctaaaagtttctccatggctcttataaaagagactgtaaaatcctccttcctggctctctctgatctggtctgcatcattatacattagcttgcatttcctaaaattttatataaatggtatgaaaaaatgtgtatgatatatctgttttcactcaatatttttttttaagattcagccatgttgtggcatgtgtcaataatctattcctttttattactgagtagtattcctcataaatatactacaagttgtttatccattcatctactgatgaacatttgggttgttttcagtttctgtctatcacaaagaaagctgctgcaagcatttgtgtacaagtctttgtatggacatacacttccttttgtcttgggtaaatatatatgagtggaatgacttgatcacatggatcacatgatatgtatacatttaacttttcaagaaaataccaaaatgttttccagatggttgtactattttgcattctaaccagcagtaaatgagaattgtagttcctccacgtccttgttaacagttggtatgcctggtccttttactttcagacatcctaaaagtgtgtattagcatgtactgtggttttaaatctgcatttaataactaaagttgagcatcacttcatgtgtttctttgccttctttatagatttggtgatgtgctcattcatatattttgtactttttaaaaaattctatttttgggtcatccatccatttacagagccatattttgtacatttttaaaaactgaatgttttgttttcttgagttgtgaaagttctttatatattctgaatacaagtccctttatcagatatataattttcaaatattttcttgtaatatgtagcttcttttcattctcctaagaatgccttttgtagaacaaaaattttttattttgatgaagtcctatttatcattttaaagaacagattgtgcctttggtgtcatatctaagaaatactgtctaacccaaagtcaaaataggtttaagttttgtgccttaaatttaggtctaggatccattttagacaattacatacagtgcaaaactgaaatgtgtttttaaaaatatgaataaccaattatttaagcactatttgttgaaaaaaatatcattttgaaaatcagttgtccaaatatatgtaggtctgtgtctagatttggttacactaatctatctttatgccattactatattctcttgattattgcagtgttttttaaaaagccttgaaatcaggaaaagttatgattctaactttgtcctttaccaaggttagactattctaggtccttagtatttatttatatcagcttgttaatttctacaaaaaagtatattggaatttgatggacattggactgaatctatatatcaactttagcagaactgatatcaaaatactgaaatactatattacatgcaatgttgaaggcatgaacattatgtatctcttcatttacttagttctctgatgtctgttggcaatattttatacttttcagggtgcaggttctttgcatacttttgccagagttattcctaagtgtttcttttgtatttttgataccattataaataatgtaattttaatattattttctaattgtagccagtacacaaaaatacttgcttgagatatatatctctgtatatacagatgtatatatatctatatatatagatgtgtgtgtatatatatatctatatgtgtgtatctatcaatatgtgtagatagatagatagatagatagatagatagatagatagatatctcaagcaactatttttatatactggctcttgttgcccaggctggagtgcaatggcatgatcctgactcactgtaacttctgcctctcaggtgcaagcgattctcctgcctcagcctccccagtagctgggatttcaggcacccgccaccacgcctggctaatttttttttttttttttttttgagacagagtctcgttctgtcacccaggctggagtgcagtggcgcgatctcggctcactgcaacctttgcctcctgggttcaagcgattatcctgcttcagactcctgagtagctgggattacaggtgtgcatcaccatgcccgccttatttttgtatatttagtaaagatggggtttcaccatgttggctaggctggtcttgaactcctgacctcaagcaatccacctatcttggcctcccaaagtgctgggattacaggcgtgagccactgtgcccggtctgcaattgtttgctatattaatctcatgtcctacaatcttgctaagctcacttattctagttgtttttaggtagaatttgttgaacttgctatggagacattcatgccccttccctcacaatctgaatggcttttgcttctttttattgccttattgcactggctagaaccttcagtacaatgctgaacaatagtagtagaagccaactgggcttagagtcgtgtttatagaaaggtttttaagtacaaattgaatttgtttatgcctacttcttcttcagtgagctttggtagtttatatatttcaaggcatctgtcaatttcatgcaagctgtcaaatttattgatataaaatatgttcacattgtcttatttttctcttaatatctgtagaattagcagtgatattacttgttttgtgccttactttgaaaatgtgtcttcttttctttcctgatcattctgcctaaaggcttaccagttttaccatcttctcaaagaactagcttttggcttcattaatttttttaaattgtttttctgggcatataaattttttaaatcacgaagtacttcaaacatattctgtatgcagagaccattataacacatacctactctctagatttagaagagttaatattgttgtttcagatctttataactgaagtctttctccctatttattaaaaataaaaatcatatttactcccctcccttctcagaggtaacttctggccaccgtgctgaaattgacgtttacttttcttatttatgtttctaaaatgtaataccatatatgtttgttttcataaaaaatatgtctattgcttttaaaaaaatacataaatggtacatactatatgtgtcctgctttttcacccagtctcttatcaatagacatgtaattcagtttctaatttttccatttctgatcataaacacatgtatagtgtctctgtaagatgtgtacctagaagggtaatttctgagtagtgaattataggcatcaagtttactagaaattacttaatgttcttcaaagtagttgtagccatctatactcctattataccatcaagtctgaaagcttccctttcttcacttgcctaaaaactcttggtattaacagacttttaaacttttggtaatctacaactgtaaaattgtattgtgttttattttgatcccactgattacaagtaagataaagcaaattatgatgtttagtggtcattgtatgtttcctcttttgtgagccgtctattcatgttgtttacacaatttttttctactgggttatctttttcttgtgagtttgaataagttattattttagatgccagtccttttatcatttacatgaaaatatctccttccaatcaatggcttatcttgtaacttattttaaggtttcttttgttgtttacagtttttttcccctttacttaaatttattaatcctttctaggttattcttggccctttactacttcatatacattttagaatcaccctgtgaggttcagtgaaaacctcattgggattctgatgaaaaaaatagactgacttcatgaattaacatgggaaaaattgccatcttcatgattaagtattgttttacaagtttatttaggttttctatttattattgatttaatattggcaatttatattttaaacaaaattatcaattcatctgtgtttagaaagttgttgcaaaaagcttctcagtattctcttctgattatttaaatatgtcttatgcctgtagttatgtcttcattttaattcttgctatttttacttgtgcctattctatttcatcatctttcttgccacaggtctgtataattagtcttaaaagaaagaaaacccagcttttgttttagttgatcctgtcattatttgttttctgtttcattaaatatttactctactctttataattttcttctaatataaaaagtcagaaaaacgaacagagtaattgttaagttacaatttgagaagttgttgagaagattcaaacaaaatgtacaagtaattgttaagttgaacttctataattttctttaatttctgctatattgtatacatttaatttctcaagaactatttttgctgcattacataagttttaacatacactgactcagttgtcttccaattttaaatattttagttttaaatataaattatttatattttttgaggcctaatttatttataagtacttttaaattttcaaacacatgaacttgtgcttttttcttttaatattttcataattgattatattgtagacagagaatgtggtctgcatgacagcaagtcttttgtaactctatttgtggcctaatatctactcaatttttggaaatgtgtacatatacttgaaaaaattatgtattcactaattatgtatgtgcattagattaatcttgtacattttgtttgaatcttctcaacattctcaaaataatatttaactaaagggtcctaaaagtagcatcttaacccccaatagtcaaatcaagtctttaaagactatcaactaatattatctgaaaggcaaatcatgtctttgcatacacatacacacatgcacacacaaacacacattctttgttctctataaattctctaagccttgctccctgaaataaagatccaactgttagtcacaaaattctcaagtattggggaagaatctcatattttttggctataaaatcaggtgaaggttaaaaaaataaaaaaactttacaaaaagaaatgtaggctgggtgcgatggcttacacctgtaatctcggtgctttgggaggctgaggtgggaggactgcttgaggccagaagtctgaggccagcctgggcaatatagcaaaactcccactctaccaaaaactagaaaaacttcgccaggtgtggtggcacacacctgtagtcccagcaacttgggaggatgaggtgggaggatcaattgagctcaggaagtcaaggctgctgtgaactgtatgatcatgccactgcactctagcctgggcggcagagcaagaccctgtgtctcaaaaaaaaataataataattgagtggtcctgcagttgaactattacatacagggtcctgttgccagggtccacatgctgtagcccactcagagcactctctctcccttttatggttccctagtgtgttgggatcaaatgaacaaaacttgtttatgatacagtcatgctttttgtgatcatgtatagttcaaacatctatatttgtaaacaaagcccaataatcattttgatcatttaaattctccttctgaaatctttgcagatctttcagatctatccttctaaagatctctaacctaagaatgataaattacttctgtagatattttctattttgtttctaagatggttcttaataataatcatcaatttgttagtttatattttatttttcttggatttcctgactgatttgtacatattgttggatgactaacaatttgtttcgtctcaatgttacacttaattgtgttttgatcaataaatgttcacccagcatatacttcctccaatagttctatcaaccactcaaaagtttagtccatttcttttcttttccttgtctattttaaaagtacaaagcagttaaccatattctaaaatctcaatcaacacaccctgagtattctagcaatatgcatctcgaaagtgaaaacttccattactgtctggccttgtaatgaccatactttgaactcatttaacatctacagataagtctcaagataatattacttaggtacatattagagctgttaattcgctcattctaagctactaacaaattttgggtcttctaatttgtttcatacaaacccaggacttgatacggtctgaatctgatcaagtatgatgaatgacttctgtgtcttcaattattctaagcaattaaaggacaaaaaaaaaacctgatagcactttgaagactgtacaatattcagtatacagcaaaatgaagagacatggaaatatacacctaaataattctgattcaaatacttcaatgtgattctgaagaaaggaaatgagacaaaatacttttatgacaaagaatttcattataacaaattaaacactatatgagaaaggtgttaactaatctgggctctaagaatccgaaatcattcatgagggtgctaatggggtaattctttgacttacaaatattgaatgatgaaaactggcatacatgaagttccactgagctagtgaagaggcactggtttctctaatttgtgaatttctgatgcagtattctcagtgaaaaattattcagtagagtatcttcttcattattataaagctcaaccaagttaccaagccaggtaattaaagctgtatgttaacctttctgaattctaatcttattcctctaatctaactagatcacatatatgtcctccaattatttttttgttttgccactaatgtgacagaaagcaatgaaaaaacaggatctaatatagaaactttgagcctctcgctaattttaagacaagtatctactatattatttatgaatctaaaactgaaatacatggaatagacttaatctgagattagtgagacagactgcttgtacaaagatgaaaagtttttgatttccttcattttcatccttaaataagtaatgaaaaccaaattctgaatataatctacatagatacaaaactgataacttggagaaaataatgtggcctgcattattgtgacagcttccttgtatcttctctaatctaattatggcctacagcccattctcaccaatgcagccagaatgatcttgttaaaatcaaagtcagattagaccactcctttgctgaaaatattttaatggttccctacctcattcagaataagaaatgcaatccttaaatagcctgcacagagtcttccataatcaactcccattttcaaacccagatccaaacatttccaatctcatctcctcctttctcccccatactttctctactctaccagtcactatggtcactttgagtgtttcttgaatacctcagacatcctcttgcctcaggacctttgggagtgtggccttgaatgctcttccttcgcttgaccttaccttctacaattcttggcacatatgtcagccctcttcttagtgaggctgtggctgactgcctttttaataactacaactcccatcccacttctggcattttatccccttgtccctgctcatttttgtcattttttcagaaggcatttattgctctctgaaacgttcattattttacttgcatatttccttcttatccatctctccagataaaatgcgagctacacaagggcagaggtttttgtgtcttttctttaatactgcattcccagaacctatatcttaccacataacataattagatagctgacacatcagtaaaaaaaaaacaaaaaacaaacaaacaacaacaaaaaaacaaacaaaaaaaacaataaattaaaagcagccacagtgatcaactaacatttaggaacattttagttgttcttagtgtaaagatctaaattcactagcttttaaatctcatcgttcttaaaaacccttaatttataaatgagatttctagcctaagatcactcctaaatacactttatacaagtaatattacttgattatctgaatataaattttctaatttagtgatctccaaatcagtcattaatttactaataaattcagttgcctctatgcagcattatcactaagacatataaaaatccaaggatatcatctcagcttacagaaggaaagcatgtgagacagccaaactaaagagaaataaaaaagcaaagggtctcaccaattttatttttcttaagctgaaaaacataattttattttattttcaattttttttttttttttttgagacagagtctcactctgtcgcctaggctggagtgcagtggcataatcttagttcactgcaacctttgcctcccaggttcaagtgattcttgtgcctcagcctgccgagtagctgggattacaagcatgcaccaccaggctcagctaattttttatatttttagtagagatggggtttccttatgttggccaggctggtctcaaactcccggccttaagtaattcactcaccttggcctcccaaaatgctgggattacgggaaggagctcccatgctgggccaattttattattcttaagctggaactgtgccaatagccagttccaatgtagacacggacagaggataattcatggagatacaacagtacagaggagagcatatttatataaacaataataaacggatgataagaaaaacagcatcatatgaagttagctaaatggttaatgaactttcaaatacaaaatttaaaaactcaactaaaaggttttaaaattcttaatttaaattccttgaattacagaaatagatttcaaggtgatctgtaaactttatgcttctcaaaaggacttgacacatttcattgctagagatttcagaatttctactagacttcctatgacatttataagattaaaggatgtcttggatgtttgccccttaccgattcaactaatgatcttgcttcctcttgagtgcaacggaaagggctatcagatatctgcacgtttgtgctggagaggaaaagagaatgttattattaaacaggataaaaagaaacaattaccaaaaaaaccccaaaaactaactccaaatactccacatctgttgtataattttaaccaatgaatagaaactgaatgaataaaaattaagacaatgaaaattattgtatattctttcaggcaaggttctaagtatagagtagtccacagcaaagcactctccagaatgataaaagatttttaaaaattatattacacaaatcctaataatttccaggtatatataaaaagctacaccacaattgcacttcacctttattgaagaaaagaggaagcaaatttgacccacacaatgggacctaggataaattttcctctaagtgaggtaacaaacattgtaattagctactgaaagtttttgcggaatctctttcacagataaggagattaaagaggaaactatatgaatgtaaagtttgttttcttatatgtagggaagttcagccaggcataggaatagcagctccttccctgactagggaagcctccatagagtcaaaagcctttcctatacctctaaaagcatgctactcattacatactgccactctctagatgaaagcaaaagcatcattcctctgaaacatattaaggctgatttttaaaaatttcatcacaggaacaggcagattaaaatggataaagaggtggtagagaagggagttaaagccaaattaacttttttaaatagaagaaaaagtgattagcagatacctaaaagataaaataataggtaaaacacacgtaaacatattccccctcaagtggacctaaggatatacattatcaaatttattttcacaatagctgtgtgaaatatgccgagatatcggtgataaaaacatctgtctatatctgtttgtaattgatgacactgagtatacagcgattataataagtggtcattttggtttctatccagactcataatgtgggattcattttcattcttggcatgaatagaatctgatgaaagttagcagtaacatctttaagactaagttttttttgccactatagcacacgtttacttacgtaacaaaactccacatcctgcacatgtacccctgaacttaaaagttgagggggaaaaaaaagacagttttttgtcttttctacagctcatgtttaaacaagctgacaattgaaaaaggcagagccctgtaagttagatgtttccttgatgactgtcaaaaatgaatttaaaaagaaccaggcaaaaaattagacactgcaaaaaagtgctggtcctgtgaagaaactacgatatacaaagtactaattacaatgcatacaacaatgcttttaacattataactaaaccaaagtaaaacattccttggaaattctggaaaaatgaaggtgagagaacagggggcgggggtggggaggtcttttctagatatagttgccatataaaatacataacaaccaattacatttgaatttcaaataagcaacaaactatttgttagaataagtatgtcccaaatattgaaagagacacacacacttacatggaataatatttgttattctgaaatatttaaatagaagaaaaagtgatttaactggtgtcctgtatttttcatctgttaaatctgataaccctacttctaaagtaatcccctactcttacaacaaaatgaaactatgaataggaatattagaaaagaatgacaatatttaagccagcacggtaaaatttaaaaatatttaaaattttattttaattttaaaaattaaaaaaatttaaaaatatctctgataaaatgtcttgacaagtaaccagtagtggatatcttgggaaagtaaattgactctgctattttttcaccttaaaaaatgtatgagcggttgggtgcagtggctcacgccagtaatcccagcactttgggaggccaaggtgggcagattacctgaggtcaggagtttgagaccagcctggctagcatggtgaaaccccatctctattataaatacaaaaattagccaggcatggtggcacacacttgtaatcccagctccttgggaggccaaggcaggggaatcacttgaacctgggtggtggaggttgcagtgagccgagatggcgccactgcactccagcttgggtgacagagcaaggcaacgtctccaaaaaaaaaagaaaaaaaaaaaaattagctgttttaagaatgaaaaatgaaatggcaagcacatacaaatgaacttaggagattcttgtaagataaaccgatacataggatgaaagattacaaagttccttctatttatcaaataggctcttctatcagctaaaaacagtgccaacatcctcaatgatgtccttttagtcaataatatatgtaatctaggttgtaagaacatatatgtatgtaaatatgtgtgtgtacatacctaaatgtactttatcctctcttggatttaatagttatttgtactttgaatgtttaaaagtgtaataaaaggcatgataccaagaaatatttttattttttctgaactggccttcatgtaaaaatagttgtttaacattgattcatatttatttgccaaatcaaaaaatcacactatgtgtcagggactcttctagacgctggagacacaatattgaatcatggaggccccaaggaacttttaatctttaagattctttttacttctcaaactattactacgacctgccaggggaaaagcagtataatcatttaaaggagggatgactaagctgttagtgcccactataaacgaaacttaaaaaaaaaaaaaaaaactaaaaagaatgcactgctttcctttttatactaagatattaaatattatattctaattgtataaatgttacatgacctatatacaaccttgttgaccaaaacaagcagatgacattagagcaaaaaatcagtaaaaccaaaaatgctgtgtacaacaagcccaaattacatataaaaataataaagtatattactagacagataatagtgttttgtgaagggaaaccattttcttcaagtaaatttcaaatcaaacaatggcccacacttatgagaatcctcaaagacagtgttcaggataaagatttgtcaaggcttttcattctaaatcaaagtagtcaagaaaaaggcaaagagaaaatttaaagagatcagaatgacaataattttagaccataacctccagagtttatagaaggaagtgaccttggaataaatgtacacaaagccaaaacaactgaggctatcaatacataaaaaagtaccagattactggtgccaaaacagacatatagatcaatggaaccccagaaataacaccacacatctacaacaatctgagcctcaacaaaccagatgaaaacaagcaatggggaaatgattccctattttataaatggtgctgggaaaactggctatccatatgcagaaaagtgaaactggaccccttccctacaccttatacaaaaaactagctcacgatggattaaaaacttaaatgtaaaacccaaaaccatacaaaccctagaagaaaacctagacaataccattcaggacataggcatgggcaaagacttcatgactaaaacaccataaacaattacaacaaaagccaaaattggtaagtgggatctaatcaaactaaagagcttctgacagcaaaagaaattagcatcagagtgaacagacaacctacaaaatgggagaaaatttttgcaatctacttacctgacaaaggtctagtatccagaatctacaaggaacttaaacaaatttacaagaaaaaaaaaacccatcaaaaagtgggcaaaggatatgagcagacatttcttgaaagaagacatttatgcagccaacaaacatgaaaaaaagctcatcatcactgatcattagagaaatacaaatcaaaaccacaatgagataccatcttgagccatgaatggcgattactaaaatggcaattattatcagaatggcaattattaaaaagtcaagaaacaatagatgatgctgaggctgtggagaaataggaatgcttttacactgttggtgggagtgtaaattagttcaaccattgtggaagacagtgtggcgattcctcaaggatctagaaccagaaataccatttgacccagcgatgtcattactgggtatatgcccaaagaaatataaatcattctactattaagactcatgcacacgtatgtttattgcagcactattcacaatagcaaagacacagaaccaacccaaatgcccatcagtgatggactggataaagaagatgtggtacatatacatcataggatactacgtagccataaaaaggaatgagatcatgtcctttgcagggacatggatgaagctggaaaccatcatcctcagcaaactaatgcaggagcagaaaactaaacaccacatgttctcacttacaagtgggggctgaacaatcagaacacatggacacagggaagggaacaacacacactggggcctgctggtggggggaggggagggagattattaggacaaatggctgatgcaggcagggcttaatacctaggtgatgggttgatgggtgcagcaaaccaccatggcacatgtacacctatgtaacaaacctgcatgttctgcacatgtatcctggaacttaaagtaacaaaaaaaaaaaaaaaaaaaggaagtaccaggttaatatacctttctctaggaatgtaaaaagaaacaactttaagacctaaagaatttagatgaattgaatatatttatttatttattcagtaagcatatttagactacctactgcatcaagtcctgctattgagtgctgaggtaaaaactcaatacaaagtattaaaaaaaaatccacctccagttctacatagaggtatgtacagcagtgatacaacagcccaacagaaatgaaactgtgcagaggtgacatctaaactgcttctcgaaaaaatgaagatgtccaccaaagaaagacaaggggataggaaggaagagcccatgaggctggaaaggcaggtttggacacattgtttaagaatagaagggttggatgaaatcccatttttgaagggaatcataagacgtttttaggcataaaaatgagttatattcatacttttgaaagataattctggcagtattgtatagaatatattaaacaggagaatgattgttaataaaaaaagagtatgagtaaagaaataaagcattactttatgagtaaagaaatgctaagtaactgaattagtgtagttttataactagaaggcactcaagaatcaatcaaaacttgaaaaatatgtaagacagatggatcaaaataaataatgattaataaaataaagtagtaaacagaatagtacatttctgatttcttaataaggtatatcaactggttgaagagaaagtgggagaggactgaagagtaaactcaaatgtcaaaaaatgatttctcccagaatcaagtttaaagttttcttaggtaagactagaaattaaattctctctgttaatataatatttagatttcagagtaaacatccagcagtggaaaaaaagaataaacaacaacaacaaaaaaaaaaacttcggagaaagagaattttcaaggtatcaatgaaaagaacttaataaaagcagtgctcctgaaaagagaagagtcactacctggattaaaaaaaaacaaaaacaaggctgggagtggtggcttatgcctgtaatccccgcactttgggaggctgaggtgcgtggatcacctgcggtcaggagtttgagaccagcctggccaacatggtgaaacctcgtctctactaaaaatacaaaaattggccaggcatggtggcaggtgcctgtaatcctagctacttgggaggctgaggcaggagaattgcttgagcccgggaggcagaggttgcagtgagccgagattgcatcactgcactccagcctgggtgacagagtgagactctgtttcaaaaaaaaaaaaaagaaaatggttggctttaaaatattattcaacaatttactccaacagatatttattgagtggctactacatgccaggcattaggaatataaagatgaataaggcatctttattcatctgctcttgaggaacttatattctagagaagaagataaattcattaaccaagtatttagtaactgacagatgtaatgacaaaaatccacagaagacaaggaatacagagagtactggcatttcaactagcatatgagggaatgtttcctagagaagacgaagtaaaaattaaatcttaaaagatgagtaacatggccagttcaagaaatgagaagacaatcatggcaaaggaaacaaaatgagtaaaggtctagagattactacaagcacagtgacaagtggccttcagttgttgtaacatgaaataggagacaagaagtgatggaaaatgaggcaagaaaggttatctaaatcttggacggccttgtttgtttttccatgagaacaagtttggattttatgattcttaaggccgggcgcagtggctcacacctgtaatcccagcactttgggaggctgaggtgggtggattgcttgatcccaggagttcgtgaatatccctagcaacatagcgagaccctgtccattcaaaaaatttaaaaagtagccaggtgtggtggtgcatgcctgtacttgggaggctgaggtgggagaatcgctgaactctgggaggtcaaggctgcaatgagtcatgttcgcgcccctgcactccagcctcggcaacagagcaagacactgtctcaaaataataataataataataataataataataataataataataataataataatatggttcttaagcagagaggctcatcagaatcacatagggggctttaaaaacatatacgtttagattctacttcctaaagatactaatacactaggtttaaagaaggggacaatgtatctgagttctctaacaatttccctagttaattctgtgtattacatatacattgagagaatgtctatgatagtatggacctaaactgaactgagtgagaaaaatgggtttcaaaaaggaaggcagaggaagcttgccaatctacaatggtacagtttaaggaattaagaaagataggcaattcattacagaaaggcaaaagaaataaaaactaacaacgctgaatatatttccaaattaagttatgataaagagaaaaatggattaaaatgagttaaaattctgaagctcttgactttaaattttctagatgcatatgatacatatactgaaacttatattctgaaaattcttaaactaaaaaaagttattttgttataaaaaatgtagaggaggtaaaagaacatagctattaacagagtaaggtttaggccaggtgtggtggctcacgcctgtaattccagcactttgggaggccaaggtgggcggatcacttgaggccaggaattcgagaccaccctggccaacatggtaaaactccgtctctactaaaaatacaaaaattagccaggcttggtttcaggcttatgtaatcccagctacttgagaggctgaggcaggagaattgcaaattacttgaacctgggaggcagaggctgcagtgggccgagattgcaccactgcactccaacttgggcaatagagcaagattccatttcaaaaaaaaaaaaaaaaagaaagaaaaaaaaagagagtaaggtttaaatcctggctccacaatgcattgtgtgaccttaggtaagttacctaaatctttatgtggactcaatttcttcatgtgtaaaatggagataacaatacatattttataggattcttgagtattaattacataacatatataaatcactcagaacgtggaacatagtatagagttaataaatgttaactcttactgttaatgtaatccttatcattactcaggaggctatagcaaaatgattccagagcttagaaataaagttaccttcacagtaaggataattagactcagcacagaaggaatgagttcaagctatatatatactaaccaaacaaagggtctctggctgtgtagctgaggaaacctggggaaacactcaagtctcatcaaagactgcataagctttttagaaagtgattaggaaggagataagacagcaaagagcaagcaaatatttcctcagacaatcacagaccccctcctccttcatactggagggactcattacactggagtcttaattttagcccacaaagaatagctcactctaccatttactaggatagacaagactagaggacattcaatcatatccagctttgctgttaataaattatattatttatattagaaacaattacctgcattttaagattatgcttaaaaaaaaaagagtgctctgcatacgaggtaagaaaaaagggagaaggccaaggagttgacagtgtttctttagtaagcaagagaaacaaagtcaattatcttcaatgccaagcatttgtgttgtaggcaaaatgggccttcttgataacttaggtaaaatattccttgatattaaataattctttactccatctgattaccttagtctagaatttatttaatgaccctcttgattcccagactgtgctcagagagcacagggactctatcgtattcatagtgttatctttagtacccccacaggactgcttttgcctcctatacttagacttaccaagagtcagttgttttagttcttaaatgtgttcgtcaattgtacttgttactataatttcaaaatttaagtattaattatgttcacagatgaactgtaaaagagtgtggaagaactgtttctgtgaacattaagtaggttataaaactaacgaggctttaaacaatactgaggccctaaaaagcctcaataaaggtgaatcactacaaaaatttggtgtagataacataatttaaatgatttttttaaaagaaccctaaaaatctgtcaggaattttaagttacaaggagcttaaggattacagaatctttattttctatcctgtgttatgttagagtgtatataaaatctatatggaatctatattaaaaggggctcagccctatatccaaaaatgggtgaatatacatttaaatgttttaaattaaatgtttatgttactgttacttaattcctcttaatcaatcaattagtgatcatgatgaataaggaggcttttactttctaagaaattatatggtagttattagattttaaagaaaccgcatagatttacatgctgaaaaattgcgtttttcatctttgcacaatgtatttcaattaaatgtccatttatttatcagtattcccactaaattataaattccttgagaaaaaagatcacgtcaattcctagtttaatagtgcccaacacttagtaatgcccaatgaataggtagataatctgtattgtttaaattaaaaaaaatgcaaaaatctgaaatctgattattatgtggctgtttaataccaattaatataacattacttacatagaaaagacaaattcttaccaatttatagctcctccattacacttcttcataagcaatgctttccaacattgatgagtggatttaataacttcaagagcaaaagcctagctccaaacaaacaaataaaaaaagacgtatttaatatcagtcacattgttacactaacacaaaactaatcttgtgatgacagttaattgttaagagcatgagctccagagtcaggcaaagcttggtataaattctggcttccttatttgtcagctgtgtgactttgggcaggttacttaagcttgctaagcctcaatttcttcatctatgaagtagaatataatagggataatctatatcaggggttggcaaactaggaactatgggtaaaatccagtctgccccctgtaaagttttactgaacagtcacatttgcttgtgtttggcctatgctgctctagtactacgatagcagagttgagcagctgtgacagaaatcatacgatctgcaaagcctaaaatattttctatatgacccattacagaaaaaagtttgccaacccctgatccaagtcacagagttgttgaaagagtaagtgagatgacatatgtaaagtgcttaacccagtacccggcttgtcagtaagcatgcacccattaatctcagcatcatcaaaactgcaggcagtctaaatgtagttttttcaatcgaagtaattttagactatccactgtctgaaagcagtacatctccttgacatttatgacattgtctaaaaatgcataagcaacaatagatatacctcttgttggatatacatccagtaagaatatctaaggaaaacttgctttataattccaaagcagaaagttctttagagttttttcccaaaaattgttgtttgttttccttaaggagagtccttactggttagttcaaagtagctcctttcttcttcaatgataactaaactcattatgataataaagaaactaaagaatcttgggaactgaggtacagtaataatgggaaatttatcctctgaaaagagaatttctctcgggtctacgattgcctgcgatggaggacgacttatatcttaatgagatagtgttgggcgggaatctcacttcagatacaggacaagaaatctaatacattatctgattatgtaaggatagatttttaatcaaattatttggataagtgtgattatttagaaccaatttcaatacttgtttaaaggagtggcaagaaaaacccacaataaaagaaaggagccatctttccaaccatgttaaagaggcacaaatcaattcttgagttataccctgctatggtttgaggggatttgtcctctcaaatctcatgttcaaatttgatccgcagtgttggaagtgaggcctaatgggaggtgtatggataatgggggtggatccctcatgaatggcttggtgcctcctcagagtaatgagtgagttcttgctgttagttcccacaagaactgattgttaaaaagagcctgggcaccttccacctctctcacttgcttcctctctcaccctgtggcatgcctgctcccccttcatcttttggcatgactggaagctttctgaggttcttaccagaagcagatgccagcaccatgcttctggtatagcctgtaggactgtgagctaaataaaccttttctttataaattacccagcctcagcagttctttcatagcaatactaagggcactaaggctctatattttaaatagcagtagtaaaaagcaatgcataaaacaattattttctggtgaagttgtataaatgacctcatctttatacagaaaagaattactatttgttaaaaacaaacaaaaaaaaactacctcattctttacaaattcgtgacttggcagacttaccctgaggcaaaaataccatataggtttaaaatttcaattatctcaataataaaatgaaaatttttaaaagaaaaataatgtataaattttcaatcctttaagataatttaatctaaaataataattttatatttacatttaataatcccagacaaagccctcaagatttgaaggattcttttaatgtgctttcaaaaaaacactgagtccagcaatcaattcttttacagcaaaatacccattataaattttaagttttcattaacatgccttatttcacttataaaacatacttactggtatccacttaaaagttggtttcaaatattcaatttacctagtggtaataactttaaaaaaaattccatgctttagactttaactctttggtctattctctccatctgtgtcatattagagatactttgtggtaactcagtggtattctaatagaaaaatcctatgacagtaagataattcaggtgtcctttcaattgttaagcagcttagttccgtcgtggtagaatgaacacttaggagggagtcccctatggatttacattaagggtgagtaactttctcctccacaaaacagtaaatagaaagtttttctatgtacacaatttgcaaaattagtctgatcatgaaattccttcattttccaagacgtaggagctatagacacatagatggaaatatatatttttcagccttgttgattcacttagatcttctgaaacagaatttaaataataaaataatgtttttaaatatgtaagttagtaaaaagcacttttttaaccatgctatatatacatattcacataagaaacttcccaagtgaaacgaatattgtacaggtatcaggaggtacattttaaaataaagattctcatcttcaccttgtttttgaattctccattaaaagcaaactggttttctggttttccatctggtaccttatataatctaaaccaattaagagtagcttccaggtaacccggtttgaacttcttaacatcatcaatatctgtaaagaaaaaaacaaaaagatgttttgttaagaaccaaaattaattccctttagtggcagagcattggactgagggagccaggaaacatggggcccagtctaaccagaagcacaattgattgtgatacctagagcagcatcatcattgatatgtatatcaccttcagacttttgtgttttcatatgtataatactattcctgcactctacaaacatttacaaagcatcttcagacaatgtgctatgtatggggaataaatggatggatacaacaaagttcttttcatcaagatactcagtttttaactcagggaaagagacaaatagataaactgcaattaaaatgcaatgaggttttaacagagataaacagaagcaatggtaatgtcatagaagagggagtaaaagaaagcattataaaagtgagaagtacatcactaactggacaagaggggaaaaggtagaaggaacagcacacataaaagcaagggactatattttagaatatacaaagatggttctgcatggatagaacatcactgttaggaggcaggggagagggaggagacacctaggaaaagccagtcactgaggatcatatacacagcaatctccctttatccacggttttgttttctgcagtttcagttacctacagtcaactgaatccagaaatattaaatggaaaattccagaaataaacaattcataagttttaaattgcataccattctgagtagcctgatgaaatcttgcactgtcctgctccatcctgtccaagacatgaatcatccctttgcccagtgtggccacattctatatactacccaccattagtcacttagtagccttctcagttagcagatccactgtcttgatatggcagtgcttgtgttcagttaacctttattttgcttcagaatggccacaaagcacgagagtagtggtgctggtaattttattacagtatattgtcacagcatattgtattgtatacaatatatttattagagcatattaaaattatactgttttgttataacaaaacaaacagggatgttttgcaaaaattaattaatattgagttccttgaacgaacggttttcttattcagaggggaaaaaaatcttttagtctactgacggcgagtgtctagaaatgcaatttaatcaatgcccaagataaataattttctaggccaggtgtggtggctcatgtctgtaatcccagcactttgggatcacctgaggtcaggagtttgagaccagtctggccaacatggtgaaaccccatatctactaaaaatacaaaaaaaattagctggacatggtggtgattgcctatagtccaagctactcaggaggctgaggcaggagaaatgcattagtccaggaggtggaggctgtagtcagccaagatcacgccattgcactccagcctgggcaacaaagcaataaataattttctgttgcttaaatctgatttatgacttcatcgttgtaccttactcaaactaacattttctcttccactgtatataacttttacaaatcatataacttttgtatgatttttgttacttaactcactgacttccaaggagaaagagaaagctaattatctaatatctacctcagtctaggaggctttctccccaaaagtcataaagaggacccaataagcaaagacacaaattaggaaaaaaactgaaaattttataatggaaataagaagtataactctccaaatataagctaaacttttccattctcaactaattataccctaggagaaaacagctgcattgtcccaaataacaaaacaaaaaaattacagtaagatatttaaacatttttaaaacctcaatagcaaatgcctgaagccaaattcttatatccaatgccaacagtcagttcaataacccctctgaaattataaaaagttccagctaaagtgtataaacttatttgtagtttatgaaaagcatacatagatatatataaaacttaaacttgttcctcacgaaattcctgagagttaaaaacaagtatgtttatattcaacataagaaaactacagctaagatagtttaaaaggcttgccaaaatctatccaactcactcatgatagaactagtattatataaatacaagacttctaattccatgacttctgctttttcttctatactgcatagtaacattgcccaaaagttttatttacatttaaaaaatgtaagtaaagatgtattttttcagttttcttttattgtgataaaatatccataatataaaatttgccatgttaagcatttttaagtgtataattcagtgacattaagtatgtctacaattttgtgcaaccatcaacactatccatttgtaggacatctttgattagatatatttttttacaatctatgttattttaagaaaagtggcagttctctagtagtcatttattcccacttgtggaattaattttatatgaattttagagatgaactaatccaataaagttaggataatctggaaaagctatatatgtaattaagctaaatctatttcagtttctaattttgattacaaattaagctcttttaatcgaactctacttgatcaacttactggactgattagtaaagactctacttttgtagaacattctgattaatgttcacatattatgtatgctgactctggcagagtactctagaatgaagcccacacttctatttccatcagttaagttttagctttaccaagcatcaggtgtgtttattcccaaaccatttatgctaactgtatcttttattataattatgagatgtaattaaatattacatacaccagtgaatttatgagtacaaaaaagtgtttgtctttatgaagttaatttgaatgttctgaaagaattcaataaaacattgctaaaatatctgttgtcaaattaagcctggagctaggtgccatggcatgcccctaatcccagctacttgggaagctgaggtgggaggattgcttgagcctaggagtttgagaccattctgggcaacatagtgagaccccatctaaaaataaaaacaaaaaagaaaaaaaaaattaggcctgggtaagaaaacagttaaacattaggaggaaaaaaaccataaaaatctacagttatgcatataggctgctttgcaagtaaggaaagaagagaattgtagatatgagaggtcagggatatcctctggtgaaatcactttagtagagtcttggatgaactgtaggagcaactcattcaggtatctgaaaggagtgcagtctgggaggaagacagtaaatgcaaatcttctgaactaagggtgtgcttttaacatttcagggagacagtaagaaagtcccatggctagagcacagtgaaaaaacagaaagtattaggagatacgattagagaagcagtcacaggccagtcacagaggactctaagggccatactaaggattatagctttaactttgggatggttttgggcagaggagtaaatgttttaagatctttctatctgctgtgtaaagaaaagactacatagaggaaaaaatggaagctggaagtccaataaggggctgctaagagagtctacttaggtgaactatgatgagggcctagacaaacgtagttgtatggaggtagtgataaatggtaagattttgggtatgttttagaaagtaaaactcagaggaattaccaatggaaaaaaaattaacaataataaaccagtaaagatgagatgtacatgagatgtaaaactgaaagcagtcctcaaaattctttctttttctttcctctttttctttctttctttctctctctctctctctctctttcttttttgacacagtgtcttgctctgtcacataggctggagtacactgtgcaatcacggctcactgcaaccttgacttccagggctcaatcaattcatccactttcgatttccaagaagctaggactacaagtgtgcaccaccatgcttggctaatcttttttgtttgtttgttttccagtagaattgctttgttttgttttagttgctttgttgcccaggctggtcttgaactcctgggctccagtgttcctcctgccttggcctcccaaagtgttgggattacaagtgtgagccaccatgcccagcctatcaccccagatttttaaaaaaggctttataaagagtgtcataacttctgacaaatagtgtgcagccatgatttactttcaaatttgaaagtttaattaacaaagattatatagaatctccttaagggaatttttgtattaaaactataaaaatatgttttataaataatcatagttctatataaatacattgaaaatattgtaaatttctctctaaaattccagttgaaaaacaggtaataatgaagcaatataacagacaaatcttaaggttccattgggtttttccaagtccagagctctcacttcaatttagtttttcttaactaactttggtttatgtttctataaaagaaaacctataataacttaatgaaaacctaccattttatctctgcagacatgagataaatctaacataatactttctaagagaaacgtttatgacttttttttccttcactggggatactgtatatctttcatataaccaaatttcctttccatataaaccaattcacttgtttctaaaatctaattggaaaattctttctactctttttttttttttgaatccaaaaacacactctgttgcaccaggggtgtttctaatcacatgagtttgccaagacttcaatattacccacacttcagaattaaacatactttggaagtaagttaatagtaatgatatgacttcaaaagccaaattgataaggtatattttatatacaaagaccatgaacagtatatatgagagagaaatttagagaaagtatgagacctatttaatctagagacatattaaaacaataacatttaaaaataattatataccaaaaacaaagaaaatgttaagaaattttaaacacatggaaattaagacaacacattctataagtacaatataataaatttaaagatcaacaataaacacatttaaaaactcttgcctactgaaaaagaaccacccccaatcccctgattttttaaatataattaaaagataaatattaaaagcaaataaacaaagaataaaaagtcttactaaataaataactttcgggtccaaaagaaaatcaaaactctaaaaatattcagaaaataatgacaatgagaacactcaggaagtttctaacaagaactaaagaaaaacatgtttggaatcagacagcactaagtttaaattccatttctggtacttccatattgtatcactttgggaaaaatgtactacctgtttcttcaaatccagaatagggaagaagaaatcaaggttgtcatggggattaaataatgggtgaaaatcacctaataaaagggaataattcttaacaaatatcaatcattatctctccaattccccaaaactttgtccatgaacacagccaaagttacacttacaggcaaattaatagctttacaagcttttatctttcaaaaataaatacacaggccaggcacggtggctcacacctgtaatcccagcactttgggaggccgaggcgggcagatcaccaggtcaggagatcgagaccatcctggctaacatggtgaaaccctgtctctactaaaaaaatacaaaaaattagctgggcgtggtggcgggcacctgtagtctcagctactcgggaggctgaggcaggagaatggcatgaacctgggaggcggagcttgcagtgagccaagatcctgccactgcactccagcctgggcgacagagtgagactccgcctcaaaaataaataaatgaataaataaataaatacacaaacatgagttaatttttttagaaaaatactaaacagattttcattaatattgacagttattttaatttgtataatgctcctgaaaaatcaatgtaggtaggcatagttataaacaaacacaaagactaaaaataacatatataaaaagtatctaggtatacatatatacacatacacatgcatacttattaataactttttgctatacacatatagtttttcacttatagtaaagaccctaaatgaatttgtaattaatttcttatttaacaacagacacgtttacttttatctctaatattattacaatttagttcttataaatttatttttttccactgtgttgaagttaaattaacccctcttttaaacatttggaatggagagggaatatataaatagaattacttgagtgaagtacttataaatatttatttctgaaatgaggttttcactgagttcaagcatattaaccaaattatcagcaaataaaaagactcctcaagtttccaaagcattctgcttcggaaaaaacagagaccttttgacaggaggggcactaaattcgtgtttcaatgtactccctcaggctaacctacctaaaatagataccttataaacagattaacatcaaaaagactcaaaaacaagataagtaactttgtagacccaagagggaacaaaaatacaaaacaacatgtagggctgcatccaggggcacacaggaatcctgatgtgcaggcaggtaggacaggctggaagtttggctcctgtcaagtgaaggcaggatgactatgcgatttattgtatatactggaatatttctgagacctgtatcaagagaaaaagcagttaacagaaatcaatccttatgtgacctatgcaaacaagaattttaaagtagttattatgaatatgttcaggactttcaggaaacatggtcacaatgcacgaacatatggaaatccaagatgaggaacagaaactataaaacttcaaaaaaaaaaaaaaagaaccaaaaggaggatatgaaatgaaaaatcaggtagatttaacagcagaacgtggatatggcaggaaaaaaacaaaaaaacaaaaaaacagggaagtagaagatagattaacagaaattatccagtctaaataacagtaaggaaaaaaaagatgaaatagactggaagcgtgttagtgattgtaagacaataaaaagtagtccaaaatatgtgtatttagtctcagaacgcaggtaagaaaacagagcccccgcaaaagtgaaataataatggcaaacaatttcccaaatatgatgaaaaaatatgaacttacagatccacaaagctcagtatatcctaagcagaataaatacaaacaaaaggaaaccttagcttatcaaagaaaaaaaaatttctgaaatccaaagataaggagaaaatctttaaagcagtctgagaaaaaataatacattatacactagtaacaaggtttacatgaaggattagttccaggaccaccacctgctcccccaaaatccatgcatatgaaagtctcacagtagccctgcagaaaccagctatatgaaaagtagaccctcattatactgggttttgcaacctgagaatattgttattttcaatccacatttggttgaaagaaatccatgtataagtggacctgtacagttcaaacccatgttgttcaggggtcaactgtatatgaggtaacaatacaaatggctgttcaccattcattagaagcaatgggggctgatagaaaatggaacatcaatataaagcttaaaaaaccctataactttaaatttgacatcaagcaaaattgtatttctaaaacaaaggcaaaaaaagattattttagataaatagcacatacatatactaaaattggaacaatacagagaagattagcatagcccctgcgcaaggatgacatgcaaattcgtgaagtgttccatattaaaaaaaaaaaaaagaaaagaaaattcgccaccagcaggagtgcactacaagcatagtgaaagtccttgaactgaaagagaatgacaccaggtggaaactaagatctacagatcttcaggaagaaacaaaatacatgggtatgaagatggcaaatatgtgggcaaatgtaaaagacacatgtacacaggcaaatgtatttctcttactttctttaaaaaacattttgttatttaagacaatctgtaacaaagtataaagaatgaatacatgttctgacagcaactggataccttgctagtagaatacaaaatggtagagccactctggtaaacaatttgacagtttcttacaatgttaaacatataattaccatcttactcagcaaaactattcctgagtatttccccactggaaatgaaaacatgttcacatgaagacttgtaatttcactgttcagagcaactttattcacattagctgaaaactggaaacccaaatttccaacagtaatgtgaatggataaactgtggtatatctaaaaaatggaagaccgttcaataataaattaggaagaactaacctgatacatgcaacaatatgcatgaatctccaaaacattaggcaagagaaaaaagtcatatacccagccatgtgaataatcactgatgccagactccattgataggtaattctagaaaaggcaaactattgtgacagaaagtaaatcagtgtttgctaatggcctatggtaggaggaagggattgactgcacaggggtatgtgggaatttgggggtgatggaaatgttttgtattatgaatgtgatagttgctagaagactatatagttatcaaaactcactgaattggatacttaaaatggggtgaatttgactggatgtaatttatacctcaaagtgggctaaaaaatataaaagagagagagagtcccagccctgaaagagttcataatctagataggcgggtagataaggaaacaaacaattataaatctgtgaaatcaaagacatttcacagaatcaaacaaaacagtgtgggagtgaaaaaagtggcaattaaccaactgcctttgccttgcagagtcaaagagaattcactgagagatgatatttaaactggttctcaaaagataaaaccactaaggtgcaaaactacctggtatatataagaaagggtgaaaagctcagtgtgttaagaactttggataaacagtgtgcatggctaggaaaaaaaagcatttactaagttagagaatctggatttttctgtaagctctgagtcaaaacctttttttaaatacgttttctttaaaataaaataagtctggtaaacagtgtgggagatagatttttgtgtcaggaggctaattagagaaatgttaacattgattcaatggaaaagcaagatatgatagtttaacacaataggaagaaggagggaatggactgaaagatatttgaggtcaaattgagggaatctggtgacaaactgtggtaccaacttaataagaaagatcactgaagaacaagatgacaaagtttagaatgtatatatgactaaaacacaactgcaatagttaaaaatggcaaaattccaagtacaaatgaatgctttctccctttaaaataagttaaaacacacctatttaagatattttcagactgtgctaaaagatatacaagatataaaagataaacaagaatacctgaataaatgggaaacatatatcaacaactgatgtaaaaattaatgttttaaagataccaaaaatccttgacaattaggattctaaaatctgtacacaagaataaaggcagtcacttccaaaatggccaaataggaacagctctggtctgcagctcccagagagattgacgcaaaagatgggtgatatctgcatttcaaactgaggtacgtggttcatctcattgggactggttggacagtgggtacagcccatggagggcgagcagaagcagggcagggcattgcctcacccgggaagcacaagggatcggggatttccctttcctaggcaagggaagccatgacagactgtacctggaggaactgtacactaccacccaaatatgcgcttttcccacagtcttcacaactggcagaccatggaattcccttccgtgtctggctcagcaggtcccacacccacggagccttgttcactgctagcgcagcagtctaagatcggcctgtgagacggcagcctggtgggaggaggggcgtccaccattgctgaggcttgagtaggtaaacaaagcggcctggaagctcaaactgggtggacctcagtgcccctctgcaaggcctacagcctccacctctgtgggcagggcatagctgaacaaaaggcagcagaaacttctgcagacttaaatgtccctgtctgatagctctgaagaaggcagtggttctcccagcacagcgtttgaactctgagaacagacagactgccttctcaagtgggtccctgacccccatgtagccggactggcagacacctcccagtaggggccgacagacacctcatacaggtgggtgcccctctgggacaaagcttccagaggaaggatcaggcagcagtatttgctgttctgcaatatttgctgttctgcagcctctgctggtgatacccaggcgaatagggtctggagtgggcctccagcaaattccaacaaacatgcagctgaggggcctgttagaaggaaaactaactaacagaaaggaatagcatcaacatcaacaaaaaaggacatccacaccaaaaccccatctgtagctcaccaacatcaaagaccaaaggtagataaaaccacaaagatggggagaaaacagaatagaaaagctgaaaaatcaaaaaaccagagcacctctcctcttccaaagaattgcagctcctcgccagcaatggaacaaagctggatggagaatgagtttgatgagtggacagaagtaggcttcagaaggtcagtaacaacaaacttctccgagcttaaggaacatgttctaacccatcgcaaagaagctaaaaaccttgaaaaaggttacacaaatggataactagaataaacagtgtagagaacaccttaaatgacctgatggagctgaaaaccacagcacaagaacttcatgacgcatgcaaaagcttcaacagctgatttgatgaagtggaagaaaggatatcagtgactgaagatcaaattaatgaaataaagcgagaagacaagattagagaaaaaagggtgaaaagaaatgaataaagcctccaagaaatatgggactatgtgaaaagaccaaatctacgtttgattagtgtacctgaaagtgacgaggagaatggaaccaaattagaaaacactgtacaggatattatccagaagaacttccccaacctagcaaggcaggccaacattcaaattcaggaaatacagagaacaccacaaagatactccttgagaagagtaaacccaacccacataattgtcagattcaccaaggttgaaatgaaggaaaaaatgttaagggcagccagagagaaaggtcaggttacccacaaagggaagcccatcagactaacagctgatcactctgcagaaacactacaagccagaagagagtgggggccaatattcaacattcttaaagaaaagaattttcaacccagaatttcatatcaagccaaactaagcttcataagtgaaggagaaacaaaatcctttacagacaagcaaatgctgagagattttgtcaccaccaggcctgccttacaagagctcctgaaggaagcactaaacatggaaaggaataaccggtaccagccactgcaaaaacatgccaaatggtaaagaccatcaacactatgaagaaacagcataaattaatgggcaaaataaccagctaacattataacgacaggactaaattcacacataacaatattaaccttaaatgtaaatgggttaaatgccccaattaaaagacacagactggcaaattggataaagagtcaagacccatcagtgtgctgtattcagaagatgcatctcaagtgcagagacacactttgctcaaaataaaggatggaggaagatcaagcaaatggaaagcaaaaaaaagcaaggtttgcaatcctagtctctgataaaaaaaagaccttaaaccaacacggatcaaaagagacaaagaaggccattacataacagtaaacaaatcaattcaacaagaagagctaactatcctaaatatatatgcacccagtacaggagcacccagattcataaagcaagtacttagagacctacaaagaggtctcaaaataataagagctatttatgacaaacccacagccaatatcatactgaatgggcaaaaactggaagcattcccctggaaaatcagcacaagacaaggatgtcctctctcaccactcctattcaacatagtgttggaagttccagccaggacaatcagggaacagaatgaaataaagggtattcgataaggaaaagaggaagtcaaattgtccctgtttgcagatgacatgattgtatatttagaaaacgccatcatctcagcccaaaatctccttaagctgacaagcaactttagcaaagtctcaggatacaaaatcaatgtgcaaaaatcatgagcattcctatacaccaataacagacaaacagagagccaaatcatgagtgaactcccattcacaattgctacaaagagaataaaatacctaggaatccaacttacaagggatgtgaaggacctcttcaaggagaactataaaccactgctcaacaaaataaaagaagccacaaacaaatggaaaaacattccatgctcatggataggaagaatcagtattgtgaaaatggccatactgcccaaggtaatttatagattcagtgacatgccgatcaagctaccaatgactttcttcacagaattggaaaaaaagctactttaaagttcatatggaatcaaaaaagagcccgcatagccaaggcaatcctaagcaaaaagaacaaagctggaggtatcatgctacctgacttcaaactatactacaaggctacagtaaccaaaacagcatggtactggtaccaaaacagagatatagaccaatggaacagaacagaggcctcacaaataacaccacacatctacaaccatctgatccttgaaaaacctgacaaaaacaagcaatggggaaaggatcccctatttaataaatggtgctgggaaaactggctaagaagaaaacctaggcaataccattcaggacataggcatgggcaaagacttcatgactaaaacaccaaaagcaatggcaatagaagccaaaattgacaaatgggatctaattaaactaaagagcttctgcacagcaaaagaaactattgtcggagtgaagaggcaacctagagaatgggagaaaattttcgcaatctacccatctgacaaagggctaatatccagaatctacaaagaacttaaataaatttacaagaaaaaaacaaccccatcaaaaagtaagcaaaggatatgaacagacacttctcaaaaaaagacatgtatgcagccaacagacacatgaaaacatgctcatcattactggtcatcagagaaatgcaattcaaaaccacaatgagatatcatctcacgccagttagaatggcaatcattaaaaagtcaggaaacaacagatgctggagaggatgtggagaaacaggaatgcttttacactgttggtgggagtgtaaattagttcaaccattgcagaagacagtgtggcgattcctcaaggatctagaaccagaaataccatttgacccagagatcccattactgggtatatacccaaaggattataaatcatgctactataaagacacatgcacacgtatgtttattggtactattcataatagcaaagacttggaactaacccaaatgtccatcaatgatagactggattaagaaaatgtggcacatatacaccatggaatactatgcagccataaaagggtgagttcatgtcctttgcaaggtcatggatgaagctggaaaccatcattctgagcaaactatcacagggacagaaaaccaaacacgactcataggtgggagttgaacaatgagaacacatggacacacggtggggagcatcacacaccagggcctgttggggggtgggggactgggggagggatagtattaggagaaatacctaatgtaaatgacgagttgatgggtgcagcaaaccagcatggcacatgtatacctatgtaacaaacctgtactttgtgcacatgtaccctagaacttaaagtataaaaagaaaaaaaagaataaaggcataagaaacatcaagtttgaaaaagtagaacaaaaggtggaagattagtctcatatatgccttattagaagtcttcataattaaaataacatgatgctggcacaggattctatcactgacaccatatagaatccagaaacagactcctgtataatgaaatgtgtaagaaagacattccaaaacaggaggaagaaaatgactttttctgttcagcagtgttagaaaaattgtatacacagacaaaataaattccacataaattcaagactcgattgtaaagataataaaatacaagagtgaaaagaaaataaaaacatctttctgaccaagaggtaacaaatctttaaacaggaatcaaaacactaaagtgatgtattaaaaaagactgataaaatggaatacatcaaaatttaaaacctctgtaagccaaaagtcaatatagcatctctgcaaatagaatgtctgcaacctaaataataaagggttaatatgcaaaaactctggtataccaaaagaatgtcaaccccaatagaaaaggggcaaacaatttacatactcaattcacagaagagaagatacaaataagccaatagaaatacaagaaagatgttccaacccagtagtaagcagaaaaataaagaattaaaacaagataatcatcttttatgtatcagattggcaaaaaaataataaactattatttaggaagcatttactctcatacactgatgatacaatcactgcaaaaggcaatttgataatatctagtaaaattttgaaatactttaaacctatggctcagtaatagtgccacaggattcttcagctgtcgcttttccagctggaaacctctgtggccagtggcgccttttcccgagttttgctcggcccgctgggctccttccacccactcggcctggcaggctgcgctccgctcgtgctaagcctggatcccacgcatgccaagggcaagccaggtatggagtggcaaagggcaggcaactccgggcaccagcacaggcaccggctccctgcgaggctgcagctggaccaggcaaaccccgcaagtggcttccactagaggctccaggaaacacggtggcacttagaagcttggaggcaccaagaagtgcagagccccaaagagggtgtcacagccctggctcagggagccattaggtctgggatccctgaaggggcccagctcttctcttctccttgttgcctgcaatgtggcgagcaggatcaggaggtggcatgtttcagccttgtttgccttagggttctttcagtttcgccatttgggtgttcccgagtgcttctcccgtacagaagaagaatgaggtacctgggcaaatggagggtgagcaaggcaaggtgatttactgacagtacagctcgcagaagatcagaagtgggtagctcctatccacaggtaggtcatcccattgagcctgaggcccactgagactacagccctcagcagagaggacatccagagcgggtagctcctaacgcaggcaggttgtcccgtcctcccgagtctggttaaatccaaggtttttatgggctcaggagggaggaagtgtgtgctgattggcccatgggcagccatggttaggcccagaaaacgcaccttaggttctcactccaggccacagatttcacccagaacagacagcctggtccccaggcttcaggccatccctggctttaaggtggggcttcactgtggacccacctctttccgcccaggagcctgtctgcctcccgctatctatacatcatccactgtacccaggctgtttgtgccaagcggcacctacaggcctgcaccaagccaccctcagcacctctttggcctccctcccatgctcgtcagcgccaaaagtccagagggggccgaggtggcagggggctggtgtgtcagtgccactatgagtgagggcacacctggctgcgttgcaacagcacccaggatcggcctcgacttcactccaaaatcagagtggggagaggccaggcagcagtagcaggcacttccgagcctgcagaggtgggtgggggcttctcaggcccccgagagtgcagggatgcccaggtccacagctgtggctgtgtggctgcagctgtgtccaggaaggtggtgatcccaccctgccaactcggaagggggtggggctcccacctgttcctggctcctgtagcccggtggagtgtgcagccttggctgtgcctccccggctgcagccagtctttgcagcagctgctccagacgggccactgctgccaacaatagtatgtcatttaaacttcacaacttgtaaatgaggtattatttatctctttattgcaaattagtaaactaggactctaaaaggttaagtaatttgctcaagatctcaaagggaatcaaaatattagctttaaaaatggagtgacaggtgtgtgtgaggcaaatatcaaagttaattaggtaattacatcttaagaccttcttctaactgaataaatatcaaaattgttaccaattattctacatccaggactagaatgtccaaccagcagaaaagaattaattaatggaatggttctcaatttgaaggaaatctatcagaattacccagggagctttatcaaactatataaattcacatctctaaacattccatccgctttcacaaattgagggctacatatacttccacaaatgttaggacgaaaaaacattaaaatgctgctttacctggattatctccacccagccataacacaaagtgaagaaagcatacaatcggctgagaattttttatttttagataaaaaccagtgacataaaagtaataccctatctctttgcccttattatataaaaggggaaaaaagacaccaggatatagccttatgctaaaattttgtccaaaggggaggaaaaaagaaaaatgaaaaaggagtttccactttactaaaggaagtgatgttgattcatttgcacaacactctcatcccagtactataaatgttgctcccacagaactaaacatgtgcacaactagtaccctctaaagaaactctgtgggaagcaagaacatgtgtttttaatgacttataaacattcacaagaaacaagtttcatttaataacattcattgtagtttctgtatcacaaatagaggtccctgcaaagagaactgattttcttaataatttatgcttactcagaatctctaaaagattttcatgtttccaaactgttctgcatatctacgtttaacattcatgggctaatgaagagtatctttcattgttcttgccctttccttctccattctccttttcataaattgtactcttaccaagacaaaacctgtactaaaaatgtgtattaacatcatgaaaaaataatggaattaacacatgtcaaagtgagtattaccaaacaaggtaattctacatagagactatatgcactgtagcagaaaaacctctcagaaaagacttagatttttctcaaaatatagacattcattaccagtttacaagtaatttcacatgaccagtaaaatgaaaaccatacagctgccttgtatatggaaggaattcaaatatttctaatctaattttgatttgaagcatataacaaagtggctaaatgcacaggtctcaggtcagactgacctccattgaacttccagcttcatcacttaacagttaccctaaagcacttaaaaacgtgccaatgtccccaagaaatcatctaatcctttaatttaaactgggtttcccacagcactaactttgaagataatttaggtctttttactaacagaagacaacaagctaaaaataatagattaaaaatatttcctataacaaaaatttagagatgggaaaaaccctagggatcttttagtgatcagaagatccactctacaattttaagaaataaagaaacaaaggctttgagaggttatgacttttccgaggtcagataattaataaacaaaaagaggattttagaatttaggcctcccccatacttcaccatatcatgggaatgactgaaaccaaaaaaaaaaaactgtaagaggtcaaggttcaaaaaagagacagcaggttctcggtaatttaattccatctcaattataattttttaactcgatttgtccttgttcctcaactgcctcctcctacaacccatccctacatacctacacccattaatgaaataagaggaatatgatcaaaagagctaacttttcactggaatctctatcattgtcccactgatgcctaaattacttaagagcaaatggtcagcaatcttagaaagcgacaaggtccaaggccacaaatacagctgactaacccggcatttttcagaagagtgatgtaatgcagcaatgaagaacatggactctggagccagactggagtggaatgactggccatatgatttaggctagttactaaccatgccccatgccccatccacgcggtgcctcagtttctctatccttaaaaaaagagaataacttatcttcattgaagttgtgtgaagattaaacatattccaaaagaagcacttagcatagtttcttcttaggcatattgcaattgtttgacaaatgttagagctcttaggttgatgatgctgatatgcaagcccctttccaagccagtacattctgctgtcttctaacacacacaaattgaactctattctttctggttacaaaacatgaatattttcccttaagatcactatgctattctttttattcccctaaatgacagtattaagttgtgttttaggaagaaaggaaatcaaacactacattaatttgcttatttttaaataataattacagaagcactggaagtgtttacttagcaaatgaacatttaagccaaatagattgtgtctcaacatatttatttttgccttgaaagagagtagtttttatttttaaatttctctaaatataagctgaaattctacatatacaaaagacataccttaataattttaggacaagtgtgatgccggcctatgaaaatgtcagaacggtctcattttaaataattgctcatatgatttattcatccacaatgtatctatatcaatataactattctgatttcgattgttttaaatctttcattttttaaaactataaaatcactgcacaggtaaacagttattgcagcacaacagacaatagttttcatttatttaaaggccaaacaaaagaaatcttcattgctctgcaagttgaaatagcatctaggcctaaattagctcctcgtgacattagttctcctgacataaggtccttaggcatcagtggcagttctgaagaggcacaaacatctgtttggtgagtatctgaagctgtacattatagaaggtggttaatttaaccacgagaaaaattacacatgccctagcatttcaatcttcttaaaaagctctaaacttggttatttcataaccaaagctattattcacactggccaaggtattttctagtaacaatttaggtgtcctgggagtcttattaactctttcaggccattagggtaccaataagagcattagggcatgaaacctaattacagggcataaaatggtcttagtgctctgtttttttgttttgttttgttttgttttgttttatgtatactttaagttttagggtacatatgcacaatgtgcaggttggttacatatgtatacatgtgccatgttggtgtgctgcgcccattaactcgtcatttaacgttaggtatatctcctaatgctattcctccccgctccccccaccccacaacaggccccggtgtgtgatgttccccatcctgtgtccatgtattctcactgttcaactcccacctatgagtgagaacatgtggtgtttggctttttgttaatgagcctgctgaagtgaccaattttgtatcaaggaatacaacgagtttcatttcaaatgttatttggacattttttagacttttacagtggctactccatttttagaaggtgaaactagaagacttaaaacagtaatgttaaaattacagaactataacaagaaaaactttttttactaattgaaaaatgttatctgatgcaatggctagtttaagttcagtcatcataggtaaaaactgtaagtattaaaacagggatatatagtctaccaaagtctgtacatatgttaattaggatcaaaaaagttatttcattttatttatatcaaaaaaaataaaagttattgtatttgttcacaaattaaaacaaccccaaaatgtctttgaagaatcacaacttaaacgtgtctatatgaatagagtaaaaagaaaatacacatacataaggacatactatgaactaaaacgagcttcattttcaaaaaagaaaaactctgacaaaccatgccaaataacagcttctttttctttctttttttttttcgtttgtttgttttttgttttttgggatggagtctcgctcttgttgcctaggctggagtgcaatggcgtgttcttggctcaccacaacctccgcctcctgggttcaagtgattctcttgcctcagcctcccatatagctgggattacaggcatgtgccaccacacccagctaattttgtatttttagaagagatggggtttctctacgtgggtcaggctggtcttgaacttctgacctcaggtgatctgcctgccttggcctctttttctaaagatagtagaaactaataggatggatataatttttattatttatttatttatagaaacgaagtcacactacgttgctcaggctggtctcacctcctgcactcaagtgaccttcctgtctcagcttcccaaagtgttgggttactggtgcgagcaaccatgccggccaaggatttactttttaaatgcctaataacaataaaaacgtataggaaatttaaaaaatctctatatactcctatattacacacatacccagaaaactacacaattaaaaagaaaattcctgatagctgccctctcctaagtgtttttaaatttctctcgtttatctgactgacaaatatgccaagaagtatagatgacaaatgtttaaacggtcataaaatataaaatcacttattcctttgtaatagaaatttcaatttatacacagcaatttatatttaaagttactgcattagatatttttggaaaatggacaccagccaacaatgaaaagggaaaactaaagagggaatggtagaatttaagtaagtagaactaaccaagcattgaaaagaaacccgcaggtgatagctatgcaggaggttcagagaacagtctgttcaaagatgatcacttaataaatagtatgataaactaaatgaatatttacataacaatactgtaaatgctacttagtttttaattttcagattcaaccatgaagcaaaataggaaaaacaattatacttaacataatttaaacattataaattttgatactgtagaattgatagtgtagctgagagaagttaggttgtaagggacagaaaaggataaaaatgtagaaaccaaatgctctaagttctacactgggcagttaagagttattgttcaaagtcaatgaagcaataaatccagctccaaatatacaacttagagttattagggtaatagtagaaatatggtaacacagttgataaatgtttaagaatttaagttccttgtcttccaaagtaataatttgagtcaacagggaaaatgcataaattaagaaatataagcacatcatttacagaaggaagcaaccattcaaaagaacaaaaaacatctgtgataagatctgagaagatgaggtgggaggtaggaagaaaaactttactttcattttatgtactttttttatacttctgagtttttatttccatgtataaaattaattttataatttttaaaatgccatctaaaatcctgtgtttgtgattttagatggtaaatatgaaagacataaataccaaaacattttaaaagttgcttgatttaggattaaacactgttgactaaaaataatttttcaaaaataaaaaacatttatactacaatctcttcttcctttcaatttgtgcctacatcaatttttttcctcggtctctgtaaagtaaagaagaaaattcaacaaaggtatgcagaatatattaacgataatgtgtaggtaaaaggaatgagaaaaaaatgtgtgattcttaaaactaccaaacttgctgggcatggtggctcaaacctgtaatcccagtactttgggaggctgaggcgggtagatccctttaggccaggagtccaagaccagcctggttaacacggtgaaaccccatctcttctaaaatacaaaaaattagccaggtgtggtggcgcgcgcctgtactcccaactagtcaggaggctgaggcacaagaatcactcaaacctaggaggcggtggttgcagtgagctgagattgtgccactgcactccatcatggaaggcagagagagactgcctcaaaaaaaaactaccaaacttattttataaaatctagatataggagaagagtactttaagtactaactaatgagaacaatatacaaatatccttaaaataaacaattttcattttccccatacactttactcattcttttaggagttcaaaaacatattatgaataagaattgttgtatttttcatgatgaaaataatacatgtattcacttttaatacaatgataaatgtattggtgttctaaaacaataacatcttgttttaactactcaagttcaataatttcttctcaacccaaatcagcaactggctttagtgtttctgcatatctcttcataaaagcaaatatgaaaggaatttagaaaggtgtccaaagtgcaaagtcatctccattctgagtacgcaacagaaataaaatgaatagagttaaaactttttattctaacacttacgaaactcaaggagtcatgctaggcttatgtgatctagtttcaatacctctagttacaaatatataaattactagaatcaaggatgaattgcttggtataatattatagatgggctatatattgctcaatacagtactgagcaattcacacattagaatcagacagaaatgagttcaaactgtgtactatttacatgtttgcaaaggtgggcaagtcacttacattctctgaccatcttctaagttaagaacaatatctactataacaggcaccagcgcttgttatatgctagagagtttaaaatgttaaatcacatctccaacagtactgaactactactctctaaataatattttcattttcattcaggtgctcagctttttcagtttaaaggggcatcccttagcacagtttcatgactttagtgtagcagatcacaaatgaattaggtggatgatttgtttcggctgcctgtgggactattaccttatcaattctcatttgaggagcagttaagatgctaaaaaatgtttttaactaaataaaatttatttactgttctcatatatatgtatatgaaaagtataaaaatagaaaaaatcagggtaaaataatgagataaggaatatatatggtttatagacttgagctcatattttaattgtagttttcacattttacttttgatcctgaggttacatgcacttcacgctatcagacctctccctttctcagttatatacaagaatgacaaaaaagaaatctcttcctgtttcaagtgcaaaaaaaggtacataaactaagattaatacattgttaatgaggttcagtcatcttagaaatggtaatatcttccagtttagaatcgaggtttacaagtaaagaggatcctgagcaagaataaaacaggaaagaaaaatagaggaaaaattggtcaaagaataataatagttgtcatatattcaacactggtatgtgaaagccagatgctttaaataaatcgtttcttatattgccaacaactttacaagtaggtataatcatctccctttagagatgagcaactgaaattcaggaatgatctacccaaagtcactcagccaggaagtagcacagccagaacttaaactgaagtctgtctgactccaaacaaaattaaatcatgccaagctatttccagaacttaaaatttctaggacatcaaaatttcgttagagggcagttacttttcccttcatttgtacaagaagagacaaaaactaggtgcagaaatagcttttgtcatcgatgaacactccttccttagtttcttcttgttagtcatatgaacaaaagagatttcagggtaaaaatgccagtatcgtatgcttttattcctagtcaaaggatgctttcaaaacagttcccaacagcagttggaccatcaaaatcatggaagtaaggaaagaagaaaggagggaaggaaggagtgaaaggaagaggaagaaagtgaaagagaggtgacaggagagggaagaaaaagggaatagagggaaaccagtagaatgtactttcttcatttaaaatataatttgtctatctacatcttttcctctctcttttttaaaaagtacatttaactcccctatgtgaacttcttttaagttctcagaattccaatgacacactaatttgctttcactttctggaaagtaacagtcttaccatgaaactttgaggcttcaggatcattcgcattgatagcaattaatttccaatctgtttcaccttcatcaataagagccaaaattccaaggatcttcacatgaataacttctccacaagaaagaatctttaaagaaaaaagaaattcactatttgcaaggctttggagagtttactcacatatcacaaaatccatataaaagattaaaagaactacagactgaaatgtaacaaagcctcaataattaaaaataatatgaaaatagccaaagtctgccttgcaatgtccctttagagttaactttctcaaaatttccactttcaccaatgactgaattattttacagataaacaacttgccctcccattgcaaacaactaaaaaactggacaaaatatatgaaatcactcgtttcagacattaaacaacaggcagtacaggactgtgatcccagagagaagtaaacaaatgagaagagatgtgattgccctggttttctgctcaatacacattccaaaccacagcagagagaaaggaacccagtaagaggacagggatctcactgaggttaaaaaaaaatggaggatgaggcagctggaatttgtagggcatggtactagaaataagaaataactacagcaatatacataggggttcctttgagacacggattaaacactaacctgtgcattcatgggatgagactttataagtcaaggcaaagaataatggccagagacctataaaatgagttccaaccacccaggaaaacctcatttaccacaaggggcattcattagtgagcctataataggcatgcattaatggtaggactaaactggctctcaaacaaaggttactctagacctgtcctaacaaagttttaaaagtgcctggatacaactaaactgactcacaagtaactacctgtaaaaacaaatattctttaaaggaagacaacaacatccaggcactcgacataacacaacatccaagatcctgtcaatatgcaagaaaatgtaaaccctaaatggggaaaaaattaaaaatcattcaacagaaacatttccagaaatgttagatgatggaattaacagataggaacctcaaaacaactactgtaaatatgctcaaagatttaaagaaaaacatgacaatatggaagagagaaatagaaaacaaaaaaaaccaaatagaactttaagagctaagacatatataatctgaaaagaaaaattctctcaatgagcttaacaacaaaatagacattgccaaagagaaaattagtgaacctgaagacactgtaacagaaactttccaaagtgaagcacagaaacaaaaaggttaagaaaaaattaacaatcccagtgtcctctgggacaacattcagcattctatctcatgtataaatggaattccagaatgggaaagaggaggccaaaaaatatttgaataaataacgtccaaaaaatttccaaatttgatgaaaagtataaaccccacagattgagaaaggacacatgcacatacacacacacacacacacacacacacacacacacacacacccatcagaataaacaaacaaacaaaatccaaagtgaagcacatcataatcaaagtgctgaaaaccagtgatagtgacagagagtaaatcttaaaagcagatagaggggaaaaaaagattacataagggtacgatgataagaatgacagctgatttctctttagaagcaatgtaagccaaaagacaaagaaatgaaatctttaaaattcttaaaaacgctaccaacctagaatgccgggagtcataaagactttgcaaaggggaaagggggaactttctgggatgatggaaatgcttcatattttaattgaaggaggaggttatgtgtgtgtatacatatgtcaaaactcaccatatacttaaaatgagtatattctattgtaatatatgttttatatatatacataatgacttaaagtttattttaatagttaaaaaaataggaggttgcctccaagatggccgaataggaacagctcccgtctacagttcccagtgagatcgatgcagaagacaggtgatttctgtatttcaaactgaggtacctggttcatctcattgggactggttggacagtgggtgcagccctcggagagcaagccaaagaagggcaggatgttgcctcacccaggaagcgccaggggtcaggggatttcccttttctagccaagggaagccatgagtgactgtacctggaggaatggtgcacacctgcccaaaataccatgcttttcccatggtcttcacaactgacagaccaggagatcccctcccgtgcctggctcggcgggtcccatgcccacagagccttgctcactgctagcgcagcagtctgagatcaacctgggatgtgggagcttggtagggggagaggtgtcagccattactgagacttgaataggcagttctatgcttacagtgtaaacaaagccgcagggaagtgtgaactgggcggagcccaccacagctcagcaggcctactccctctctagattctacctctggggcagagcacatctgaacaaaagggagcagacagcttctccagacttaaatgtccctgcctgacagctctgaagagagcagtagttcttccagcatggcatttgagctccgataatagacaagactgcctcctcaagtgggtccctgactcccatgtagcctgactgcgagacacctcccagtagaggccgacagacacctcatatagataggtgccccctctgggacgaagtttcaggcagcaatatttgctgttccgcagcctctgctggtgatacccaggcaaacagggtctggagtggacctccagcaaactccaacagacctgcagctgagggacctgtctgttagaaggaaaactaacaaacagaaaggaatagcaccaacatcaacaaaaaggacatccatgccaaaaccccatccataggtcaccaacatcaaagaccaaaggtagataaaaccacaaaatggggagaaaccagagcagaaaggctgaaaattccaaaaaccagaatgcctcttctcctcaaaggattgcagctcctcaccagcaacagaacaaaactgcatgaagaatgactttgatgagttgacaaaagtaggcttcagaaggtcgataataacaaacttctccgagctagaggagcacgttctaaccctttgcaaggaagctaaaaactttgaaaaaaagttagacgaatggctaactagaatcaacagtgtagagaagagcttaaatgacctgatggagctgaaaaccacagcacgagaacttcgtgaagcatacaaaagcttcaacagccaattcaatcaagcacaagacaggatatcagtgactgaagatcaaattaatgaaataaagcgagaagacaagattagagaaaaagagtgaaaagaaaggaacaaagcctccaagaaatataggactatgtgaaaagaccaaaactacgtttgattggtgtacctgaaagtgatggggagaatggaaccaagtgagaaatcactctttaggaaattatccaggagaacttccccaacctagcaaggcaggccaacattcaaattcaggaaatacagagaacgccacaaagatactcctcgagaagagcaaccccaacatacataattgtcagattcaccaaggttgaaatgagggaaaaaatgttaagggcagccagagagaaaggtcaggttacctacaaagggaagcccatcagactaacagcagatctcttggcagaaaccctacaagccagaagagagtgggtgccaatattcaacattcttaaagaaaagaattttcaacccagaatgtcatatccaggcaaactaagtttcctaagtgaaggagagataaaatcctttatagacaagcaaatgctgagagattttgtcaccacgacgcctgctttacaagagctcctgaaggaagcaagaaacgtggaaaggaacaaccggtaccaaccactgcaaagacacgccaaattgtaaagatgatcgatgctatgaagaaacttcatcaattaatgcgcaaaataaccagctagcatcctaatgacaggatcaaattcatacataacaatattaatcttaactgtaaatgggctaaatgccccaattaaaagacacagagtggcaaattggataaagagtcaagacccatcagtgtgctgtattcagaagacccatctcacgtgcagagacacagataggcttaaaataaagggatagaggaagatctaccaagcaaatggaaagcaaaaaaaaaaaagcaggggtttcaatcctggtctctgataaaacagactttaaccagaactcatgttctccctcataagtgggagttgaacagtgagaacacatggacacagggaggggaacatcatacaccgaggcctgttgggggtggggggctaggggagggatagcattaggagaaatacctaatgtaggtgactggttgatgagtgcagcaaaccaccatggcacatatatacctacgtaacaaaactgcacgttttgcacatgtaacccagaacttaagtataataaaaaataaataaataaactgaaaaaaactcaattgaaatggaagaaaccatgaacaacaggcaattcacagaagaaatgaaaacagcctttaggggtataaaaagatgttcaagctcattcataatataaataccttgtggtttaaattaatatccctgcttagtgtttgcagaattctcacacaataggtagttgcctgtcatcttgaccttctcctccatattttgctttctctattctggagggaatttctctggctgctctaaatctacaaaggggatcatttttcttcttccatctagaggaatcagaagttgaagcaaaacctttaatttcattctactgccaaaacaagccccaaaattatggacataagagagcataggcaagtttggctagaagtgcattattttattaccaagaaaatttgcagataaatgagaatcaaagatgaccaagaggcagaatacaagaaacgagtagatgagagtaactaacaaagatggcgtatcttacagtggcaacactactcctgtcactggcagctatcatcaatgagtctgagattttcagcacgaatataacttattcccttatgcctacctgcaaagtttcatataatggtcaatattccaaaattaaaaagttaagaaaaaagtcattttaaggtctaaggacaattttttaattaacaaatcaaaatctcatcacattatgtaagtaaaagcaatccatatatttaaaaaattaggcaccaagaaagtggacctgtttacagtttcaacctattgcaatttgtgctgaaactgaagttatttacatatcttgaaatttaaggtatctactaggcctagacactcacactaaatagaaaataaacctgtatgtaccattacataatataaacttgattcctgctgcttgaggggaaaagagacctgagaatccttttacattgcttcatagtacctttttaacaaaccacatttatcggttactagtgaaaagtaaaacataatagagtaaagccttaagaaaataataaatgatattgacaaaacaggtttcataaaatatttcaaaaatattttaagagaaacccagaaatagcgtgacttaagcagatgttccatgtgcttaagaaagttatttcagtgaggttccctcaagctgccaacgtcaagtttatatgcatgcattctttgtatatatccttttacttttaaaggtttagttggctatagattttcactgtaaacctggaatttgaacacatgcttcagaataaatttctcagaattcaaaatgcagttttacatttagaaaacaaggtatgtagaaaaaagtcacttctgtgtcctgaaattatttattttgagggaaaaaatactagaatttcaagtcataaagtcaaataaatcctgtcagaatatttggaagttgattctaaaatcttaacataaatctgcatggaattgtaattagttaacacaactgactaaagtgattgtataaactaaactgaaatctgaattccaagggaatatacacaattatattagacactcacatgtttagcctctattaagtactcggctctatattaggcactgtgtattaaagaaagaatgaattgttctcaaggatttacaatcttatttgggtgacttagacaccccagggccgaacagcatataagaccgaacacatgtgagtttaaacatgtaatatcaacactacgtgcatcatttctcatagctgtgccttcttcatttccaatgccactgccctgatctaggcaacagagtgtcaaggtaggttctctaatatgataaaaggacaagatagaggctaacaaatcagaagactataacactatagatatgaggtaatttggatctagattagggacatgacagtggatagtctagataagggtagtgaaatatttataaggaaaaacaaatagtgtacaaggagaaaagaaaatgatttaccaaacagacactgtgtgatgggcactacagtatgtcttctatgggtatcattttattcttcacttacaaaaactagtgtacagtgtagatattatccctgtcttggaaacaaagatactgggattcacaacggttaaataatttttgcctgagatcacagaactagtgaatggaagacctgggattcataccccaaactgagccaaagcttcttctcctgccaaactgtactaagaaagcagatcagtccttgcctgaggacagagggttgggagtgtcaaaggaagagattacaaagaagtgtaagaaaacatttgggggtgataaatatgttcattttcttatttttgataataattttgcatgtaattatatcaaaaatcatcaatttgtgtacactttaaataggtacagtttattatatgtcaattataactcaacaaagctagaaaaaaatctacttcacatttatggctaaaactatttttttaaatgcattattttattggataaaataattatccacatttgtttaagataaaatcagacgtaagcttgttttaattaaaaaaatcacaataccatttcacaaccactaggatgattgttaaaaaacaaaaagggaaaataatgagtattggtgaggatctggagaaactggaatccttgaatattgttcgttggagttaacatgctggggaaaacagtttggtggttcctcaaagagtaaattcagaattaccatatgacccagcaattccattcctaggtgaaaaaaatggataagagtattcaaacaaaaactcatacatgaatgttcatagcagcactattcataatagccaagtggtagaaacaagccaaatgcccatcaactaatgaatggataagtaaaaggtaatattatccatcagcagaatattattcagccataaaaaggaatgaagtactgatacatgctacaacatggatgaatctcaaaagcacactaagtgaaaggggccagacacaaaaggttacatatcatgtgagaccatttacatgaaatatccagaataggtaaacctatagtatagagacagtaaattagtggttgccaggggccagttagagaatgaaatggggagtgactgctaatggggatggggtttccttttgaggtcatgaaatgtttgggactagatagatacaggtgatggttgtacaacactgtgaatgtattaactgccactaattttaatgtacactttaaaatggttaattttatgtgaattgtacctcaatttaaaaaattaatcacaaattatttttgatgatggtggaggttgttatatacatgtcaaaatgaaccataataaaacagctcctatcccttaagtcctctctcctgaaactatgttatcattaagtgaatggttcgcttctttccaatacctaccttcaagtttattctataatgaacaaaatacttacgtttttgtgtttaactacaaaattgatcagataatttcttaaaaacgtcaatcaaaaaaatacaaacatttatcaaattaaagcaaaagaacaaactttatgcagaaaaacttgttgcaatgcagctgatttaaatcaagactttaatcaaacatatcttaataaagtaaatctcaaaaattagaattctgtcattttgaataataaaagttgaaatcatatggctataacctgcaaattctaaagaatataaataggatggatataaatatgtggatcaattctcacaagtattagcagtagaggcagaaggggatagggcaagcttgtccaacccacgcggcctacgggcagcatgcagcccaggatggctttcaatgtggcccaacacagattcataaactttcgtaaaatattatgagattttatttatttattttttagctcatcagttattgttagtgttagtgtattttatgtgtggcccaagacaattatttttccaatgtggcccagggaagccaaaagattggacacccctggtgtaaagactaggaacacaggctccagtacaagatacctgggattcaatcccaattctgccaacttactagcaatgtaagtttggggaaattacttaacttccttggaatataattttatgtaaaatttgaaaataaaaatacctgtttcacagcatagcagttttaagaataaatgagataattcttatagagcacctcaaataatggtttatagactagtactttactataagcatcagtattaaggtttgggttcctaaaggaaatcattcatttttccccttaccattctcagtaaacaaaaaggctaggagaagttttttttgaaaagtatacacctcatgaagaatatcctaaaggatcaaagacaaggaatcagattttctgagggacactttatatgttatttcctacagtgatctaattctataaaagggcatgtaaccattgtttacagcattcttaaaaaaacaccaaacctctgatttcttaacctgcttttctatttcttaatagaaagagaagtttcatcttccttagtctccaaattacaggtaaacaactaagctgcttccactccaaaattagactcccatttgaaaaattacagaaacgatggctctggagatggaaaatgggagatgagcagatttatatgggctcctctgaactgatattggtgccaactcacagaagccactgtgtgtttagctcagctgctctttgtgcatgcctccaggggttaatagctaaagctacatctgtgaaggaaatataatgacaacactgtccacgggaagagacattataaacaaagaatttccctctacagttgaggtctcaattgtctgaaatactgtctgttcctttcccattccctgccctccggcatgcttcttaccagctgcaatcacaaagtatttctgatacatgtcctcaagtttggactctggttgcttaaattctagattctcaagcccaaaaggaacatatgacaagtgattataaagatatggatgatatttgcagctctgaatatacatcaaaactaaagtactccatagaaaaattttacaactgcatatgtaattgctaacttatacaggctggatcatatttagagaagggcgtttagctgtggtagtatggtattctatttatttattattatttttttgagactcagtcttaccatgttgcccaggctggtcttgaactcttgggttcaggagatcctcttagctcgcctcccaaagtgctgggattacaggcatgagccactgcacccagactgctccattctaacatgggcattaacagagatgatctagtgaaaaggaaccagagtggaaaataatctagaaactgtcagataaggaacaactagaataaaaagccttgagaacagaagtcttcaggagggtatggcacattggaccaaaagatgtgtaagatcctttataaaacaaaaatgttcaaatttgaagttatcacataattgccagtttaaagttggctatactggttaattcacactggatacactaaatgagagtttctcaaccaaaggcaattttgccctctaggggatatttggcaatatcctaagacattttgggttgccacaactggggaggaggtattactagcatctagtaggaaaaggcaaaggatgctgcagaagacagtcctctctcataaagaattatccatctgtaatatcaatagtgtcaaagttaagaaatcctgtagatgactctggcagcagggtataagaattcctggaaatcacatatagcttttaaaaagcacattctaaattgttttatctatttttattcacaaaatttattttaaaatttcaaacaacataagaacagataagacatgtataggttataaagcaagcaaggaagcatgcccagattaccaagttgcctcagaatgagacacactctttgacttcacatgcaacagaaaggcacagttttatttcaaacaaagcagtgttttgctgtaacaccgttaaaaactggaaaggaaaactcaatcaaaccaaaaactagatgcttaggaataaatggtagaattcttacaaaaccaccacgcttcaattcaatctaaatcaattcaacaaatctgtgctgaaagtataacatttagttttcttagacaccaaatgaacaatacaaaatccctcaagggacttagaacattcaagttttctatatctgtggttctaagtctgttaccaacttccaggactctgcttctttccctctgcccattaacaatgcggtgttaaaagtgacttcctaccactatgtttcttacagctgattcaaccactcatctcatagccaggcatgaaagaaaggagcatacccctaaccgagaactattttttagatggtagtcatatatttatttcatatttagtaagtattatttcaggtcttattaattaaaggaataaacttctctggctataagatgcaaggatgatatgtgaattcatgaattgttccatgtttttcacccagatacaagaaattcagagaacacttgagagatgctatgcaagatgaatatcaccaaggcacacagtcatcaaggtctatcctaaatatacatgcacgcaacatcagagcacccggattcataaaaaaactactactaaacctaagaacctgagaaatacactagtgggaggcttcaacactccactggtgttcttgtgtcctttaaaagcacattaaaaagataattcatcatgatcaagtagggtttattccaggaatgcaaggatggttgaacatatgcaaatcaataaatgggattcaccacataaagaaaactaagaataaaaaccacatgatcatctcaatagatacagaaaaagcacgtgataaaattcaacattccttcatgataaaaaccttcaacgaactaggcactgaaggaacatacctcaaaatagtaagagccatctatgacaaacccataaccaacatcataccaaatgtgaaaaagttgaaagcattccccctaagaaccagaataagacaaggatgtccagtctcaccactcccattcaacatagtactggaagtcctagccagaccaatcacccaagagaaggaaataaaaggtatctaaattggaaaagaggaagtcaaatgatctctgttcactaatgacatgatagtgtagctaggaaaccctaaaggctcctccaaaagactcctagacttgttaaacaacttcgataaagtttaaggatacaaaatctatatataaaaattaatagtatttctacataccaataatgttcaagttgagaacaaaattaaaaaatctcatttgcaacagccacacacacacacgcatcatacacacacacacacaccccgcaggaatacatttaatcaagtgggtaaaacatctctgcaagaactacaaaacactgatgaaaggaatcatagatgacacagagggaaaaacatcccatgctcatggattggaagaatcaatattgttaaaatgccaatattgctcaaagcaatctggagattcagtgtaattcctatcaaattaccaatgtcattttttcacagcattaggaaaaaacaatcctaatgtttatatggaaccaaacaaaagccagaatagtcaaagcaatcctaagcaaaaagaacaaatctggaggcatcacattactcagcaacaaattataccacatagctgtagtactggtataaaaataaacatggtactggtacaaaaataaacacatagatcaatggaacaaaacacagaacaaacaaatgaagtcacatacctataaccaactgatcttcaacaaataacaaaaaaataatggggaaaggagactctattcaataaatggtactgggaaaactggctagccataggctgaagaatgaaactggacccctatctctcaccacatacaaaaattaactcaagatggattaaagacctaaatgttaagatctgaaactataaaaattcctgaagaaaatctaggaaaaactctctggatatcgcctaggcaaagaatttatgatgaagaccccaaaagcaaatggaatgaaaacaaaaatagacaaatttaacttaattaaactaaaaaccttctgcatagcaaaagaaataatcaacaaaataaacagcctacagaatgggagaaaaaatctgcaaagtatgcctccaacaaaggactaagacaactcaaacaactcaacaagaaaaacattaaaaagtgcgcaaaggccacgaaccaacatttctcaaaaaaagaaatataagtggccaagaaacacatgaaaaatgctctacatcactaatcatcagagaaatacaaatttaaaccacattgaaagtttttatgtgctggtttctgagctctacaaaattaaaggtaagatgttcttctaggagtgagaaaaaagggagaagagttgaatgtctgcagagaacaagaaatagtaacaataaacgtagtagaaaatagaagaaagaactgaccaaagacatatagaagaattgatggggagcatcaatctctgaaattgtggattttgtttttattcagtaggatgtggcaacctggaagcaggcacacaaaaaatgaaaaagtatcagatgactttcatgagaattgaagtttttatctaaataataggcaaggaaggtgaagacaggacttggcaaatttttccataaagggtcagatggtagacataaaataataaaataataataaaaggctttgtagactatacaatctctgctacaagtcctcaactctaccgtcgtagtgtaaaagcagtcatagacagtatgtacatgaatgggcatacctgcgttatttataaaaacaggtgttaggctggctttgacttgttacagggctataatttaccaacccctggtttaagacaagaaagtgaagataaaaggagggactgataacagagaaatcaataggcttgaactctgaagagttgaagaactagaggctaaaatgaaattttatggcatgaataaaccaaaactcacgttagaattaatacagtctataaaacaaacctttgagcctatttcgcaaacatcaataggatcattatctccaaagcagttcgtgctcttatctttttcatggggatcttcccaagtctaaaattttttttttaaaaaaaagcagaaatgtaagttaatactataatgtactttaatctttccacataatcacaaagttttatagataacaataatccaaagaaaacattatcagaaattacataggcccaaggccaacaggccagtatgtccctaaggatcataatatttaaaacagatttatagtatttcctccatctctcagttgctggtataattgcatctgcaagtgggtggtatatgcagacatactcatcttccaagttcagtcagggaataaattcacattcacttttagagtttcagtggatgttcccactgtctgtgcccttgtttctgtgtttccgctgactgcctcaactgtggcttccgtcattcaccgcttcctttgacccggtaacagcacatggatctaaattactaaaaggaatccagttttccctttataaatgaaaggacaaaacactactaaagaaaataaaaacctattttgtcttattcattccattaaaaaatcctctacctgtcaaatctcaaggaccttgataaaaacatgaaaagacatcaattctttagtttactggcaagattataccctgttggttacaaaatatacacataggaatttttataaatgaagactgtaatagaaatttgctagtaagattaaagatcccttaggcactatctctcccaaaaagcctcagaattgcctgattctaaatggaactgtagaagttccctaaaattatttgctttaaattcaaactaaaagggatacagagaccgtcatcccaagaatcagattatcattattatctaagatttcaggttatctaagcttatttcctttaattttatatagataattacaaacaaacttatttacagctaagcattagagaaattccaatattttccttctagtactaattagtttattcagaaataacctggcctaactttatcttaaaaaaaaaaatcaataaatgaagtccaacaacatttcactgccccaaatactaatactactaagaaaatataagaataaccacaattgttaatcttacatactggtcataggtgacaaacactttctagctaatatatacacacacaacatacacatatatacatacataccacatgaataatataccataacgaattccattttatagataagtaaattgaaacacagagtttaaacttgcacaaactcatggtttctatatggtaaagattgtattagaactcatgctactaatcattttttatgtgcaaattatgataacaattgaatggcatttattttcaaatataaccccatctacttcacggttctcttctttcaaataccttctcttactctgagcaatctcctaagtaactttcctagagaggttctgttctttcccagtcttcccgttactgcttctttttttctattaacaggcattcattcatacagtaaaacatttattgagtacctactttgggccagtaacagagatttataggaaacagtcaataccatggagagtgtcatgttaataaatggtatggcatttgtgacaaatgcaataaaggtaataagaattattattattataataaatggcatggcatttgtgacaaatgcaataaaggtaattattatgatacttttaagttttagggtacatgtgcataacgtgcaggtttgttacatatgtatacatgtgtcatgttgctgtgctgcacccattaactcgtcatttagcattaggtatatctcctaatgctatccctcccccctccccccacccgacaacagtccccagtgtgtgatgctccccttcctgtgtgcgtgttgtcactgttcaattcctacctatgagtgagaacatgtggtgtttggttttttgtccttgagatagtttgctgagaatgataatcttaacgtgctggggaaaccaggatgggacacccaggtataatcagaatcaaacaacctactgcagaatcagaaaatatctgagaggttcctccttgctaatgcagaaatcccatctcataattttgcttatccctactcccactcccaagagaacaaatgcgacaagctagaagtcccattggcctaaaggaaaacatctagattctaccacaaactatcttgattaaactatccagatctgtttcttcagctattaagaaaggcttaaataggaagatctttttttctttcttttttttttcagacagagtctccctctgtctaccaggctggagtgcagtggcacgatcttggctcactgcaagctccgcctcctgggttcaagcgattctcccgcctcagcctcccaagtggctggaactacaggcgcccaccaccaccctagctaatgtttttgtatttttagtatagacgggttttcaccatgttagccaggatggtctcaatctcctgacctcgtgatccacctgcctcggcctccgacagtgctgggattacaagcgtgagccactgcgccggccaataagaggatctttagacacattctagccctaaaatgctgagattgttagtgctcatttacaatctgcatgaatgctaccagtgaacatgaagcccacatacttatgacctacttatgacaattttgatgagcattaattttttttaagtcattcctcacacagagacaaagactgtcttgacattaacttagttgtggtgactatttctgttggttggttggtcctcagaactccaatttcaacattacctagcaatatggttccatatgttgagaaattaagtacccaagtagaaaattcttaaactctacaatattgttatgtttagggccaattcttcatgattttccttaccagcaaaaataccagactggttctctttatttccaacctttaatactctgcatctacaggccttagtttttactacaaaaagacacactaactcacctctaatttaacttgaaaatacagtataacttcaacaggaaaggaaatcttgacaaatttaagctttggttatgccctcttgtggagtcttatgtgtgtaactattaacagacaaataactagaaaagaacaaacactggagaagaaatatcaagaagcagaagttcaaaatcttaatattggtttcacaaaaatgacaaaagattagcttccagactttagaaatagttttggcaactaaataagaaaaagggcaacccaactaaaatgggttgaagatatgaacaggtaattaaaagaaggggaaacatgaatgacttataaattaagaaaagatacctagtctgatcagaaaaatactagttaaaatcacaataagatactatttcaaaaacctaaaaatcttataatctaaaatattagtaaggatatacggtactggaaccctatatactgctggcaggagtataaattgtcacaacttcttttataacaatctggaaatacttagtaaagtaaaatagttatacaactcataatttgactaacaggtatataagtatatatactatctatagaatagttatacaactcaaaatttgactaacaggtatataagtatatttactatctatacagaaaactttagcatggacccaagaaagctacaaacaacctatcaacaggaaaacagtattatagaaaagatgattataaagctataaaaatgaataaatcagaatacacatattattgttataccctaaaacaaatccttctcattttcatgcaggtgtttgtgattattaccttacaatctataagtaatggccaatacatttctaatcaccacactctggtccttaggtctcttaaaaaatccctgaatcatacaaagccatatatacaggtggttcttaagaatatcttcctgattaaccagcattcctatcacaagtcgaaggaagacctttgactttcccactaccatcacttttttttttttttttaagagagggtttcactctgccacccaggctgaagaacagtggtgtgaccatagctcactgcaaccttaaactcctggcctcaactgatcctcttgtcttgggctcccaaagaactggaattacagggatgagccatcacctatgctttcccagctttaatttggagcaaaagcctctaccagtgtttttactactagtagctaacatcagtagcaatcatcatcattgagttaatattattaagaactcactatggggccaaacacctctgatcaactcattcaatactcacaataaccttgtagggtaggtagtatgatcatacagataaacaaacaggcctagagagatttagtcacttgtctcaggttataaagctaataagtaggactatatatttgattggggaggtcaatgaaccaaatttataattaagcacaaaataaacatatcaatactacattaagactgaagaaattttgaatttaaactgaatctagtcttttaatattttccagacaggtattctaaatattcactcaatgagatgtaacactgaaataacccattacatgtgggcaatatgaataaactggtgggaagacgagatgaatttttgcccagggaagctcaaactttgaggaaggcattattaggagtgcgggagatgctattcaggctaacggtctagacagctgaaggtctgaataatgatggtatactgatgaatcacaagctaagtggatagactactacttaaacagtattctgctgcttaaatgttcttctaagtacacagttggctcagtaactgctctgaacaagtttcttgctgttacaagacgaatcatagaacagctaaagtatccacacacgcctatgaaacaaatgtgacacacatacacaatgcattaatttattcatttcacagttattgatcacctactccatggcaggcattaagctgggtagtcagaatgtatcagtgaacaaaagagacagaatacctgccctcatgaagtctgcattctagctgggagaaattaacaataaacataataaataaattatacagcaggttacaatttggcaggtgttatagaaaagggaaataaagtatgagagggggaatgggagtagggttaaaagttttaaaggatgattggcagatactatgaagaagatgagttaaaggcaacctaaggaagccatgtgcatacctggaaaggagtgttcccaggaaaggacacagtgaaggtgagggcttgagacatcagtgtgctttgagcaccagagtgccagtgtggaagtgaagaagcagaaggcagaaggagagttggagatgagattaaaaagataaatgggaccaggggctggctttcattttaacagggtcatgtctgaacatcaaccatcaagcagaaaaaaaaaaaaaaaaaaaatcaggtagagctattccataagctatcccataagcaattggcatgatttcagcattcttaaaaacatcattcaatttagttattttctttgataaataactaacttatatgcaatttatggtgtattcacacacacacacacacacacacacacacacacacacacacacacagactctctctctctttttctctctctctctccaagatcagtcaggtttaaaaaagtagtacagatctctaattgaaaatggcagacagaatgcaggtctatttcctctttcacttccattctagccacactggcttcctttttgatactcacacatgctaggcctatttccacctcaggacctttatacttgctgtttcttgttggactgctcttcctctagatgtccacactacttgttccctcacttcctttagatctttactcaaataacaccttttcactgagatcgtctccctgtctaaattgcaacaatcctaatatcccctagtcccattccctgcttaacttttctttgacatacttaccaccacctgacattttacttggggtttattttgtttattgtctgtttatctgactaaaataaaagctccagagaaatatctgtcactttttatcactgctttacctgcagtacttacaagaacaccttgcaaatatacaggcctttaataaatatgtactgaatgaatgaacagtttggtgaaggcctggtgaggacacaatgaggtaagttagaaacactgaagaagactttgtggtggatagacgtgagaaagggggaatgctgcaaaatgaggatagagaagtaagcggaggccagatcacacagggttgagtagcaatgttaagaattttgtattttatcttttaagcaacaggagaccattaaggtgttcttgtacaagaaaagcatctgcaaatttgtgttttaaaaatatcaatttggatattggatggagtatgaaacttaggtaggcaatggtgaatgcagggtgaataatgaattaagggactaccacagtctaattctgttttattagtagaagaactaccgtacctgccagattaataccactgcagaacatctggaaatccagacacatccagaggagcacagaagtttggcaggactttaaatggaaaactacagaagcttcttttgtttttacctccgttcctccccttctctctttcctgtcaataggtttgcttttttatttttttcataattttaaattagtagatgaattagtagtgcctattataccacatcataaccagcagtttagttcttgattgccccaatcagactaaaaacaactttagggaaagaaccatacgataataaaagtaccagtcttaattataacaataattgattactacatgttacacactattcaaatgcagtaactcatttaatctcaacacaaagataagaagtagatattttatgttctccattttacagatgaagaaaatgaggaaaagtatctttcccaaggcccaaggtcacattactagaaagtgacaatctcactcccaaacccacattttccagtcacttattatgaggccttgatgtcacatctatatcccatctgtctttatatacccaacacctaatatcctgcctagcacataaatccttaataaatgtttaaagaaataaatacatgcaccttagtttattctctagctcctctacttacgtctctgtttttgtctgtctctaattcattggcttcttcagcattaccctcatccacacatttcctacaggctgcatcccctaagctttacagaactttttcaaccttttgctgttgggtcaaacagcatacctatttaagtacctggagagttagaaaacctgctttcatggtttccacaggcattctcattcttagcatatcactttagaagtgcccattttaaccaagaatgtatccatgtgggtgatctaactgaatcagagacagcctgactctttagaaaacaatttttttttaaattttcctgtgaatgtttattctacacgggcagctgctttttcatgttggataaaacaagacctctcttctcagatatttccccaataccatcttgaaatttcatgcaaaatattaaaataaataaaaatataaaaattaaatttccagacagatggtctatggtttttataaacataaaggcagatggttctctgtgtccccaaaacctagaattttgattcagcatattctgagttttactcactaaataatctggaagagttacctcttcctgggaatgaggaaacatgagagaaaaccaaaagaggtaaagaaaggaagaaaagcaaatagttgttattctccaacaggaatgctaccttatcattatttagctcttgttttctctgctttctacttaaaaattattaactcataacagtaaataagttgtgcaattcaatttacaatgagttccaggaaaaagttaataatttaacacattcatctgttaaagtttaaaatataaaatttgtgctatcatatatgaatgtgtataaaagcataacttgtcatgttcaaaggaatgactgtagataaagcctcgcttaaaagtttttcactgacacttaataggcaagaccagaaaaaaaaaaatgtattcaaaatgtcaaatgtgaacattccatatgcctgactccaagaacttgagtatagacatatatatggtttaaaacaaaatttattgatatactaaaactccatccacgttaataaattccaaatttacaaacctctccaaatgacatgtcctcagaaccaatttaaattcagtagttcacaggatttataaggcaattttttcagaagacaggaacattttaccattgtaacaaaaatgttacctgagggagggtaccataattccatatataacccttgtaagggaagatattcgccacatagcgtagctttccatcctttacatattgtttaatgggattcattggctccttggtggcaatctaagcaaatcacagaaggaagaaaaggagatgggataagaaataattaattctatgtccaaatagtacttttaaaaatctgctattttcagactaaacattcatatttcaacttaatgatcaaagatgctttaaaagaaattaagccagctcttattactaatttatagcactatatgagaaaaattgtttggaaaggaaacaccagatcatatatttagtcactctattatttatgtactccattatttctaacacaaataataaaatgattgagatggcaagaggataaagattaatcaacttgccttttgttactaatctcaggctttattatcatcaatattatgataataaaactaactcaaagattcctaccatatattcaatagtgaaatgctgaaagcctttcctctaagatttggaaaaagaaaaggatgcccacttttgccacttttattcaacatagtattggacatcctagccagagcaattaggcaagagaaaacagtaaaaggcatccaaagtaggaaagaaagaagtgaaactgtcactgtttgctgatgatatgatcttatatatagacaactctagagactccatcaaaaaacattggaaataatatataatcaacctaagtgtccatcaacagattaatggataaagaaaatgtggtatatatacataataaaatagcacttggccttaaaaaaagcagaacattctgtcatttgtggcaacatggatgaaactggagaacattatggcaagtgaaataagccaggcacagaaagacaaatatctcatgttctcacctatatgtggaatctaaaaaattgaactcataaaagcagagagtggaattatagttacagaggctaagggtagggggaatagggaaatgatagtcaaaggatacaaaatctcagacatgaagaataagatgttttattgttgagacaacacaacttgatgagtatagttaataacgtacatttcaaaattgctaagagtaaatttcaaatgttctcaccacaaaaaatggtaagtatttgatgtgacagatatattatttagcttaagttattccatactgtattcataagtcataatgtcactttgtaccctataaatatatacgattataacttgtcaatatacaataaagttaaaaaatcaccaaaaaagagattctcaccaactgattttatttcaaagttagttttcttttttctttttttttttttttgagacagagtttcattctgtcacccaggctggagtgcagtggtgtgatctcagctcactgcaacctctgcctcctggaagcaagcaaatctcatgcctcagtctcctaaatagctgggattacagacatgcaccaccatgcaaaaatttgtgcccagctaatttttgtatatttagtagagatggggttttgccatgttggccaggctggtctcaaactcctggcctcaagtgatctgcccgccttggtttctcaatgggctgggattacaggtgttagccactgcactcggcctcaaagttagttttctatcatgtatattcacattgctatctttaaaacctatgtatataggaaacaaaaaaataagccatgttgaatgaagaaacactgcttaagttaggtagattctcatagatccttgcatcctccacctaactgaggtagactagcaagaatgatgaaacattatacatgaaacaacaccaaaagaataatctaatatctttaccttttcctactaaagtgttaacaaaaaatactgccaggacctggtgatagtactgacaattctcttccaaatataaattctgaaaaatatacacctacataataatgcctaatttaaatacttaaaataatatttgctatcacacccaaagttatagaaggtttatataactaaacaaagtaacgtaaattaaatttcacttagaactataaggaagcttatatataagcttctatagctaactgaagaaagaacaagaaaattctgaatagcaaaaaggaagttcttataggttcatttcccggaaaaatttaaaaaaaaaaaaaaagctaaccagaaaaatagcagatgctctgtgatagtcataaattgagttaaccaggaaatgatttatttcctggtagaataaaatctaaaggagaattgagtcctaataaattaaaattgccatcagccccaaataaaagtttcagttccatctatgaaccaaatatatctcagaatctacttaaacaacctttaaaagtatttgccattttcaaaggagaaaaaaagaaaattaatatgtatataacaaactgacaggcaaaattgaaaaaaaaactctctataaaactataacgtatatacttagctttgagtatttttctgaactatctcaaatttaaaatattggccgggcgcggtggctcacgcctgtaatcccagcactttgggaggccgaggcgggcggatcacgaggtcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaatttaaaatattatgccaaacaacttgcaacaaagttttatatcattataatcatttcggtttcatattaataaagtatatcggtacctccattttagcatttgtccaccgaggtatttctacaatcatattaaacagattctgcagttaaaaacaaaacaaagagagaacattaaaaattttaccttttattttttccgttacctcccttataagaataccttagatgttttcccccgacaaaaaaaatgttgagtctccatcatacatctacctatgccttaaattttttctagaaattagagttgtctaaaacacagccaaatttaggccaccatgtcacttgagcacttacacacagtgtcagaggttacgagtctgagaatatctttgatgagtagtgacaaaactagaatggagtcaagaaatgtgtttcaatttttattttccaactaaaatagaagtgagagaaccagtccctcatgtaaggattcagtctcacttttccaatctgtaaagtaagtgtgatcatctctgtcccactcaccacatgaggttgttacaaagatcaatgacaatatacagaaaattatgaagtaaaatatattttaaaatgataaaataataattaaatccaagttacaatcacagtgtaaaattcaggatgtaagtacagctattacagagttcacaaagagctacactaaatattccagacttagcttgcatatctggtgagttcagactccctaaagttacaaactcactatggcttcactttttttttttaatttctgaactttgtagaatgcataaaccaaaggagaccctaggtcaatgatgagtaaaaataattccctacagtttgccttacaaagagaaagtcttaaggttaaagttgatttgcacacattttgacatcaataactaacaatttatcaaggaaacaacgatggtttaaaacactgtactccaagtgtagccaaagaccagggccagtctgcaaaccgattgttactggctcatttacaaacatttgtagcaatttaaaagagcaatttttatatctgttaaatctaataataaaaaattggaatctgaattacactttccttttttttttttttctcccaagacggagtcttactctgtcacccaggctggagtgcagcagcatgatctcggctcactgcaacctccacctcctgggttcaagcaattctcctgcctcagcctcccgagcagctgggattacaggtgcccgccagcacgcctgctaatttttgtattcttagtagagacagggtttcactatgctggccaggctggtctggaattcttttttttttttttttttttttttgagacggagtctcgctttgtcgcccaggctggagcgcagtggcgcaatctcggctcactgcaagatccgcctcccgggttcacgccattctcctgcctcggcctcccgagtagctgggactacaggcacccgccaccacttccggctaattttttgtatttttagtagagacagggtttcactgtgttagccaggatggtctcgatctcctgacctcgtgatccgcccacctcggcctcccaaagtgctgggattacaggcgtgagccaccgcgccctgccaacacttttctaacgattcatgttgattgcattttttttaagtatctgtttacaaccaattagaaataaaccagccaaaaaactagtctttcatcccaaatcatttgagaagtgatttaacatacttattttcgatcatgccacacatcaataccacctcaccagcttcaaccaattaaaaaaaagaaagtttcccagagccccgtctctcatctatctgaattaaattgctctgggtggagccagggcactgcttatttttataggctctccaagcaattttaatatgcagccaaagctggactaaagcattgctgaagagtatcacagaggttttctagtgtaacatggaatgctgttatttcaaagaatgctatttacacaattaaatgtagatagatattgagccataaaagtaatgatgatttatattaagtttttctacataagactaaaggttacaaatggcaaagctgcaagcccataatgagataaacaacaaagctgagaataaattctcaatagctgctccttagaagtatgtctcatacctatcttagcaaccttacatacagtcctgctgttatgtttcattttctatgctctttcatgaggtacccctgcacctgtttaaatatgtctgaagtagctgttaaaaagaaaaaccaaagtaaatggcagatgtccacataatttattcatccctgaaagcctggctatacgggaacaaatgcttgcagatgaatactcagaggtgaccaagaagaccaagctggtgacaatcgttttacacaataacacctaccaaaaccactcacagatacttgaattaggccaaatgaacaataaatgaggtttgaattttaagcctgcaaaccacattctccctcttcatttgctcgtaatcactaagagcttatttccaacctgcctttcttctctccagctaagatgcatttgtcctgtaattaattttttaaagccaatgttagcctggttttcctaagattaatgttaattataaaccaacaatggtctgccaaattttatctgaaaataaaaaagataaaaggagcacaagtcaaaccagaaagttgtgtatgtggcaaggactgtgaactactccttcagtccttttctttctctccatttttttccttgtatttttgttgcagaagtcaaaatagaaaaactaataagatgtatgaaaaagcagtcagtacattttatatacatggggaaaagacaggaagaaatcactcttctttcctctctaatcctgaaaatttcaaataaactcaaatcagacagtctctaacataaaaactgtgttctaagaattaaattttaatttgaatgtctgggctcagaatatgtttttcccactaatgtatttcattaacctgaaataactgtttcaggttaatacactaagtcccctggggatctggaaacccttgttcactcaacatctagggcagtggttctcaaacttcacgtttaggatgcacctagaatacttgtgaaatacctagattaaccaggccctatccagcggagaatctgacttagtaaataggagatggggcacggaatctgaatttttaacaagcactctaagtggttccagtgtagatggttcaagaatcacaccagcttagaaaaatagaagacagatagcaggcaaaggttgtaggaatttaaaggcccccacaggtatgtttggaagtagattcaaatgctggagctgtaagtttcagttggggtagagaataaatggaaatgaagctggaaaggtaaaaggagacaggaaagcagcaggaaaagctgcctggcatcagaatcagagggataaaaggacacttgtagcaggagatggaatgacagacatcaatcaaatgttctggtcctaagtcaagaactattaaaggtttgacagccacatatatttgtttagatatatttagaatatatatatttagaatatattcattttagcatacatttagaatatatatatttagaatatattcattttagcatacggttggtataagtgtttttcttctcctctactcccaaaagattattgttcctgggttctaaaacagcctctcaaaccatcttctctcttataatttaaagtgaaatatttcatttataatgaagtacatttactttagaccatctaccaagataattaacttattattaaaatctgggttcctgtgctaattctctcaggttttcccattgtaaaatgaagtggaaatgaaatacctgcaacagtcaaattcataagacagaaagtagaatagtgcttcccagggcctcgggggagggaggaaatgagaagttgctcaacgtgtagagtttcagcttgggatggtgaaaaagttctggagatggatggtgatgaggattccacaacaatgtgaaagaacttaatgccactaaattgtactttaaaaaagttaaaatggtaaaccttatgttatgaatattttaccacaataaaaaaagttaaatggcaatagctgccctagctgccttaaagaaaaacatcggaatgcacatgaaagtcttgcaggggtaaaaaccttagaatcattttacaaatgcaaactatcatcaaggtatttaacagacaatataaaagtgattcacaaaaataaaaacctttggatatacctcatattcatcatttcgtgctttcttcataggaatgccattttcctataaaagaaaagatggtgaaagactgcaatatttcatgaaagtatacagtggcactgcatagcaataaaaatatgactattgtatagacattctacacaaagactgtccagaaatctgagtcaacagagaacctaccaaatgcccacttcgttctcccctgagcatttgtatccccagaatagagcatcaaagtgtttcataaaataaatgatcagaaaagccaaacctctttcacgtatattttcccagtttttataaagtaagcaaaggctctgttcagtctttaagaaaagactggtagtttccagtgattatgcttaaaacagtcatttcattattgaaatgaagctccagggagcatgactaacaagctgtgaaagtactcagctgcacctcctgcctgtgaattctaccaaggtgtgattactaggcctccaccaagcactttttttcttttttcttttcccattaaaccaagcacttttaaattaaaactgacttcgtggtgggttgggaagaaaaattatgccattcacaaatgctcaaccagcatatgtaacgtttatacaccaaaatgactactaatgaagaaaacaaaacaaacaaaatcatttttccaaatcagctctgaaacattatttttgtttttgctgctgctgttgttgttgttgttgttgttgttgttgttgttgttgtttttgagacagagtctcgctctgtcgcccaggctggtggagtgcagtggcgcaatcttggctcactgcaagctctgcctcctgggttcacgccattctcctgcctcagcctcccgagtagctgggactacaggcgcccgctaccaggcctggctaatttttttttgtatttttagtagagacagggtttcaaccgtgttagccaggatggtcttgatctcctgacctcatgatccgcctgccttggcctcccaaagtgctgggattacaggcaagagccaccgcacccagccattatttttattcttaatataccacatcccaaagtacaaagcacgagttttaatcattactggctgagatctagggaaacctatttacacaaccaccatgcgtatccatttccatatctccagaattcactggcatatcctgttgtatttgctggccctatcatcaattttgcctaatctctaatttcacatttcccaaaacccatcctccttagacaaaatgttattctcactgacatgtttctagcttactcttttccacctctacctctatctactacacgactctcaaaaatacagctttattattattgttgttatgatgaggtatacagattttgctatagcatacccctgacaacactacccaccagtcacattttatctttcctttccctgttgtatttttatagcacttaacattatctgactgacttgttttatggttgactcctccaattgagtggactatacctatcttattcactactacacccacagtgcctagaacagtgcctggctcataataagcattcaatgactattgattgaatgaataaattaatgaataagtgaatgcatgcacttttagccaaaagcaaagaaaagtgttgggagacatgagatatttaggtttgaaagttcagtggccaaaacaaaacacaggaacacatatacacacgcactttcacacactcgcatggacacacacagtaacatagagttccttttgcctctggtttccttctattgtcctggagctgcacacttaaaagtaatgagctggaggcattacacaagagaagtgaggagtacaaactctggagttagagcacctaaatccaatcccacctccaaaacacacgagatttgtgatgatggacaaggtacttagcctcgttaacaaaataagggtactaaatgtaaagccagaaggattgagataaaccatatcaagcagggaacacagtgctggctaagtaccacaagcacttgataaattattgatattattctactgccagttccttattctgaagagctgggaagcagcacaaatcctacttcacatcccataacctcactatgatgcataatattcagcctctgaggtaacaccagggtcaaacaacccttgcatctgaagtagcctcctcagttcttcagtggcctctgcccctatattgatcaccccacatcctagaaaacccaaccccaaattaacgagttacatataatttcaacatggaatgtggtcctggttatttacttaatagttgtacccccttaaaaatttggtaattcactacttggattttaaggaaataacctacaacttaatgatgatcatgaatactaccaaatatgccatattaccaactaatcatgagagatctcgaaacaccccaacaattttgatttgatagcatcagttctcctggcatctttcacaccctgacaactgtcaagtgattttcagttctaagagaacagctattcaaacaccaccatttttacccctgctttatttctctaacacctgtttcatagagtggttaaagagcataagctttgtggtcagaagctaattccaaaactagctctggcacttaccagatcttagacaagtctataaaaatgccttgagcctcagtgtccttggaaagaaaaatagcaactcataacaattaaataacatcatgttcacatagtggctagcaaataaaaaataatccacaaacgttagctgattattgtaaataaacctcttggtaatttcctaaattactacccttaaatctttatttcctaccgaattctaagttttatgtaccagtaacacccctttctcccaattcctcatggaagaatcctattctcatacaacttttaattcatataggaggcttatgaccctgttatagtaactcctgtttgtcctcctgacttccaacaacactttttcctttcaaggtgcttccaaaaagcatctaatggtgatactggcagtacacgttttcattcccaaaacaagtcaaaacaatacctctttagagttcaccttcagaggaatatcatgaaagggggaaatgtagtgaccagttacattctctgcaaagacacaaacaaacaaaacaaaacagaattaaagcaatagacacattgttctatacagcaataataaacatccttatccacttttaaacttacgcattttttacaaagctaactttaactcccaacttaaagttaattcaacttttaaaacttgccaccatctaaggaccgaaaagaaatatataccggctaaaccatatttgggttgctgaaataatttacttatccctgtggcttaaaatatccaaagcagaaaatatctacaatagactaaaacccaaaatacatattaaaaaaaaaaacatcacttttgaaaaagaaactcattactaagtgaattctattaaaactgatgtcaatttcccttggggaaacttaacaatagtattcccaatttctacctactatccatgggaagaaaagtccaaagttcctattcaattaaaagaaaagaaatattgtttccattcaatgtggtaaggatgctaatactaaggtaagcttagaacaaaaacaaacttcaataacagaaactatcttaccttaaaagttgtataccaaaatgtgtattttaaatactttcaatatttaaataaacacaatgccttgtaaataaatacaatgcacttttactggaatacatctgtttccaaaagctaagcttaatagagccctacaaaattttcactttgtaatttcctaaatcaggctgttttacttctgacctgctacctgtttggcataattttcaaatttagatttcaagaatatttaacaaaataaaacaaagactggctaaatcccaatagcaatgagcacaccagcaaccacatcttggtttctttcttctttttttttgagacagggtctggaatgcagtggcatgatcatggctcactgcagcctcaatctcctggtctcaagcctcaagcctccagagtagctgggactacaggcatgcaccaccacacccagctaagtttaaagttttttgtacagacagggtcttgctatgttgcccaggcttgtctcgaactcctgagctcaaacaatccacctactttgggcctcccgaagtatagggattacaggtgtgagccactgcacctggcccagattttggtttcaaaatgccattctccaataaaaggaactaggcctccttggagaaaggcttgattctaatgctggagcaaagaatacccaagatgagcctggagcatcttgtagggtcagaaggcaaccaagtgctcaaacatcagaagactggaggtatggtaaagggaaatgtgaaccaatctgaaagagtccccaaaggccaaagctggaacaatttgagcaacaaaatataaaacaaatatacatgaatccacactaatacaaacaaatgataaaataaatgagagagaagaaacaaatccaagattgagaaaccgtaacagattgttagacagtaaggaaatatgatgactaaatgcagtctggtatgctgaactagatcctggaacagaaaaatgacattagtggaaaaactagtgaaatccaaataaaatctggagtttagttaagggcatgtgccaatgttagtttcttagttttgaaaaatgtacaatggcaatggtaaatgatgttaagatgataaaattagggaaaaactggggtgcggagtatgctggaatcctgtactaactttgcagcttaacccaatctaaaattattccaaaatgaagtttattaaacaacaacaacaacaaataagccctggattctgcccaacaaaaacagaggcatggccgggcacgatggctcacgctaattccagcattttgggaggctgaggcgggaggatcacctgaggtcaggagtttgagaccaacctgaccaacatggcaaaaccccgtctgtactaaaaatacaaaaattagctgggcgtggtggtgcatgcctgtaatctcagctactcaggaagctgaggcaggagaatagcttcaacccaggaggcggaggttgcggtgagccgaaatcgcaccactgcactccagcctggcgacacaagactccacctccaaaaaaaaaaaaaaaaaaaaaaaaaaaggcatgtaacttaacaatgaaattgttaattcccaccaatattttatttccccctaccatgctttgtgctttaccttagcacttatcactagaattaagttctggagtttttgtagttgttcatttttgtttgttctgttatgctttctactggatctctagcatctgggaaagtacctagcacttaataggcatccaatatatacttgctgagcaaatatctgttagataaatgtctctattactattttatttttccctttaaactgttaacataatttttatttccccaccctagcaacaaggtaattcctgaaggatgtgtgcacaacgtaaggataaaaatgagaaagagcacacaaatggcaagtacataaaactttggctatggtctataaagctcttttcatcagtaaagggatgcacttaaaaaaaacttctctttcatatattacatcagatttcaaattctctgcccgattttcaaagttatctatgagtaacacaagaacacaaaaaacaaaattaccaattttttacatgattatttacttttctaaatgtaatagatactaaagtgggccacatttacatgttttcaattaaaataaaatatggtgatgggaactgaaaatggtgcacttgctctggaaaacagtttggctgtttcttgtaaagttaaacatacaattagcatgtgacccagaaatcccactaagtatttaactgagaaataaaaacatgttcacccaaaaatctctatatgtttacagcagctttattcggaatcaccaaaaactgtaaacaatgcaaatgtacaactggtaaatggagaaaaactatgttatactcatatagtggtcttttaatcaatgtttattaattattccacaataaaaaggaatgcactattgatacacacaataaaatggatgcatctaaatacactgtatcaagcgaaagaagctcaactcagttccatttacataacatactggaaaaggcaaaactataggataaagtgcagtcactggttggttgccaggggctgatggtaagagagtagggttgaccctaaagggggccacaaaaaattttttggggagggacagacctgttctgtactttgtgatgctgtttacacaaatctactttctgtcaaaactcagaagtgtccacaaaaaaagtaaattttactgtaggtaattttaaaaataagtaaatatggagctgaaagacaactaggaggaggttaagaagacatacacagtaagccctctgcatctgcagattcaaacaatcgcagatcgaaaatattctgcaaatctttaaaaaataaaaatgcaacaataaacataatacaaataaaacaatacagtataacaactatttacatggcattacaaggcatcagatattgtaagtaattcaaagaggattaaaagtagacaagagggttcctttctcttggtttctttccaccctcccccacccataagggaaaaaaaaataggaggagtgcataggtcatatgtaaatactacgccattttacatcagggactggaacatctgcaaattttggtatccaaggggttctggaaccaatcccctgcaaatacagagggacaactgtaatgtataaatggaagctcttattccaagaacaatcatcaatctgtgattgtcctctcttcaagtcactaaagtaaaaaaggtagaattctgaaaagaaaaaaaatacaatcctttaacagattacttcaacgttcatttgggacctatcattgtgatagaaatgaacaataatttcagctctaagaatccaggaagttacacaaacaagggaagtttgttatcatgggggtaaaagaaacttgacagaaaagccaggctgcctttgtaattaagagtaaataaatctaggacactgatttggtgttaaatttccccaaagatccaatgctcttgttaactgtggacaagcccaatacttattaagatgtaagatcacatatatatatagttttctaattgtcatttggaaggtaaaaagattacaaatgagtgaatggtctgtatttactaacttacataaccatacctactagaagctatttcatgaaatagtattaataaataaaaatgtaatagtgaagaaaaagagtaaaaatataactacttctagaaaacaaatatggccttagatctcagataataataatgctttaatgggcaatatatctataaatttgcacaggagcaatgactagaaaggccaaaaacctgacttctagttactcagcttcataaaaatggcaactgaatgatgaggctcataaatttggaaagcagagctttatttctcataaagggctgcaacctgcaagcatgctcagttgagcttcatgcttctccacgggacccatgttcaaaaaacggtggtgttagcatgatctgagggtggagttttcagctctctgatgtcgaaaggtgaagtggaaaacatgaaaaccctcactgcacattctccatagattcgccagaaccactcttatcaggagggaacgctggtcagttgttttgtggaaaccacaaaagggaggggcagcagtcagactttcggttggtatcagcatctgtggagtctttcgaaagggctggtttctatttagcccttagggaagaaaacttaatggcagttagtgagggaaagggtataagcaggcatagttgacctccccattccagtcgtggccaagaactcagttttcaaggtttctctagggttcccttggccaaaaggagacccattcagtcaactgaggggctcagaattttagtttatttctcaacagtcactcaatttctctgaagcttaattttctcaatagtttcttgcattaagcaatatgtatttacagagtgtttcacatgaaaaggaattgtactagattttggaatagacaagtgctacacagtgatccacgcccatagctaagacaagacacgttacatcactgtcatcatcatcatcacctagtaagtttaaacacaaaggcatcctctcagcactgttagaaaactgaacatttccctaaagtgcaaaaggataagaactcattaaaagttttccagggccaatcatgttgatatgctattatgttccatttaaagggtattaaaattctctaaaggtggatttaaagatatgtagtatctatcctgatcctctataaaatgaatgagataatctatatggtacatatgcgctacagacagagggatatggtatatggaacaagcgctgtggcaacacatgccgttatttttaaagacagtagaacttatctagcactaggttaaaaaaaaaaaagtggtagaactgaagcacacatcagacagcccttcctcagaaccacagaatatattagtgatacatcttaggttagaactttcttatccgaagctcaggctgcttgtttcttaacagttgaaaacaagctattgccaatttgctttttaaaacatctattttgctgttgttaagccaaagcaatgcaggtccatgactgaaaaaataatagtttctacctctccccagtctagttccactcctgagagcaacccattttcaactctttgtattaggcctagtggttaccttcatctttctaaatagcatatttagtagtttttgtttatcaattgtagaaattacctactgattccaattctgagagatagtttagttcaatctattctacataagttcttaattggctaatgttaatacacctttttattccaccaaatatattgatatggtttggctgtgtccccacccaaatctcatcttgaattcccacgtgttgtgggtgggactcagtgggaggtaactgaatcataggggtaagtctttcctgtgctgttctcatgatagtaagtctcacaagatctgatgattacagaaggggtagtgttcctgcacaagctctcgtctgccaccatatgagacgtgcctttcaccttctgccatgatagtgaggcctccctacccatgtaaaactgtaaatccaataaacctgtttcatttgtaaattccacagtcttgggtatgcctttatcagcagcatgaaaataaactaatacagtaaattggtaccagtagagtgcggtgctgctgaaaagataactgaaaaagtggaagcaactttggaactggataacaggcagagtttggaacagtctggagggctctgaagaagacaggaaaacgtgggaaagtctggaactcccgagagacttgttaagtggctttgacccaaatgttgataatgatatggacaatgaaatccaggctgatgtggtctcagatggagatgaggaaattgttgggaactggagcaaaggtgattcttgacagttttagcaaagagactggcagcattatgcccctgccctagagatctgtggaactttgaacttgagagagatgatttagggtatctagtggaggaagaaatttctaagaagcaaagcattcaataggtgacttgggtgctgttaaaagcattcagagcataaaagtttggaaaatttgtggcctgacaatgtgagagaaaagaaaatcccattttttgagaagaaattcaagccagctgcagaaatttgcataagtaacaagaagccaaatgttcgtccccaagacagtgatgaaaatgtctctagcgcatgtcagaggccttcacggcagcccttcccatcacaggccctgaggcctagtaggaaaaggtggtttcgctgggctcagggtccctctgctgtgtgcagcctagggagttggtgccttgcgtcccaggtggtccagccatggctaaaaggggccaaggtacagcttgggtttttgcttcagcgggtggaagccccaagacttggcagcttccaagtggtgttgagcctgcgggtgcacagaagtcaagaattgaggtttgggacctctgcctagatttcaggtgtatgaaaacacctggatgcccaggcaaaagtttgctgcagtggcagggccctcatggagaacctctgctagagcactgtggaagggaaatatgaggtcggggcccccatacagagtccctattggggcactgcctagtggagctgtgagaagagggccactgtcctccagaccccaaaatggtagatccaccaatagcttccaccatgcacccagaaaagccacagacattcaatccagcccatgaaagcagcaaggagggggactataccctgcaaagccacaggggcagagctgcccaagaccacaggaacccacctcttgcatcggcgtgacctgggtgtgagacacatggaatcaaaggagatcatttggagctttaatatttgactgctctgctggattctggacttgtatggggcctgtagcccctttgttttggccaatttctcccatttggaatgttttatttacccaatacctgtgcccccattgtatctaagaagtaactaacttgcttttgattttacaggctcataggtagaagggacttgccttgtctcagatgagactgtggactgcggacttctgagttaatgttgaaatgagttaagactttgggggactgttgggaaggcatgttggttttgaaatgtgaggacatgagatttgagaggggccaggggcagaatgatatggtttggctgtgtccccacccaaatctcatcttgaattcccacatgttgtgggaggaatcctggtgggagataattgaatcatgggggcaagtcttgttcttgtgacagtgagtaaatctcatgagatctgatgattatatacgggggagtttccctgcactagctctcttgtctgccaccatatgatacatgcccttcaccttcggccatgattgtgaggcctccccagccatgtggaactgtaagtccaataaacctctttcttttgtaaatcacccagtctcaggtatgtctttatcagctgcatgaaaacaaactaatacaaatatacagtatttcttaacatcaataacctgacttttacctccctttcctcattcttctaatttttgtcttctgcatatttattttttcatatcaaggctgatagaatgttctgtaatcatactgaattttctatgcatttcctattatatatatcaaaaatttctcttagataagaaaaacctggaatgctcattaaaatgcagatccctgaaccaccatcccacatctagtgaatcaaaatctcaaggagggagaaatgaatatctgtatttttagcaaacatcccaaataattcttacactcaggtgtgtgagaagcgttgtctatgtgtttatttttggtgaggatgctgctataattaaatttccttttttggttcagcttctatttttcttcgtgtttctaattatctttcttacattgtcataatcacgtctataagttattccaatgcctcacggatatcatcaaaattatggaatcctctctttacccaaacagctccttcaggaaccctctatcctcaggctgcaatatgaactggatgctttccgggcatcctaagactgcttctttgctctccagtgtagatctatcattttctggatcccatgcattcacgtttttttggtttacttgtcttgcagaagcatatccctaataagtgttctgtaagaaggattgcatgtgaggccaatttctcaagttgttaaatgtctaaaatgtctttactctgttctcactccagattgacagctggctgggtagaaaattctaggaggaaaactcttttctctcagaatttcaaaggcattactccagtcttcgagcattcagtgttgcaggcctgttagctgaccaccccccagcaagacatgtgggatcctctcaatagctgtataataatgtgactgggggggtcagaaaacttgggtccttcaattcttagatttttttctattatcccttttacaatttcttctccattttgtctgttctttccttctgaaacccatatgagtcaaatgttggactttctggattcaatctctacgtcacttcttcttgcctcctttttctatctctgacattttgttctactttctgatagatttaccttatcttctaattcatctatattctttttcttaggactgctgcaagaaactaccacaaacttcgtgtctcagaacaccattcaacccactacaccttctactgacttacttgttttaacaagttatttgctaaagaggtcttggtcttgattgccatttcttcacagccaactcttccttttttttatagcagatgtaatagagaacacccacttgaccttctaaaattcaagtttcttgtttttcccatttaatttttaagttttccttaaattcattcagtaaatatttcttgaatatatgcactgtactaagcatggttctagatactagatacaaattccaattccctgttcctatggaaatcacattctagttggggtgcagaagcaatgattatgtgtttattctatcacatatcataagcactataaagataaaggaaaacaaattagggaaagtgaagaatgaataatggaagcgttaccaatggcaaatccctatggctctgcaacaatctcaattcttgcctcctcagaagaaagaattcaactgaggggcagaaggcagaaggagaggctgaggcaattttacagatggaatcagtttattataataaaaggctttagagcaggaacaaagggaaggaaggtacacttggaagagggcaaagtgggcaacttgaaaagacaaatgcacggtttgacctttcaacttggggttttatatgttagcatacttccaggatcttgtgtcccatctcccctgattcttcccttggggcaggctgtctgcacacacagtagcctcccagcacttgggaaagggaccatgtgcaacgtgtttactggagttgtacgcgtgttcacttgaggtgttcttcccttaccagtcgaatgtccctaggaggtcacataccaaactctgccattttgcctcttagtgcaaacgcttgagcccactcacccagttcctgagatctcatgggaagctgctgatcaccagcttcaggtgcttctgtttatttggagactgcctttccctggtgcaggctgcaaccaattaatattttagagaaacagttaacaactgcctgaccatcacctgatgtttgcctgtcattcctggtgtgtgttgagggaggggagccctcttctgccctgctcatgcctgactagctacctactgtaacagaaggagtaatatttgatattgaatggtcagggaagatctctctggtgggtaacagttcagcacagatctgaatgaagtgagggaagagatcaagtagacctctagggaggagcactgaaggcataaaaagcacaggtgtgcagaggaaagaacatacatggcatgtctgagaaacagcaaggaggccaggatggcaggaggacactgatcaaaaggaaaagtggcaagcaatgaattcagagaggagcccagtattagatccagtaggaccttacatgctatggtacatatttcaaaaaattttttgagtgaaatggaaagccactggcattttcagcagagcttgtacattatctgacttacattttaaaaggatgaaggtgattgctgtatggaaagtagactatacagggctaagggtggaagcagggtgaagaatcaggaggttacaactgatcaagggaaagatgatggtgaaacagaaagtgagaagggtggaagtggacagaaggaattgtcttttggtacatttcaaaaaaatatgctaatgagttagctgtgggataagagtaaaaggtgacaagaagaatgcccaggttatgggttagcaactaaagagagaaacaagttcggtgagggtggggagtcaggagttctgttttgtgctgttaatcttgagttgtatcttaaacatttaggtagaaatacagagtagaaagctggatgtgtaaattctgagttcaagaagagatgcggctaatgttataaattggggaatcataaacagcgtctaacactatgggacctgatgggatcacccagagcaacagcaatggtcagcaaactctggctttatgggccaaatctgtcacatggcctggttttatttttgtaaatatagttttattggaacataaccacagtcatacttttactgtccatggctgtatgttacaatggcagagctgagtagttgtgacagagactgaatggttcgcaaaacctaaagtattccttatccggccctttacagaaaactttgccaacacctgccctagagaggcagtatagatagagaagtgggctgaggattgagccctgggcatttcaaaggctagagttcggaaatatgacaaaggttcagcaagggagaatgtgaaggagaagcatcaaaactaagacaaagtgcatcccagaggaaagcagtttcctctgggaaagacaaaaaaagtgtttcaaagagaaagtgatgaactgtaaaaagtactgctgataggtcatatgaggacttcaaactgaccattaaggtcgcagcatggaggtgacaggtagccctgacaaaaagcagttggtagaacagtagcgatgaaagcctaagttaggtgatccttgactatttggtttatattaaaaagactagaaaaaatcactgggaactctgtgttcccacagagatgaatgggtaggaggctggctgttatgctggggtccccaaataccagcatgcagagtactgctggggcaccaacaccatcaggggtcctacttccctctcagctcttcattcacttttacagttggaactaacacaaccctcatgcattagacctgcatgggaaacatttgtgtactatttgtagtacaacttaaactaatccccctgtgttaagttctacatccatctaactctctatcctatcttatatcaacacacccacaacctctctgaggttctgcagcagctcggcttttccctaaactacgtcccctgaacacatatacttaagctgggacttcttccacactgcttcattaataaccatatctccattggttttttaatcttttatacatatttcaaaatctcaagctttggtggctccttatctgttgttttagggttaccctttcttatcctcacttactatcactttaataggatatttattataggggaaaagagataaatgattgtagtcactgtgtcatttttgccatggtatttcactgtcgtcaaaaatcagattgtgtccttaggcattaattgctaacctctatcaggcccatcaatctacacgatattgccaaacagtggtcaaaattctcccttcaactggtctgaaatcagattttattctagcattttctaagttatctatgtgattctttctctcacaagagcaagttgtatcaggatgaaagtttattacttacactagagcaagtgagaaaattgaatggaatgtgaaaaccatacctaattttatgtatctataccagacagctaaatgtatgccatataccaacatatgattacacacgactacaaaaccacttatagagattcttactggaagcttcagcaatgactaaagctaactttgttttattttctgataaaaagattaagaaatgtaaaggagcctaaaaacttcaataaaaatgcttcctctgttccatatagatcacacaattcctatttcacagcactgatatagaaaacgtttaaggttttaaggactgaaaaatcaaataaaatactttttctatattcacacaaaacccattgtgttccattatatcagttgaagttctatgatataggccaactttaaaaagttacagaaactcatatttaagactcaaacaaattttgtggattattcacgggaagttctcttttaagtccaaagatacagcactttcaatggcagattcctcctactacccaaatgacataaagaaaacctacagtaatttcaacacaagcacatgcttactataagtgacaaagcaaattaattttaaagaactgcttggttcattcccagactaaataaaagcaacttgaattatccacagcactatttctctaagtaaaccagttgcctatcccataataacaaaattcctaattatggaaagcatagcttttccctatcctatgagaacagtatgaaatctaaaataaaatttcaagttattaacgaaacaaaacaaacaaaaacacgcaagatatcaaaggaatactggcatgcagcattaggtctttggctcaatataagtgagtctaacttcattatgatttcacagttaatttaaaagactgcaagtacccattaaaactttaagacctaggaagccgggcacagtggtgcatgcctgtagtcccagctacccaggagacagaggtgagaggatcgcttgagctggggaagtcaaggctgctgtgagtcgtgattgcacactgtgctccagcttgggcaaaagtatgagaccccatctctaaacaaacaaacaaaccaaaaaaataaaaataaaatgaataaacaacaacaacaaaaaaccttctgaaacctataaattaacaggaacacttcaaaataatcaatcacatcaccttattttctcccttcacagaatctaataataaggattttagtctaatgtcttaaagtcaaaagggaaaaataaataacatttattaaatacctatcacgtgtgagacactgataattacacacatagtctcatttaactgccacagcaattctataaaattactagtgctatccccattttatttacggagaaactgagctaccggatgtcatctgaaggtaagggatgcctctggttaattcagtcgagtgacttgtccaagacggtaaagtcaggactacaacttaagtggtttgactattagtttagaactgttacagcacagttgcttctggaagttgcagaaatcataaccctgatgtcactaagatgttaacaaatgttctgagaaataagtactctgtggttcagtttttggagaagttacatccgaattttccagaacttaaataggcaaattcttcttcaaaaaagtaataaaatgggaagtgttctaatttattaaaccatgaaaccctctgttttaacgaaaacctaataatataccatgggatgcttgtgttcaactaagcagtctggaaaatgatcatctggtccaatctcctcattccatggttttaaaaaatgagatgcagggaggtgaagtgacagcaagatactaacagggtcagggctggcaccaaggaggcctgatgattcccatcaggataccctttcccctaatcatcctgtctcactctttctacaaagtttaacaccaatttttttttaagtattacatcaatcatttattctgattttactgaatgacagtaaagagaaaccatttacagacatgaagctcgaaaatgttctacctcccaatgcactagtatttcagagacttggaatatatttggagatgtggaaaatgattacactttagtaacactgagtaacaattttaggccaagtatactacactcatattttttttgaagtgagacattagtccaccctagtactgcatacagacacactgagtaataaatatccaatctgtgatcatctttataaagggcaatttattcgttgctttccccttaccccattcgccctagagtggcttcgtttcactttgccctaccccttctagcaggtagtaaacagtcctggccagtgatgccatctggcggttagttcagaaattgtttaaccaacacaccttccaatcaggatcttaccatcgggaccctctccaaaaccacactcccctttcttccagtttttgcccatttaccttagtaaaatcgggttttcttctttcctgccctgtttatccaactgaatgaaaaacgtattttatttgtggcactctagttacagaaaaatcatgagtcctaagtacatttgcagctaaagaaacaaaccaacaataagaggccaacatactcccaaaaatgcccccattcgacatcctgtcttaacagagactgttagaatctccgttattcatccaatgccttcagggaataccagtgctgagaaggaccttgaggatcatcgtttcaaggtcaaaagcttcattttacagctgaagaaactggctctgtgagaaagaactgaagtaaccacccacccaacagcacacagcgagttaacggcagagccaagattatggcctaggactccccattccaaatccggtactgggtcaactactctgtgcgctcctggcttctcaagcctgtttttgctcaaccagtgtatttactttttccataattatagtaatattgtgaatctctgtactatgcctaacagtgtctagcacacttcataaatatttattatttgggtatctattaattaccgtacttattgcaaatctagaatacttgcagtagacaggccttttttcaatctgcttaaaaagcgaactgccacttcataattttttctgactattcccattaatcatcacatggtaaccttttagaacataatccattcagaaatttgagacttcctgttcacctgatcagtcttaaccaaagatagaagaaaatatgtggcatagggtgaaaactgcaaccaattttgaagaaaatagaaattctagtactagttgcattataatcacacgactttaggcaaactcttctttcccacaaaataatcctcgaccctaaactcatgtagcataactgcaaatctctcataaattacaaatatctataatgattatcggtattaacaatagtaatttatattttaggccctgtgactaatcagtttacatatataatgtcatgtaatacttgcagccctattttacggatgagaaaaaacaaggcttagcaacttaaactcgtccggggtcacagagttaagacgtgaagaactcgagggcctgcttagaactgaaagcctccagagccagtgctccgaaaaggggagcgataatgcaaggcccactttgatactaccactccaaggctctgcagtcagtggggagtgaaggcaagcgaccgacatcgctattttctgttacggttaacgtacacagtgaaacaatggggtacacggaacaatgagtcacgaagacctgggtcctttctctgagctcggcaactcagggacccccccgaagtcgcttagccttctgggcttgttcagcttggggaggaaaaggggctgctccggaaccaacgaggctttggatggtggatcacactcagggtgtaaacttgtgcgtaccaagtcaagcttctggggaaagaaccttcatcagagtccctccaaaaaaagaagacgcgctggattaggcatccgcaaagttccgcctgcctctccgacgtcagggagctcccgcagtaggaggtttcttacgcctctaggaaggccggcgtgtgggcgggctctgccttcccttcctcactgagttgtgtgaaccgggaacggcggccgggccggctaatggctgcaggccgccgcggggtggccgcttgcactctgcctacccctcggggagggcggctggcagggcacagggcgctatctaccccccagccggcagccctgcgcctctgctctccgctttggggtcttgatccgccgcctcctcgctggcagttctcgtgactcggtgcgcgctcccgcgggaagtaaggtggcctggaccgcgcggctaccgctgagggccccaaaaagagagaagggagaccgcgcggggcgtcccaagtgtcccccattccatcccccacccaggtttctccggtgcgccgctcggcgaacctccgggagctacttactaaagaagaggcggtaattctgcgagcagggctggccgcgctcctcagtgtggtacagggccatagcacggcgcgacccggtccctgcactggtccccaaccgcaggcacgcagcggctggggcacccgtgcgcagcagccgcagcagcgcgctcatggcgtcaatgacggtcctgctgtgcgcgcggagctacctgggggctcggccgggccgcacgccggtgccccctaccgtccggagtcatccctcccgccccggcgctcgggctgcgatcctggtccctgccagtggaatctggaacaccagccagttgtgcgcactatgccctcagcgaggccgcagctcaaagacgagtgagacaagacccaccacccctgaagagctcactgccactcgttaattcatacatttattcatgccttcatttatcccgtcaagaattactatcatgattttttagtatagtgatgtaatattgagtgattactctgtgccaggaactgctctagaccctgtccaatataggagatgagcgcacatgcacgcaaagacatcactataagacaaaatgatcaggccaccacgtgaaaacgggacgttgacaccgacttacagagcaaaaaaccctaagtagcttactcaaatgccatcttctccataaggccatttcctaacccagtagagattatttattctttcttttattttattattttttgttgttgttttgtttttgagacggagtctcacactgttgcctgggctggaatgcaatggtacaatctcggctcactgcaacctccgcctcctgggttcaagctattctcctgccttagcctcctgagtaactgggattacaggcatgcgtcacgacgcctagctaatttttgtatttttagtagagacagtttccccatgttggtcagactggtctcgaactcccgacctccattgatccgcctgcgttggcctcccaaagtcctgggattacaggcgtgagccaccgcgcatcggccaggcggggtggcacacacgcctgtagttccagctacttgggaggctgagataggaggatggtttgggccagtatccaggagaatggatattgtagaacaaccagtagtctgccacgtgtcattttatttttttctagtccatcttctttgggactatcatcatctaggctactttcctactgggcacccaggttctttcagcatctccaattatcgtgtgatcattaaaattgagatactggtctacccaagttccagaaaggattcctaggagatattgtgactagctacttagagacactctactaagattatagatcctaaaatgtttttgtcaacagtggtacctttgtaatgtgtcaacttgaataggcataactataaggcaaatgctcccataaaaaggagagaaaatctcttctgtgcatatatcacagagttgtataatttttttgtttatgttgaaaaaaagcttaatttttctattaacttttgaagattagatatttaaataagacaaattcctatggaggcagggttgtaggctaatttctaatgatctgtggatacttaaagtatccaggctgggcgtggtggctcatgcttgtaattctagcactttgggaggccaaggtgggaggatcacttgatcccaggagtttgagaccagcagtctgggcaacatggtaaaacccatctccataaaaagtacaaaaatcggccaggcggggtggcacacgcctgtagttccagccacttgggaggctgagataggaggatggtttgagcctaagaggcggaggttgcagtgaagccaaaatcatgccattgcactccagcttctgcagcagagccacaccctgtttaaaaaaaaaaaaaagttatctattgagataatccagcataaagttctgaggtccctcttgctaatagcttttcttaactctggcaacatattttattagtaactgacaacaagttatatgcatcctgatttgaagaaaccaacaaagatactaaacgtttctgaatataaatgtttacttaaaatgaaatcttgacactaacttgttattttgtaaattgcattgtaaaatgttaccaagttatcatgcattcagaaaagaaaacgctgacttttgttaagtaggtttacatttatttttaatcacttaaatttccatctttcattctctacagtttactggaatatttgagaatcaaaattaaaaatgcataatataaatgataggaaataataataggtatcaggttagcttttaaaactttttaaaaatactctgagggtaatgtttattacataatgtttaattatgtacttattcaaatttagacgtttggagtctaacacgttggatttccattattgacatctcctgttgtcatcatatagcaagtaaaagtcttagtcccaggagtttacaagttggagaataaagacaaatacacataaaatcatgaaataacatttccagagtttatgaaataccaaaccaccagagattcatcaacagagaattgaaactggtggctcaggaaaactataactaatatgtaggaaggaccagaatagaaaataagagatacggtgtccaggtattgacagtatctcaggtaccaagtgacaaggacccagacagtagttctggcaatagaaatagaaaggaatgttgaatttggaagaaatgaccaaatttgatatctcactggaagttgtgaaatgaggatggaagagttaaaaaaaattatgcataataaataaccaagagatatgtggtgttattttcagatatatgttaataaaaatgagagagaaattttgacactaagatgataaacgtagctgggacatgttaagtttgaaacaatgcagagttcctgctggagatggaactattttcaccactggaattctctgagaagcagactctgagattgaatttagtatgtgtgtgcagtgtttattaggctgtacacttgggatcagtatgtgaagatgaaggtaagaaagcaaaagagctgagagagaagtcgagctgtggtgcaagcccaatagcctcagcccacctcatagaataccctggagtttaaaaggctagttacagttgtccaatggagagcacaatttgacgggcctttataacctcaatgattggatggatataagctgacctgggaaaggacatgatttggacaaggcagctatggccatccctgaagaagctgacagataaatgctatttgttacctgtactcccaacagttcagcaaaagttcattaagccatggcacatcacagtgactaccacaactgtgaaactgcagtaaagataatagttggaactagagaaaaattatataattagtgaattccagttctgtttctgtttttagtattggtaagcataacacaaaatctaccatgattatggttattgttttttgcaatgctagattatcctaatagaaaataaaataattttgaaattgtggagtactcatttatgtgtttacttttataaaagcagtaaatgtccctaaaacgaattattattattacctacaacatgataaataagcaaattaagaaatttgctaattgctcatctttgctcacaatagctagcttgtggggggaaagaaatagagcagtatgcaatagaagtaatgagaattttaaaacaattttgaatattttctaattaatcagttcagagacacacagactgatatttcactagcctttggaagactttaaccacaagggagactttaaaaataattttcacattaccaaacatttaaaatatttgtcaaattacaagatttccacaatatttcagaatgttacctaaagttcatgttcatccgatattcatcaaccacatttttttctaataaatacatgtcacagttctataccatttctcatttaaatactggcaattatctattgataaaattattttcacaattcaatgaaactataagagcttgactaactttaggccttaaaatgtgtataggtgtgtatgtgtgtgtgtatttttattgctgtagttaatttatttttcttactaaaacaatgatgcttcaagatgagaaaacatgtcatagactgaaagaaaatatttgcaaaatatgtgtctgataaaggactattatcaaaatatacaaagaactgttgaaactcaagaaaaagaaaactaaccaatttaaaaaataggcgaaaagccatcagcagtggactggacaaacaaaatgtagtacagctacaccatggaatactgtgcagccataaaaagaaggaaatcatgtcctttgcagcaacacagatggaaaccattatcctaaatcaattaatgcaggaacaataacaacaacaaaaacaaatactgcatgtcctcataagtgagagctaaacattgagtacacatggacataaagaagggaataacagacatcagcgcctctttgagagtggagagtggatgggaaggtgaaacccataaactacctatcaggcactatttcctgggtgatgaaataatctgtacacaaatccccatctcacacacacacacacacacacacacacacacacacagttttaatttgtgactgccaaaatttggtgcaaccaggatgtccttcattaggtgaatggataaactatggtacattcagacaatgaaatattattcagcactaaaaagaagtgagctattaagccatgaaaagacatgaataaaccttaaatttatattactaagtgaagaaaacaaatctaaaaggctacatactgtatgattccagctgtatgacattctggaaaaggtttaagtgtggagactgtagaagcctcagtggtttccaggggttagagaagagtgagggatggatagatggaacccagggaatttttaggacagtgaaactgctctgtatgatactctacttgtggatatatattattatacatttgtccaaatccacagaatgcagaacaccaaaaatgaaacctaatgtaaactaaggaatttgagtaataatgagttgtcaatgtaggtttgattataataaatgtactgctctggtggagaatgttgatagtaagggatggtgaggaggtgtgtgtagggtatggaaaataaaggaaatctctgtaccttctgtgcaattttattgcgaacctaaaaccactctaaaaagtaaagcctatttaaaaacaacaacaataaaaacaaactattataggaaatgacttgcattcagaaactatgaaccaatatgtagtattgataatttgatatagaaaagttttccttttcttttctcttgcattaactgtattttccataaacacattttcttttcatctaatgaaaatcattgttctattttaacttcctatctgaatgtcagggtggcattagtacctttacatgccccatttataacaggcatctgttcttaacctgaattgccattgcttgagcatcagtacacactgcctcttctgcagtcgtttgaaaaatcattaatcattttatgttaaatggaactaggctcccctgagggccttctatggatagttttactctttcagagattctaacatatctttctttattattattgagaaaaatttgtataattttatttttaagcaaatgtcctttctaattttcattttgtagactttaacctgtctccttcaccatccccacctctactaacttaatgaacaaagcttaaaacctcagaggtccttttatgaaaagtttctgaacacctaatttgaaatatcaaaattcttttttcaacataggcaactattaaatagcaactaattttagctcccaatttcaaggccacttaatataaataggctgagtttctgaatgaggcaatggttcactagtaatcattttctcatgtttcttagatctcatatattcctgacagatccatacctgtatgataatttagtaggatgtctttggtgaaagctctttaaaagactgctcaactcaaatattggaacatagttctaggtaccttaaatgaagaaaatacatatttggtatagtgaaaaagagatttctaatgggcctgatgcctctaaccacctggaagagagcaaatggtgggtctcaaactcaattttggtggttcaggcttaaaaatgcctaacagcaaacagtgaattttgttttatttttggaagtgacattatttcaagttattttcctgactttccactactagaagagtccctgagaacaaatacatttgttttaaagcaattcttaattagctgcttagaggaagatgctgtgagctgccaactctacaattctttcaacagtcagaagaagccttgacctaggatgaggccaggaacaaggctggagaaagcaaattggagagctgatgtgttcccgtacacctgttcctaaacccagaagccttaaaaactaagactcaggtgacaaatttcttattctaccatttcactcaccaaaaagtgacaagaggacaaatatcaagataattctttgaagagtttgtgtccatctggagggagggaacaaaaaaccttgtcacagctttttattttgatttgaagacagcttgtctggtggagctgaatgataggtatttggggagtgagagagactttgagaaaggaacagaaaagcttacaatggattttagggaagttttactgtatatggtaaaatgcagctcttttctaacactccctttgaagcctgcagagccttcaatattactcattagtgcttttggagttagtcttgtgttttcaggaagatgtaatatattgagactggcctccatgtggttcagatacatgagggttacatgcacatttaaacaatcacccataaactgtatgggcaaatacagaacttgcatttaattttaagaaataagcataaatcttcaaagaaatttaagattcaaggagtcattgggtcagagcccccaaagaggcatttttggaaattgtcagggtgtttctgatgtcacaataattgaggagcattatttctatttagtatgtagggaccagggatgcagcacaccctgtaatactcaaaagacagctctacacaagaaagagttgtgtgtgcacattgctctcagatgtcacatcagaaatttgtgtaggtgaaaaatgcctgttttttaaaaatatgtatctcagcctaaaaactgtcattttgcaaataaacaccaagtttttttttgcattgtttttatatgtgcatgctatttgagtcactaatactacatactatcgatctgcatttatagctctcagttcctggtggttgtacattgagatgcaaatgttaagattgctttatatgtctttatatgtctatttttctccatcataccttcttatattttttgtaacagcactattacagtttttaatcctatcaatagatttatgtgattgtttaatgtctgaatcctttactagattctaatcaccagaagggcagataagtttcccatttttttaatcattctgtatcagtcactatcattccccctgacacagtgcctacttagtgaagattagtcaaatgaatgaagggttgagtaaaagagggagggaaaacaagaatcttctttctaaaaacatatattttttttttgagatggagtgtcgctctgctgcccaggctggatggagtagagcggcacgatctcgactcactgcaagctccgcctcctgggttcacgccattctcctgcctcagcctcccgagtagctgggactacaggcgcccgccaccatgcccatctaatttttttgtatttttagtagatacgggtttcaccgtgttaaccaggatggtctcgatctcctgacctcgtgatccgcccgcctcggcctcccaaagtgctgggattacaggcatgagccaccgcgcccggccctaaaaaaataattttcaagcagaaaagacttctcagccaggtgcagtggctcacgcctgtaatcctagcactttgggattagctgtcttagtggtgcctgcctgtagtcccagctacctaggaggctgagcagggagaatcacttgaacccagcaggcagagattgcagtgagctgagatcataccatcgcaccccagtctgggtgacagagtgagaccgtgtctcaaaaaaaaaaaaaaaggaaaaggaaaagaaaaacttctcagctgctgagctcctaacccttctcatcacacgcatcatcaaccaaaattatgaaccattctacattatttctggggggccctgaaattcttttttggtgtgggcatgaggtctaatataaataaaacatgttcatattttcttgcaatgaattacataagatttattttaaggaattgcctttggaacccagggttcttttgaatccaatttgagatccattattccatgtaattagaatatgtataaaagagaaaaaaatagttctacagttaaaccatttaaaaacaaaattaattcccactgctgaaggcctaaaggggaaatctagaaaatgggcagagaaactgggttgtatcattagattttgttcaggacctattattaccaatttagtagctcaacccttgaattgaagtactatatttataatattacaagggatttatacggtatcatttggagctgaaatttctcatgattattttagcctagaagcagtaatactacttaatcaagtaaaacattctgtttttttcatgtcgtttaacaatgcatagtaaatcatatgtgattcttctatgacagataaattttatgtctaatttcatcaatatctagaaagactaaaagcttaagaccaaatatattcttcatgtcatttggacttagttgaaatcaacataattgtattctttcctatttccaaggagtatatgggcctcaggacatgagcttattttcacatagaaaaaatcaatcagaaaagaaaattctacatgacaaccactccttttatttttcagacaaggggtaataaaattaatttctcatttttcaaccaattaagtttctattctctaggtcagtctgtttcttggaccatttgtttcattgaaatttggatcaaaatttattttaaaataaggaggaaaaatgttgttagataagaagtaaaggatagtgctcacttcagcagcacatatactaaaattggaaagaagtaaaggatagatctctttaatcatgacagtcttaaagaggaatccaatgcaccaacatagttgctttttgttttgtttcatttgcatcaccctgcattattctcctatttagctctgcttaaccacttctgccaaggtattcctaagggcaaaggaaaaagaatgtatgccccttctgtttgctaggtgtttgtgattctgaggcagagtttcgggggtcagtgaacctggattttatttaaaagattacatttttattttcactaacttctaactaaaatatagcatttatgaatgtaggcaacaaaccctgtagcagtgttaatattatagtgcctatgatttgtgcctccaacagaaatggcatgtaatccagatgttgcagatgactctatcatttacacccatcactacttcaaaattatggtagttatacctgctgctagatctagtcatttaggtcctcagtgaagaagcatgttattagatcacaaaattattttctaaaatctttttgtaaatataattcaatatcatgagtttcttcttcatataatttatggatttacaaacggcattttgagaagggtttcataggcctaataaggctgcccatgggatgcatgaaacaaaagtcatcaagaaccataaagcagttattttcaaccttattagacctaactttctcctctttaaaaaattgaggtgaaattcacatcatatacaatcaactattttcgagtgtactatttagtggtacttagcatagtcacaatattgtacaactgccacttccttctagtttcaaaacattttcatcatcccagaagaatacctcatatcctttaagtaatcacttcctgttcccccctgccacccgctgaca

SEQ ID NO: 542 - DNA, 137907 bp, Homo sapiens
atccagatttccttggttcagactttcttggttctcatcacagccctttctttgttcctagcctgtgcctaagagacagtattcattaagggattctccctgcagtgacttaatctatatctctttttaaaaattatttttatgccaggtgcagtggctcacgcctataatcccagtaatttgggagaccaagacgggtggatcccttgagcctaggagtttgagaccagcctggacaaccttgtccctacaaaaaatttaaaaattagccaggcatgctggtgcacacctgtagtcccagatacttgggaggctgaggtggggggatcacttgagctcaggatgctgaggtttcagtgagctgtgatcgtgccactaggttccagggtggtagagtgagaccctgtctcaaaaaatgtacgtatttttttaaatcgttactttaggccaggcacggtgggtcatgcctgtaatcctagaacttcgggaggccgaggcaggcggatcacctgagctcaggagtttgagaccagcctgggcaacaaggcgaaaccccgtgtctactaaaagttcaaaaaattagccaggcgtgatggtgcatgcctgtaatctcagctactcaggaggctgaagcacaagaattgcttgaacccaggaggcagaggttgcagtgagccaagatggtgccattgcactccagcctgggcaacagagcaagactctaactcaaaataaaataaaaattaaaaatatatataaaataaaattgtcacttttaattactctgaaagtaatgtatgcttgttttagcaataccaaaaaaaaaaaaaagggaaattttagaaataaaaaacatccatatgatcctacagccttactgctgggtatatatccaaaagaaagaaaatcagtatatcacaggggcacctgcactgccatgtttgttgcagcatcgctcacaatagccaagaaatgaaatcaacctaagtgtcaatcagtggatgaatgactaaacaaaatgtaggacatatagacaatggaatattattcagccataagaaagaatagaaacctgtcatttgcagcaacatggatggaaccagaggtgattgtgttacgtgaaataagccaggcacagagagacaaataccatgtgatcttactcatgtgggaggtaaaaaaataatggatctcatggaggtagagaggagaatggtggttaccagaggctgggaagggaagatagggagagagggtggttaagggctgcaaaaatacagtcagaaggaataagttctagaattcaagagtacagtaggggaattgtagttaacaataatttattatatatttcaaagtagctggaagagaagaattgtaatgtttccaacacaaagaaaagatacatgctggaggtgataggtatcccagttactctgacctggtcattacacattgttaacaggcatcaaaatatcacatgtcccctccaaatatgcacaactattatatatcaattttaaaaaagaaaaactcatacccataccacccaatgatgacactgtggatatttggggagtgattcttcctatgatcattttatttctgattacacactgcctctttcacttatattttcattttatacatttataagtatttctgatggatatgtaatatttcactaggtatgtgggataatccctttggcattaaagtagtttccagtattttagaaccataaataaaacatgatgccctcaaaaagagtaagatagttagaaatgaagttatcaaggagagaaaagacttgcacactgcaaactatgaaatgttgctgaaagaaatggaagaatacaccaatcaatggaaaaacatctctcgtttatggtttggaagacttaatgttgttaagatgtcagtactgcccaaagcaatctacaaattcagtgcaatccctattaaaacttttacagcattcttttccagaaatagaaaagtttcatcctaagattcatagggaatatcaaagagataagcatagccaaaacaatcttgaaaaagaacaccaaagttggaggactcacacatcctgactttaaaacttacagcaaagctacagtaatcaagactgtgtagtactggcataaagatgagcccagaaacaaaccctcacataggtggtcaaacgagttttgacaaggtttcctagaccattcaatggggaaaacacagtcttttcaacaaatggtgttgggaaaactgggtactcacatgcaaaagaatgaagcgggacctggccgggcgcggtggctcacgcctggaatcccagcactttgggaggctgagacgggcggatcacaaggtcaggagatcgagaccatcctgaccaacatggtgaaaccccgtctgtattaaaaatacaaaattagctgggtgtgttggcacacacctgtagtaccagccactcgggaggctgaggcaggagaatcgcttgaacccaggaggcggagattgcagtgagccaagatcgcgccactgcacaccagccttgtgacagagcgagactctgtctcaaaaataaaaataaaaataaagaatgaagtgggacccttaccttcataacacatacaaagattagctcaaaatggatcaaacacctaaacctaagagtaaaactataatgtttgaggagaaaacataggagaaagatttcatgacattggatttgacagtgatttcttggctatgataccaaaagctcaggcgacaaaaataaaaatagatagattggactacataaaaatttaaaacatctctgcattaaagggcccagtcaacaagaaaaggcaggccacagaatgggaggagatatttgaaaaatcatataactgataaggagttaatatccagaatatctaaagaactcctacaactgagcaaaacagcttgattttttaaatgtgtgaaatacttaaatagacgtttctccaaagaatataatatctgcaaatgaccaataaatgcatgaaaagatcctcaacatctctgtcattaggaaaatgaaaatcaaaattacagtgagatacttcacacccactaggatggctactatttaaaaaaaaaaaaaaaaaaaaaaaggagcaaaggcaggcagatcacttgagctcaagagtttgagaccagcccggacaacgtggtgaaactccatctctactaaaaatacaaaaactagctggttgcatgtgcctgtggtcccagctactcgggaggctgaggtgagaggattgcttgagcccagagggtcaaggctgcagtgagccaagatcatgccactacactccagcctgggtgacagagcaagaccctccctgtctctaacaataaaaatagtgctcgcttcagcagcacataaactaaaattggaatgatacagagattagcacagcccctgcgcaaggatgacatgcaaattcgtgaagcagttgcatatttttaataaatggcgttgggaaaactggatattcatatgcagaatggaactagacctctctttctcactatatacaaaaatcaaatcaaagtggattaaagaaatctaagaccttggccgggcgcagtggctcacatctgtaatcccagcactttgggaggccaaggcaggtggatcacgaggtcaggcgattgagaccatcctggctaacacggtgaaaccctgtccctactaaaaatacaaaaaatcagccgggcgtggtggcgggcacctgtagtcccagcaacttgggaggctgaggcagcagaatcacttgaacccgggaggtggaggttgcagcgagcagacatcgcaccactgcacttgcactccagcctggacagcagagcaagactccatctcaaaaaaaaaaaaaaatctaagacctcagactgtgacactactacaagaaaacaatggggaaaatctgcaggacattggtcttggcaaaaattccttgagcaataccccacaagcacaggcaactaaagcaaacagggacaaatgggatcacatcaggctaaaaagcttctgcacagcaaaggatacaatcaataaagtgaagagacgacccacagaatgggagaaaatacttgcaaactactcatctgacaagggattaataaccagaatatataaggagctcaaacaactctataggaaaaaaaactaataatccgatcacaagatgggcaaaagatttgagtagacatttctcagaagacagacaaatggcaaacaggcctatgaaaaggtgctcaacatcattgatcattagagaaatgcaaatcaaaactacaatgagataccatctcataccagttaaaatggcttatccaaaagacaagcaataactaatgctggagaggatgtggggaaaagggaaccctcgtacactgttgttaggaatgtaaattagtacaaccactataaagaacagtttggatgttgcttaaaaaactaaaaattgagctaccatatattcagcagtcccactgctgggtacataccacaaagaaagaaaatgagtatatcaaagagatatctgcactcctatgtttgttgcagcattgttgacaatagctaaggtttggaagcaacctaagtgtccatcaacagatgaatgaataaaaaatatatatatatacacaatagagtactattcagccatgaaaaagaaagatccagtcatctgcagcaacatggatggaactggagatctttatgttaagtgaaataagccaagcacagaaagacaaacatcacatgttctcacatattcatgggatctaaaaatcaaaacaattgaactcatggacatagagagtagaagaatggttaccagagactgggaagggtagtagtgggggttggcgggggggatggtcaatgggtacaaaaaaagttagaataaataagacccacttgatagcacaacagggtgactatagtcaacaataacttaattgtacattttaaaataacactaagaatgtaattggattgtttgtaactcaaaggataaacgcttgaggggatgaataccccattcccattctccatgatgagcttatttcacattggatgcctgtatcaagacatctcttgtgtctcttaaatatatatacctactatgtacccataaaaattaaaaataagttttaaaaaataagtgttaatgtcctcgtggagaaattggaactattgttgtgcactgttttttgttttttagggtctgtttgtttgagatggagtctcgccctgtcacccaggctggagtgcagtgatgtgatcttggctcactgcagcctgcctcggcctcctgagtagctgggcctacaggcacgcaccaccaggcccagctaatttttgtattttcagtaaagatggggtttcgccatgttggccaggctggtctcaaactcttgacctcaagtgatctgcctgcctcagcctcccaaagaaagcgctgggattacaggtgtgagccaccacacccggccctgtgcactgtcagtgggaatgtgaaatggtgcagccactgtggaaaacagtatggcagttcttccaaatattacacatataccttgaaactgtgtatcgctattatgcatcaattaaaaataatagaatgggaaaaaaataaaaatagaactgccatatgatccagcaatttcacttgttggatatacacccaaaagaattgaaaacagaggcatgagcagatacttgtagccccatgttcatggcaacattattcacaagtgacaaaaggtggaagcaacccaaatgtccgtaaacagggaagagtgaataaacaacttcagtgtatgccaatggaatatcattcagccctttgaaggtaggaaattttggcacttgctacaacatggatgaatcttgcggacattatgctgagtgaaataagccagtcccaaaaggacaaacgctgtaagatctccttatgtgaagtacccagagtagacaagttcatagagactgaaagtagagtgatggttgccagcactggaaggagggagaatggaaagttactgtttaatggggacagagtgtcagttttgcaaggtgaagagttcggtggatggatggtggtgagggttgcaagacactgtgaatgtgcttaatgccacagaactgtatgctgaaaacagttaagatggtacattttgtgttgatgtatattttagcacaatttttatttttatttttttgtttttattttaccttaagttctgggatacatgtgtagaacgtgcaggtttgttgcataggtatacatgtgtcatggtggtttgctgcacctatcaacccgtcatctaggttttaagccctgcatgcattagatatttgtccaaatgctctcccaccccctgtcccccaccccccgacaggtcctggtgtgtgatgttcccctccctgtgtccatgtgttctcattattcacctcccacttctcagtgaaatcatttagtgtttggttttctgttcctgtgttactttgctgagaatgatggcttccagtttcatccatgtccctacaaaagacatgaactcattcttttttatggctgcatagtattccatggtacatatgtgccacattttctttatccattctgtcattgatgggcatttgggttggttccaagtctttgctattgtaaatagtggcacaatttttagacaattgttttttaatcaattataatattattaactccttgtatttatagcatttatatttccttttgcttgcttttggagagaacatacagaaatttgtgattttaagatcgggcatggtggctcatgcctgcaatctcagcactttgggaggctgaggctggaggatcacttgagcccaggagttaaaagactattctgggcaacatagtagagacctcatctctactgaaaatgaaaaaaatgagcagttgtggtgattcaagcctgcggtcccagctctgcaggaggctgaggcaggaggatcacttgggcccaggaggccgaggctgcagtgagcagagatcataccacttccctccagcctgggtgacagagcaggaccctgcctccaaaaaaacaaaccacagaaatttgtcatttttaatatgagcgctattcctgaggggtttgttcagaggtatttacatgttatttttttgcttgagaattgattattcactttccctttcttctaaaagttatagggatttgggggggtggttttgattgatttttatttaactgtttaagccacgtcaaattttattctggtatgatgttaagacttaaattgacttttttctgcatatagttaatcagttgtctgccccaagattgccaagcaattatctaattcttccccttccactgatttgagatatactctttattatattacatttatgtcaacatatttctcagtttggggctgtggcttctgttccattaatctgccttttttgccccatcacactgtcattaattcatacagctttatagttggtaggacttgcctttctcattagtagtgttctcattcttcttgttcttttattttttgcaggtgaactttagaatacttttgctaagtacctggaaaaatagaggcccacctgaattttaattggaaatactttaaacctgtagatcagtttggggggaaattatcagcatagctgcagtatttatatttttatatttccaattcagaagtacaccttacctttattcaagtcttcttttcttccctcatattatttgtttatttatttctatcttagagtctgttttatcaatgatggccagatcagccttgggttctttaaagaactacttacatgcatagggtttcaaaagagtgtggggtaaatcactaataaaggcaagatcctttgatctgagatcattaggaaaaatacatcaaaaagtgtcttcactgtttctttgactcctattccgtatattatatataaagctcttaggagcctttcccccttatttctgtattcccactcatcagcacagttgtaggataggcacattttttcatcttatctcgtatgaaatattaaatcattggagggcaggtctctgtctccttaaagcccagatcttcaataagcatctgctcctgggctccttcctgagcccctgaacgcctcgttcctaattgtgtctgagttcatctggcatcactcagaggaggaggaggaggaggaggctggggtgtggggcagtgagagtcatcaacactgcttcctagtggtcgttggtgatcggtggccatcccctccagacagacaacccacaggtcagcagtgaaggcttagaggcaggagggcagctaagatctaaattcctcttacccaactgaaagcacgtgctctttaaaaaaaaaattaattctgctgttcagatagcagcaaagtcagagcaggtgtgaggccggcagcctgctcaggtggtgcgtgcccactgcccacttgtgttagaaatcacatcatctcctggccggccatggaatccagcactgtctgtcagctctggggaaagagggggaagggtgggatttggtttgcttttatctatttattttagttgctattgatacacacaataaaagctacattcttgtgagggaggacttgattagcagccctgaagggcggtagcagttcccttactcattgaatgtatctggcgctaaaccctcagctggaactgcgagccctagctgtatttcaggtgtttcttactctactgtgaattatgtttaggaactaaagggcttttgtatccttcacaagtggggggaagagagcaggggaattgtgtgagaaactattaaaaatgaggagccatggtttggacaaacttccttgttggtgtgaagaaaggaggaatttttttcagttccacctgccgaagaggcttttcttatagttcgttttcatttggaactactaataacactcatttttgtagggaatcatctcaccgcaccccctcatgggatcctgcaatactccatccaattcagaaataatgtttttctccttggaatagctttttacattaactgtatttgaagatagaaaatttagatctgaatagcagcttttaatagccccataaaaataagtgaaaatatctttaattttaaatttaaacaaaatatctaaaacttaaaaggtatttaatatgtcagcatatttgcaatacaaaaataaacatgctccatttcatttttttgctttcttactcccacggccaggtgatataaatatttcaatttgtgtcactttctagctatcgaatttataaagcggctttcattttctacgtaagtttttaagcttaattttttcagggaaaaaatagatctcaagaaaaaaagtgtttgggatcataagttaataactcatcctattggtaagggaagttgaataagagtccaaactaatggattagaattgtgtaatatttgcttaaccatttgttaaaaaaaaaaaacaaaaaaaaaacactgggttgccagaatcctacctaagatgcagatattaattagaactagcaagtcgaagttgcacaggtgggtataaaatgaatttgggatccctcactgggaaatgctaaagttcacacagacatatacacacacttttttttttttttttttttttttttggtggctccctcgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgaggtaagttattgtgtgtttcactgaatcggaaccttccgtgggtagttaataaatggctattgtgcttcagataagaaaagcaggaagtcctttctagcagaattcaccccatttcgctgcagacttaaccagaggaggttgggtgtgtcactgcagtttggcattttacgaactacttacagaatttgaggcttgaaagaggccttgcatgcatagttcaaagctggtttttctgctttctgctcgctctcccatccccctttcaaagctgtgctgatgtcaaaggatgtgaagtcactgcccagggaaggtattgggtgggggtaggaaggagaggcgggcctgtcgcgcctggccaagttgttcgtacgcagagtttctgttacatatgtgtggcttaatgctgcaaaggttttgtcgaggacacatctcagaattaaagatgaattgcagtcagaaaatatgcacaattgattggaaaagaacttcctttaaaaggattgttttcattcttgccgtggagcctgagagagaaatatgctccactttgaaatattgaaatctatcgtgggtcatcatttttgaaatgttagcgttttcgtggaatattaggaaatattttgcatttaaataggctctgtgttgccagttggcttttaaaattttaaatggcaacaagttttcaaggtatatagagatcactgttttaataattagtttgcttctttttatgcatattttggtttcaaaacttagcctaaaagcacaactactctagtaattaatagcggttatattgaactacaggcatcagggtagtagcctacttattcttggtattttaagatatatgaatttttttttggtcataattgggtgaaatagaaaaatgattttaagcttcatcagatcactttagaatttatagtatcagagctgtgccccaacaaaactgtttctcagaatctcttttaaggaagggtgggagcaagatttctaggtgactaataatctctatgactaaaacgccaggccagacttttcagatcctagggtgtacccaggcacatgcagactcaatctactggaataaaatgggtggtgcttttctctccaaactatctttcatgaaggtggaaatcagcattcaatgaccaaattgtaggacaggctgtgaatttattgtttttgtagtgcacccagtaaaaagcaaaggttgcctacaggtaacattcaggtattttagctgcaagaaccaaatgggcaagaacaaaatgtaattgtttggatttaagttagatagcttttgtttgttttttgggagacagggtctcactcttgtcacccaggctggagtacagtggtatgatcacagctcactgcagcctccacctcccgagctcaggtgattctcccacctcagtttcttgagtagctgagacttcaggcacgcaccaccatgcccagctaattttttaatattttttgtagagatggggttttgccatgttgccctggttggtcttgaactcctgggctcaagcgatcctcccacctccgcctcccaaagtgctaagattacaggtaagagccactgtacctggccaagttagttcttaaaaacgaactagttagcagtaagataaattaactgcatataaaatgtaaatttttatacttttaaggtatccacttataaataacataaatctttttggtttgtgttttctggtttttattagatgcctaatatactactcagtttttgaattatgaacttattctgaaatagaatcatttcacgttgtgtcttgaaccacattgattttttttttaaaattccaagaccttattatggccagtttgtatttgttgctgttggttgggtggttggttgcttgctgtataattgtggagggaaaaagcagtgaagtgtattagcctgaaagagacttgagtttttaagaagggataactttggagacctaagactaacttctgactcaaacagtgggggtaatttctaacttcaaaatttgaagaacgcttgatttactcataaagacttttctggagcgagcatgttaatgtgagatttagcaaaatttgatttatttattgggccttagagtcttagcttaacatccattgagcagctccggtgtgccaagtgctgagcgtcattacagtgattaagttgcagcccctgtcccaaaggagcgaatggagagacccagcataggagctctgccacgagagggctaaagcaagaacacaccggcagggtgcccgggagagcaggggctggtgtcaggagcagaaggaaccaaggagggctgcaccctgggctaccctgctcactcggatggggtgggcatgcgctgtccttcccgtttatttaggaaggaggggtctttcccactgaaggagaaataacttacccaaggtcacacagcctggaagtggtggagccagaatccaaacccagactgttgtgttgttttgttttggatctttttaaaaaaatcattttaaaataggaatgttggctgcttgaagaacattttgctacaggattacagtagtggtattttccccaatgccttaccatttatttggctcggtagcctctttttgtataacagttttgtaccttgggctcatttattaatcattttacaaatatttattgatccataccacatgccaggcagggttctaatgtggatatgagcaggggctatggcccagctttcccagtttaccatccatcagggtggggaccaagtaagtaagtaaggaaaatgatcacctgatttgttgtcacgatcgctttgaccattattgtctaccaagtagtctggactttgcgattaaaatggtgaatttgcacatcctaataagtttgagtgtgaaagggacatatttttgagagttagtgtaagcccttctgtctgtagaaggagagtcacctggaacttgatggctgtgaatgtagcttggtgacataaatcctcactctcagctgtgtccaggagaactgtctgctgtggtggaaatgttctgtgctgtcctctgcagcagcccctggtcacctgcgactgctgagcacttaacatatacagctgagaaagtgaatttttaactgtagttattgtaaatttaagtggacacacctgtcttgtggctaggatattggacagcacagtcgtagactggaattgttcgacttttttggaaaaggaccagattgtaagtagctttggctttgtgggtgaaagcagccatagacagtaaatgaataggcataactgtggtccaataaagctttattgacaaacaggtgacaggctggatttggcccatggaccatagttcaccaactctgttctagactgttctttgactttcggaattgcctgttaaggataggaaagcatgtttcctgcaggccttcagtctagtgcctcctccctgtgctgggaagctgggccagccgtgatgctgtgaggcgtggtgggtgggcccacttcccaccctgcagcgcatgctcacttcaggagccaggtttaaggcagtgacagccaagccggaaagatggtaatggccagagaggaagcacacagtttgagccttttccagctggcccttattctgggcttcaagaatgttattaactgctctcatcttgttctagtcattagcaaacttatccagtggatgagtctgtccttgaaagactcaggagtagctccagcctggtgggatgttggagaacaaaccattcttttgatgtaaacccattttttcttgggaagtggaagtctaatggaaaagtttattttctcacaagtacttcctgagtcaccaatttgttgaaggtcttcacctttccaataaaaactcattaaaaaacatgcaagaagcaagcacagaactcaaacccatggctttcatttcctgctgcgctaaatctggtgacttaacctatattaataataacaatagctatacataatgcacatgggttgctaaattagtaacacacctgcatggtgtgaagtcagtaagtactagtgagaatgggtgccccctgttatctttattccctaaaattaggaaggaaaaatgtttgaatgatgactaaacagttcttcaaataattaaaccagtgatcctctgaacagtgcctcagctcaagatttttacttcacaaacatctctttactatgtaactgcagctctctgcaaagtgactttatagaactacagccttaaccttacccatatcctatcctgtatccaatcctgtatcctaggtgtgaagttgtttctttcgtattcctggtggtgtggaaggtaaccaaagtaacagataactctctgaggaaacaggggtgggtatgtttgtgtaaagtctgtacacctttttgttccttaaacacacacacatttatgctcataaacacactctcatccacctccctcatccatacgctctcaatctcagaggcaaaaacaaaagcttaccatccagcttgggtctaatgtctgctcaggaggttttgccttgcagcaaaagctatcttctaaaattttctcattaaagtatgttgtgtagaggaatgaaagaaaaatagaggtaaggttattagtcaagaatagggtgtgtgtttttaaacccaggaaaagaatagacagaaacacaaagacaaagtggtttgggatacatcctaacttttggttccatatgtcaaataaaattgcgaggtggttctttttggatcctacagcactttgccaattgtgacaagctgttgtgaacactcatgtacttcttcctcacagcactcctgcctggcaggtgagcaggacaatcctagtatttctcctccccaaggtcacccagcctagagggtccagtccagggctgttggcagcaccaagtacgaggtcccgaagctgctgctggtggctgtcccagaggagaagcagcatacgttgagtgccttcagtgtgctaggtcacagctgaaaccctgtacctctgttctctctctgaatctgcccaacactgtgaggcattataaccctcccccactcactaccgcccctgccttttttgtccccccgggagaaaaaagggagcctcttgcccagggccacagagaatgtagtgaaacaagatttgagcctcagtcagtctgatagcaaagctcatgttctttgctctgcagacatcagagtgttgagagatgctggtgaaagctcccacctcataggtactttttgatttttactgttttctgtacagtggtaatggatttgagtgtctggagttcaaaactcatttcagggttgaataggagtttgttaaaggtttacatgcgtatgttcttggtgtgcagggagaaagttgataatcttacctgctgtcccagttcacttaccaaatctgccagctagtaactgttgacttacctcctccacaaaatcaggagtatcccgaggacagtcctgttgaacttgttctctggtgacactgagcattattcctagagtagaggcatcagttagtgtcagtggattaaaaattaaaagttatctctgagtgatcactcaggaaatagctatctactatatttcttttttgagttggagtctcgctttgtcacccaggctggggtgcagtggcgtgatctcggctcactgcaacctctgcctcccaggttcaagcgattctcctgcgtcagcctcccgagtagctgggattacaggtgcatgccaccacgcccggctattttttgtatttttagtatagacagggtttcaccgtgatggccaggctgctctcgaactcctgacctcaagtgatccgcccgccttggcctcccaaagtactgggattgtaggcatgagccaccacacccggcctatctgatgtatttcttagctaaatacctcatcagtggaatgagaagctcatgagaagctgtactttatttttctttcaatcctctatacgctgtagttaacgtatttcaatgaaaaacatataggagatggcttttgctgcaaggcaaaaacctgctgagcagacgttatacccaagtgcaagagtaagactaccaaaaaggtgacagactttacacaaggcggctggttgaaagagcgacacaggtgcccactccactctaggccttgctcaggcgctgtttccgctccctgtcacactggaaataggaccgccaagtggtctaaacgtgggataaatcatttctctcactcacatcttggaaagacgctggctaaaatgcatgggggaaaccagtactcccacagcaggtagaagtctggctttatttgaggcccttgaattacacataaatcaaaaactcttctagtttaaaaaagaaaaaagactaaagagatataacaggtaccgtgagtgaatctagatcagatccttgttctaaaaagtgtgaaatcaaacctattagagacattttgaaggcagctggagaaagtggagtgcagaatgatgttggatgtgtggaattactgcgaactttctaggtgtaaaaaggtgtccaacttttgtaagggacttttcttattcttagggaatgcagaatgaagtattaataagtgaaggatcgtgatctctgcaactttaaatggtaaagagaaaagtgggtaaaaagcaaatatgtcaaagcatgaacagttgttgaatctagctgaggggatatacaatatacaattattcattgaaattctatggagattttaactttttcataatgtttgagagaaataaatatatatatttatttatatatatattatatatatattatataaatatatatataatatatatatttatataatatatataatataaaaatattatatatgtatatatattttttttttttgagatggagtcttgctctgttgccaggctggagtgcagtggagcaatctcagctcactgcagcctccgcctcctgggttcaagcaattccactgcctcagcctctcaagtagctgggactacaggcacccaccgccacaaccagctaatattttgtattttaatagagatagggtttcaccatgttgaccaggattgtctcgatctcctgacctcgtgttccacccgcctcggcctcccaaagtgctgggattacaggcgtgagccactgccccaggatgagaaatatatttttaaaaaataaggctgtttcgctctcttatcatttcaatattctctggtgaaggaaatatctttaaaaagggtctgctttggaaaaaatgtacaaagaaaatgtaataacttagctactgtttcctaagccatgagcagtggcctttcatatttgagtctttgccagccagtgttggtcctctggttgtaactcacagtagctgcacagacggccacaccatctgacaaaacagcgtttttggggtgcataaccgtttttgatgtttattggcatttttattggtcttttggagtgtaactgcctttgagccacactagaagataagataaaaccaaagtttcctccgcactttaagaggcagggtgtttggtggctgagggtaggacctggagccacacgccagggtcagatcaccccccatcccccaccccgcccaccccaggcaagctgaactgtctagggcatgtgactcactctctgtttctagaaatggaacgtgaaatgggaataataatacaacctacctctttggggttttttgaaagttaagtgaatgcacataaagaacttaaaatggcgcctggagtgtcgtgagactcagtgctcatggtgtctgtggttgtctctttcgtaggtcacgtatggtactctagggccccgccacttagccataatctgttttctttttctccagctgtattatctgtatttgttcatctcaaagctcatctgtctctctctctctcttttacccagccttttcatctcttgcagtttgcttggcatttcaccatttggaagaaattagtatcatcagtacctctggagtttgcactatgctctgcttatagattgtgtatagttacctgctaagatggtcctaagcacatgtccacggcctcagttcagagtatacttaatgctccctattcagtctttctgttcccgtgctccagtccgtgaagtctagagtaaaataagaaattggcatttatatacatctcccctcctcatctttaactcttttgaagaagagagttttagtatcacattcataagaaatttcatctttaaaagttggtattacaggcgcagtgcctcacacctgtaataccagcactttgggaggccaaggtgggcagatcacctgaggtcaggagttcaagaccagcctggccaacatggtgaaaccccatctctactaaaaatacaaaaattagccagcgtggtggcgggtgcctgtaatcccagctactagggaggttgaggcaggagaatcacttaaacctggagacggaggttgcagtgagccgagatcacgccactgcacaccagcctgggcagcagagtgagactctgtctcaaaaaaaaaaaaaaaagtgagcaatatctgtggttaatctcaaatagggtggctttccgtgtcatttccctttagttgtttttaaatgcagatgttgctttaattaaataatatttgaaataagtggggtcccaactataaccttatatcttattgtttttaaatgttgatattttggtgttttcagtagaatttgagctgttaacagtgattaggttttttcagtttgtcatcgatgtatgtgacctcgttataatacacatggatttttgtctgctggttgtgttactcatgagcaatgtgttctaattatggtattttaacttataacttatgaaaaagttatgtttcactctagggaacaagtcctgaagaaccctcaagccctaaagtaccacctccacttcttcctgagttgctggttcttatttttggtgggcttcaaggaagaggtgggtggtgagggtgtctgtatatgtgtgtttacatttgtagacagtttctgtacatgtataattaggaatgggttgtcggttttggtttttttcccagctttatgtaattggtcagacttctcaaaggggggtagcacttgataatcgctctcttggaactctgaagcctttgcatggagcagtgttcaccctgggcagcctgtggcccctggggtcacagagctgctttccagggggtttgcaaggccgtcactgcctcataagattaccaagatctaatttacctctcactgtgtggacgtttgccctggtggtgcaaaggcaatggtgaggaatatggcgcctttctttcatcgagcaggacagcggtgttcagctagcaacacaccagtctgacccaagaatgtcctcgataaagcatgaagttactggttttttaagtctcaactcttttgtatacctttttaattttgtttttgtttgggtttgtttttagttttgtttttgtttgggtttgtttttagttttgtttttgtttgggtttgtttttgtttggttttttggttgctcaggctggagtgcaatggcgcaatcacagctcactgcagcctcaacctccccagctcgagcattccgcccaccgcagcatcctgtgtagctgggactacaggcaagcaccaccacacccagcgtggttttttgttgttgttgttttggtagagctggggtctcactgggttgctcaggctggtctcaaacccctgggctcaaatgatcctcctgctttggcctcccagagtgctgggattagaggcgtgagccaccgcacccagcctcctttttaattttgcgtgacgaaatgcagagttcacatgaagccgttctagcatgctggagtgtgatggccgtctcgaagaaaagcgcccatgtgatgtgtgagttatgagccaaaatagccactttttccaggaactttaaattatgagaatagtaatgtaaaatcatttttacttgacagaacaaaaagcagacaaactgtggatattaagacttaaatatttggctgatattttctagaaaatctatgaagtgagcttatcaattgaggggaaaacaactgcgacactgtttttggcccatggtaaaatttgagctttcaagaaaaatttgaactttggagaacttttatctgccagtgtaaatgtggcagctcccagtgccacagactcttctgctgagaggggtggtgacattagcaagtggggtttcttgatgtatacggtggaaggtcacacaccacatgcagcagtgtgttctcagtgaccaacgaacgatgctacaaacaagcgtgggtgaagagccaccaaagtgtaagacacactgccgggtgttcatgtaactgacaggttcatcaacatggtttcagattcctcattgcaactaatctttaaggaactatcacttgttgaattttagcataggcaaagaagaacatcggcaattttttgagaagcattgaaacctcccttttcccaccagacgtgtctgtctgagcctggggtgtttctttacatatacttgaaccagaatagcatatcacagcaagttgaacacagaagcatgtcggcagatccgcctgtcttctgttgagtattgaagaaacatgcaaaaatgtacaacatggccattttctcgctggtttctttttgaaaataaggttattttcataaaatattacttaacatgaagtgaacctattgctaatttaatgaataagtaaatatttttaaaattttcaagtatggtcagtatcaatggatataacccccataatcaaagctctttagggttctccatactttctaagaatgtaaataggtcttgacaccaaaaaaatggaaaacacgtggacttggaagtttttctcgaatgggctggatgtgaccctgaccctgtttttaccaagcctccttggttttttccctcttttctctaaaaaaaaaaataaaataaaaataaaaataaaaaaaaattaagtagtcagtggaatcatctaaactggtctctgggaccatgagagctgagagcatccggagcccacctaaccctgagccttcctcttgccttggtcagtttccttctttgtttttcaaatctttttttaaaagccattttcaagtaatcaattaatatgtgaatacggccccatttacattttttcttcattgcaaataaaactgaaattttccctaaccttatcccctgagattggtctaccatccccacatctcaaagtgactgctgcctggagtttgctgtgtgtcattccagaccattttctccctgtggggggtgggtgggtgggtgtgtgtgtgtgtgtgtgtgtgtgtgtgtgtatttatccacataaataatataaatatgtatttattcacagagtatatagcattttttgtttcatttctttaaaaaattgacatgagagcagttttagtaacaaaaaccttttatacgtttttaggatcttggtggcgctctcggttcataatgctctgagttggtgttacgtcatattatcctgtattgtactgtgtatacatacgttacgtaaatgcttaatgtggtctcgcatgtttttctgtgaatttggcttaaactttcagactaggcatctaggaggtggcggcaagtggaaggtggagctgtcacagacactcggcccccgcagcctgtgcataggtgctctaggctaattttacaggtgtgatgaccgggccagagtgaaaccatgttgtctgattttagaacagaggtcacttatgcttcaccaagctgctggaaatgtggaattttgtttctcaattattggacctggtcctgaggagatgtttccctttagagaacatcattgacgcttttaagagtattttactagatgttgaaaacgttgaggtcttattaatgtagtgaccccaccaccaccaccccctgccccccccccacacacacacatcccttgctaaattattacatcaaatcatacaggaatctggcgctatcagagccagggttaaggcctaatagtgtcactagttactgagcttcttgattaagtcaccttactttcctgaatctccaaataagttacattaaaaatgcatctgattaaattacttattttagagggaattggaagaattctgtgattggcgttccgatctaatcccccaaagagaaaaacacgaacgagaatgaacacatttctccttttatattattcttagttaagagaaatgctctgccaggagaaaacttaaatgactatccaatgggtagggttttttaaaagaatctaaccaattcagatactttttctttttacacagtcacaaatgatgttatgttgatgtgtttttatgacttactcttaaacaacatttaaatttaagccaaagttaaagttgtgattttgggaaatttttttacttatccttcctctcttcccgacttccttcccttaagaaccccattcttattttctcatttatatcctggctgaggctatcaggtattgaaactggccttttgaagacatataaacttctggggactgacttttctcattcaaatagtctaatatcagtggatatgaattctgcatttttttacttctaaatcttatgcgtcatttaaatgttaactttcaaaatattaatcttgaattttcacatttttgtgtgagttggaattattatccaattaaatgaacataaattatactgcctacatagattggaaaaatatcttttggtgggccgtgtgtgtatatgcacccatgtgtttatgtaaaaccaaacatcaacttacaaaaaccagttcagtcttatagccttgtatagtgtaacatacgggctgagacatttgcttatttgagccttttcaccctttatttgtaaaaaggaggagagcctttaagtgaaatgtaaactaaacttggaacccctaaaacgattttgaacactacttgacatttaaatgtttattaaaaataaagcaaagtttaagaagcatgtttggtaaagagttctttggcaggaaatggggacctatcagccaagctaatagccttagctatggcatccatagtaactaagacacgctgccgatgtaaatatttatgccagcaagcagtgctgcagaacccgggccgagcagttcagagcagtgaaattaaagcatcagccgccaatgtttgatttattttgtattatccggtattccaagcattaccatcattcatctcttctagggtttttcaaaatagtttagccctaagaacaagaatcctagaagaccagtttactcggagtaattcggtaccctctcccccacagcatgatagatacccaaatgagaatagagaggctgttattgtttgtcattagcaccctggaacctttttcatcttcaaagctcctcgcaaaagggttcattaaccgtcgccctctttcctgtgagagagtaaacaagtatgattagtcctactttgacagcggtggaaactgaagcagagaggttctccaacttgtctgaggtccaagaaggagctggtgacagagaccagataccggaccagcacttgggttttctgactcacggttctgggctcacccctctctgagcatgcactgagcctgctcttgcaggtttctttatcacagggatctatctacacggtactttctgctctcagctttttacagtggtgtagagtgcagtgcagctgaaaccaggttagttgatcttatggtgtcatctagaaaaacaagagatgcagattctgggtcacgaaggtaaggttgtacttttagggtttgtggttatggatgaaattaacttatctgagccttacattgtctcactaggcacagtgcccacttgttccgtggcacagccccagagctcctgttgaaggaacagactccaggactgactttccacttgattttcggagctcgcacatcccgagagattcatgttcaagctgcattttagacatagctggcaagagtattttcgtggtaaacgtaaacttactattggtaaagattcttaatgagtaattcttaggatttagtacaaaattagatatattctttttattcgtaatgatatagcatgaagttcttgcggggtaggagagagaggtattcatctgaaaactggctctgttttagtgtagacatttgtctacggggaaacagtaggaaagcatcaagaaatatttcttgatgtgtacaattgaagtgatgtttacaatgtagtgaaaaaaaaacctatgcacgcatgttcctgattttaataaagctctgcaaagatttccttcctcattctttgcttttgattcagcatatgtgctgttgctaagttaagtgttggtaaccctgtgtcctttgttgggccaaacaaggttaaaattaagacgaaaaaaatttctgagttcatttcaaatggaaggacaacatgatacctaacacagaagagaacaaatttagttttgactttctgccctatgtccacctaaagctgtatttcactcactcactaatatttagaaatcacccacttggtggttggctctgtgcttagtgctaagaactggtcgtgttataggtgctgtgggtgcgtgtctgcgctggcttcaggaggagggagcaggccctgtggggcccagcaaggcctcccaggagaagcagtgtgttagctgaagtttaatgaactaattggtggtcctgggatgcagttgggaagatgggatgattcagcctgttggggtatgtgttgggggtggttgttgcactgtggtgagaaaattcctggaaaagggtgtatgtcaaaagggtgtaagtagcatccctttatgactgatgaaaggagagcagccgagagcagttaagtggaaggcaagacgcagcagtggcttctcacgccatcttcgtcactacacaaggggaagttgggctaagaataaatttgttttggttccaggatgaaactcaagagatacagaagaaactgaaagtgatacttttggcagagggataggataagagggttttcagcgtgtgtgtgtgtgtgtgtgtgtgtgtgtgtgtgtgtgttgatgaatttattacttattaaaaaaatgtaaagaaggcatagcattaaaagtgggagacatatactgataatggaatccgggcattgctatctttctgtgtcttagaagttactgctatgattttagccacttaactggctagaacagttttgaaaggccaagatcatgggtttaagatttgagacttggccaaaaggtagctttcctagtccttatcgtagagtgcacgctcccagcttttgcccagcctatttggggtgcacacgctcatcgatgagggcaacagaacacagcatgcaggcggaactgtgcaggtcagtcaccactccacctcctagccagggtgtcactccaattccatcattcaggtttcactgaactttcatgttggcatttcatttagttgaatgaaccagttttgttgtatttcagatattctcactgtgtagttagcctgttcagtttttgtaggtgaatggtaaagctgtcaaaaccagatctgctgaaaaccaaaatgttcagtgtcatcttcagcagaggggattatcagaaacttctggggcagtaagggaaatttaagaaggaagttggggaaggtaggacctcatggctttggtttttctggtggtccaagagaggaggcctctagagaattgagggggaacaataagtgacaagcatgaagaatgaagagggaactgaccaaggatcggtgagaataggaggtggcccagagggcatggtcagatgtggctatcacagctgtcacagcaaagtctttatgtactccgagaaccaagcctttatcatatatatgttttgcagatatttttctcatactgtgggttgtctttttcactgtcttgatggtatcatttgcagcacacgtttttaatttagaggaagaccagtttatcttgatttgttttctgtctcctatgcttatggtgtcatagctatgaaaccattgttgaatccagacttactcttacacattcttctaagagttttttaatatgaattctcttacatttggtctttgttccatttcatgttagtttttatatagggtgtgaggtaagggtccaacttcctttatttgcatgtgaatatccagttttcccagaaccatttgttgaaaaaacaattatttccctcattgaatggatttggcacacttgttgaaagtcaatggaccataaaagggtttatttctggattctctattccattggtctgtatgtctgtccttatgtctgtaccacactgtcttgattactgtagctctgttgtaagctttaaaatcaggaagtgtgaactctcctactttgttctttttttcaaaattgttttggtattttgggtcccttttggtatattgggtccattttattcaatgatgtaatgatatgtgtgtttccatatgaattttaggatcagcttagcaatgttccttgtctctttcttctaattctgtagcctttcctgggttagaatcagttagactaggactaggacagtgctccctggaatctgcccagtagctgctctgactgtgagcagagaacctgtgggcatctgggcacttagtctgaaatggtccataaggaacccctaaaatgtttaagtttctgaaatccctggttgtattgtaaaaagctatttgaatttagtattctgtttcatgattattatacttaagtgtaaaaatgtttaacttttttttttttttttttttttttgagacggagtcttgctctgtcgcccaggctggagtgcagtggggtgatctcggctcactgcagcctctgcctcccaggttcaagcgattcttgtgtctcagcctcccgagtatctaggattacaggtgtgtgccaccacaccctgctaatttttgtatttttagtagacacagagttccgccatcttggccaggctggtctcaaactcctgacctgaagtgatctgcccgccttgacctcccaaagtgctgggattacaggcttgagccactacacccagccttgtttaacatttttcagctgcatggaaaactgatattctaggatgtatattgcatttatcatttatcctgtggctttatgcaccctccagaatgcataccccagcataaaaggccaagttagggagaaacctgcctgctggagttcttagatttataaatcttgtttccttaactgtctgccctctgacctctccagaccacagccagcagaggagaactaatgggcagagacaacactgatctgctgccatctgcactgggcaagatggcctcacctgactcacagctgttgctttctctcgcgaagcttctaccattttctgctgattcttaaaatagatttggatcttgtcaattttggtcgtcaaaaagattgaacttttacaggatgaaatccattattttcctaaattatctcgttttgggaaatcagttctcggccataagtgcaggctcaggtgtgctaaggagggcaccccagacacctgtgctgctctttgacaggacttacctgtcaaaggcgaaaataagggtgatgtcatgtgagttttccattaagctaaatttattccatgtacaggactatcttttattctgaaattgtcttcttgttccctataacctcatattggaagtgagatactgtctttttgggtattaaaatgtcttttttgtaggatcttttttttactgatcttatttgtatgttaggatgatagcccagtgtcagtcctcaggattctttatgaaatgttcctagtctgtgaaattctaactctacaatttcagtttagaccacaaatcccagatttttaccttgtttacatttgtagttaccacataatattgcaaatgatttatgtaacctcaaagcccatttttttattcttttcatgtaaaatgtccagaataggcaaatccatagagacagaaagcagattagaggttgccaggggctgcggggagggaggaagggggagtagttacttacagggatggggagttcttctaggatcatgaaaaaggtttgaaactcgacagagggctgattgcacaacattgtaaatgcactaaatgcccctgaagtgtacttgaagtggttcattgtatgttatatgaattttccatttttttgaaaagcccattttattcagtgatataatgatatataagaagacctgaaggtgtagggggagtgtcgtattcagaggatatacatcaaggcaaggatactctgtatgcttgtacacacacacaaatacatatacacaaagaacatacctattattaatttctgtttctaagtatgatcattagaagctgattaggtaaataaactttctgctttgggacaagcagaaagatttaattaacacttaactgaaattcacagatactcttttttttttttttttttttagacagtgtctcactctgcctcccaggctggagtacagtgacacgatctcggctcactgcaacctccgcctcctgggttcaagcaattctcttacctcagcctcccgagcaactgagactacaggcgtgtgctaccatgcctggttaattttttgtatttttaatagagacggggtttcattatgctggccaggctgttctcaaattcctggcctcaagtgatccacccgcctcggcttctcaaagtgctgagagtacaggcgcaagccaccgtgcccagcctcaaaagatattctttttcttacctcaaaaactatgttttccaacttttcacagtggaaagttgaagtcgtgaaaatatcctcaggataaatctgaatcgtgtttcttttattgctgagtctggttggcgtgttcctggtatttagtggaactctggtcaacacaggctgaagttagtggggttctctctgtggggttctaaccttgaaataggagcatggggcttgccttccccttctccattcctccaagaaagagaaaggaaaggaagagaaaagaaaaagcatcctgtattatgtgtaagtttgtaagaatccttactatgagttctgagtacaacatctttttaactcttttctctccctctcctgcttccttcttcaatctccagctaccattcatttcctgatttcatttataggtcttaccaggcaagaaggccaagcagaaggaacctacatcagggaagtgctgggctacgggccccacctggacttggggttctgggcagcctgaacacaggtttcttagtttcctgaagtaattgagcttgttgccttaacttcagttaaaacactgatcgtgctttacttttaactgagcattgagacctcttataatattccataaggctggatattgttttgaggaagacgatttttcctcttaaccttgcctctgtgtttgtgtgtgtgtttggtcggtgtttagacagttttccatgcatggaccctgattacagcgggagcaggcaacgtgaggtgcccgcaatcagacatccagctccacatggtggcctccctgcccccagctcatccttacgcagtgccttcaaattgagtgtcttcaaaggtgctgcttagtctcactttggttgttgtgtcgctgtcgtatttttcttttttcgcagtattgaaatgttcactcctagggaccgaacactggttttagtgtccatagtggcaaaaaaaaaaattttttttcaaaacttgtttctatttggtcctctgtgacccaagttgttgcttagctttcctgcctagtaagagccagaaacgagattaggacgtgaatggtattttctgaaccctcagagtgtgtacaataccattttgtaaagaaaagcatctatattcaaggtagatctaaataattcctagaaatgccaaattgttctcccattcatttttcaagacaaatatgttctaatccataggagagtgagaatttccaagttcattaattcgggttcctgttaccaactcatgttttacagcccatatgaagttttgtttcactgaaacctttgattatcacaagtagaacttgggaactctacactgctgtctccagacaagacacagagtttcacttacattaacaaaggatgatccattcagaactgtaaacaaatgctacattgtgcccttggtggttgtgacccgattcagtcctgctttgaggctgaggacagccaagtgttggcccaaatcagcataaatcagagcaacagaaaatccacccgaggtggggccctggattggacgtgctttggacagcaggtccacagcctgcacctgaatgaatcctgaggcgggcttctgactctgctctaaacactcatcctgaagtgtatctggatcattttaagtaccactctagcagtggtacttagttacaattaatataaacatgtcattccattaaaagaaacctgcagcttctgttaagttgggtcaaatataagatactggggtttaaagatgtaaatagaaaattcagtttcatccagcaaggaatacagagaagcagcaatagagcctgccagccctcggggagcttgcagtctaagagaacacaaatatgtataatttaaagtaaaatggaagtgtcactaagcgggtgagaggatgcaaagattgccttcagttagagtgataagtaagttaccgtcacggcagcatttgcaggtattggagctttattgtaagtttcttcattcagcaaatacttccgagcacttttgtgtctgatcctgttatagctggtggaaaattatagactaacaacccatgtgcaaatgacaacatcgtgtggcatgtgcagggctggcagctacatggggacattaacagagcccagcagaagggcacctcactccacacctggggagaaaagaggtgtgctgagttttgtttatttttttatttgcacttgttttaccataaatgaaatatgacccttcttaatatgttatctgtgatatgttggcatggatatcttaatgtataaaacatgcttatatttatatatgacattatgtttatttttggctacatccagaaaagaatttgataaggcttaaactattaaaacatgtgcaacaggctattaaaggaaacaaaataactagaagccagttaggaggactagttcagcttttgaatggagctattcaacagtttcagaaattttttttacgctactaatgggccagtgggcatagcatctttttaagcttccttccagtttgtggtactaaaaccattgcagatgcataaaggaagatgcttatcatcctgtctgagttgtaagatgggacacaactccttatcatagtacattccttaaataagtacaagaattacagttgacccttgaacgtcacaagtttgaactgcacaggtccacttatatgtggatttttttcaaccaaatgcagattgcaaatgcacaagattcgagacctatgtatacagagggccaacttttcatacgcacgggttctgcgggccgactgtgggacttgaatatgcgtggatttgggtaagcgtggtggtcctagaagcaatccccaacatggaccactgtagtctgttacttacattggctttaaagttgagtttaacttgtccaaagacattgttatttaagcagcaatattatgatacagctttgaaggcaaaacttaaaaaagaacccatggatagccttggaaccatggaaagattctaaccctgagcttctaaatagtattgcatttgtagaaccaaagactagcaggggatcagcaaaggctgagagcaagtggtctgtatgtcctcataatgaaaaggagcagaacagaacaacagaggtaaagtgattttcttgctcctcattcaggtaatcattggagatttgttcagcaataatagtcaacatagaaatctacagtgtaggccaaatagaggatttcttgttatcttctttcttcgtactgtgggatagatagcccaggattcctccaagtgtggcaagtgcacaccactgctaacggcagttattttaagtgattcagagttgagtattattttactttaataattatatattgatgaatgtgaaaatatataattagcacatcaaatccatggtttcttgggttattattgcttaggacagggcttagtaaaaagtgtatccatttaaagcaaaataccaagtaaataagagcctgactgtacacagatttgtgacgatcttgaaggtgttcatgcaggactgaagtacgggaaaccccagggtgggcgactctgggttccacctggggaatctgttccgaagacaccttcccatctctttcttgggttacaagcagtggagacacacttgggcttgcatagatgaagacaagtgtttttaaggcacagtcacagagggactccacacagaggagcagggtggagcgggactgtggaggcagaagggtccagactccagcagcgtgagtgacccctctgtgtcctcatccaccccgccactcccagtctttgcgtgtcatgccccttcttccccgcgctttaccgtgtaatttctctgcatgctcttctgcatttactcagtaacataatacagttagcagttgtgggacctccagcaagtattgaactgttgagtggctgttcttcatttggaaaatgggagtgataacagtttctctctcacaggacagttgtggatagtcagggaggttgcagtgtgaacactaggcacagcatctgaaacgtgctggaatcagtcatgtccacactggcagtgattagatctgcctgattcttcccatgttccgtctagtgagaagtcgtcagtagcttcagttttcaggaggaaaactttgacttggtcaaaactttgtccttgatcaagttgtttactctcacgccaagccgccctggagtgtggtccaggaaaaacatgggcgcctaggtccgcccctcggccagccgtggccagaggtcactggtgctgctgttcacatggccggtgtcagggttttaattcgaggtggagcttcccagccgttctggtaatgaggagtcttgcctgatatgtcttggccagctctgattggtcaaatgtttgaagaagatagggttaccaaagattcctagactctccaagtttggcagaagttgttagaggatcacacagttacctaaaatgattggtttaattatatggtttgatcattcttcagaaaccaccaccttgggtaaaccattgttcttaattttcccttcattttttgctctcattgtctggccccaaagacacacccccttgcgattttgtaaaggatgcatttcattgagaggacacagtatgagggagcagcacatggacctaaacttgacttccaccacccccagccagatgaattgctgagtcagttcactgttccaaaactgttttctcaaggcattatggtaacaggccatgtgaaattccctaacatgactaggggttttcacttcccagctttattcaatccaagggtttttttggcattttttgtttttaagacggagtctcgctctgtcacccaggctggagtgcagtggcgcgatctcagctcactgcaacctctgcctccagggttcaagtgattctcctgccacagcctcccatgtagctgggattacaggcacccgccacctgccaccacgctcggctaatttttgtatttttgtagagatggggtttcaccgtgttggccaggctggtctcaaaactcctgacctcaagtgatccacctgcctcagcctcccaaagtgctgggattacaagcgtcagccaccacacccggcctgaatcagttttgacattgtctcttcctctgggtggcaaatgtgatccattcaagacagattatatcccatgtgaagagtcaccctgagaatttgagcagggtgtgctgtgtggttacttggactccagacccttgtctgcagaactggtgggaccttgactgggtccggttctcctgtctgcacatgcaggccatggaggtgctgaggttgcagcagtgacggcagcactgagggtcagcttcagggggaccctcttcaagccaaacaaaaagtcttctcaaaaaatggaactaaagatggtcccttgatgtggcgtctcagtacggctgctgaggtatctcacaaggccaccagcaagttaatctaaggaggcattttcctcttgtgatcaggcagctgttccagcagaaatggctcaaggagaaattctcctcccagattcagtgtctggtgggtgaaacttcactggtgcgttgccagccctggcctccaaatctctttaaattatgaggtcatagaatgcatgcttaaagccccaggcctgtcaagtcgcttggggacattcatactgaggatttattaagatattaatttggttatcaggagtctggatggggatgagaggaggggatctttattacatgctgggaaaatcagaaatcaactctaattgactacctctactctttcctctcccaagatgactttgccaaaaagctgtgagaaaaagtcctcaaatctcagagattgacttggtacttgattatatccagctcgctggtgggcctgtggccacagagcctcagaagaaggttagaaggtctggccagactttagctttgctccacctacttggcagggtcaagcctacttgccagtggcttggagaagtgttttgttttgttttgtttactttttaggagtgtattcaaagcacattcacagtaaggaaaaaaaaaatgcagcctgtgtcttcagggactgggagtctctgattccagcacagccgactgtccagcaaccccagaattggtaggctggacactgggctgctcctcatggcggtgggagcatgggctgctcagctggggccatccaaggaagcaaagatgtggtgctgtcctgtggctgggggagcaggatgaattgggataagggaagcccagggcagggtgttggcacagagctgggaggtgcattacaccgaggaactgacgtggcctaaactccacagtgacttccacctgggatcacagtttacagtcagctgagtgctcaagagaactcagtagaggggaatgttgatgattcaggtatttggttggtgatcatgttatcaagtcagacttgcagttaaggtagtgtcccagacgtttgttcagagggctccttcccacttgtcatctgtaatactggctaatgggaaacctggcccatgtcaaatttgtattaggaaccattgatttcaattcacgggctttttccattgaggaatttaaaggtcttagaagtaatattcttgttaaggcatctgaggtctcccgggggacagacacagtcttcatcttgagcaggaacggtgagaccactcttctccctgtaagggaccagtagcatgtgtgggaccacgccgcctgcacagccgtcccctcacggggtgcctcttgcccttgcagatcaccaggtgctccgagctgccctgcctgggctcaggcatcagcacggtcccatctgagcgtcgccttaacctctctgtagacctctgtccttgtctatctaatggggatgatggtagcccctctgtgtgttcttactaggattagtgggctgggaaaagttacagtaatatattaccagcatgtagaaaatacccaataatgatgaactattagtattccttaaaagaattaaaagtgaaaatagtaggaaacactagtaagataaaatacaatgggaaattaaatttttttaattacttaaggaaattcctcaatccacaagcaacaataaataagaaactgagatttcctagcagctgaaaggtttttttttttgcagttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaatgcctggggtgttgcatgcatttttctaggctagcaaagcttaaagattatttctataatttcagttacatttacctttatagatgggttactctaagtaacaaattaaacacacatggatcttctaactttggctttaaatcctaagaagagataggtaatatataaaagagtattaaaaagaaatggagagtaaaggtatatgtcgggcagatgcagtagaaaagcaagggtcatgacgtcaatgctgggcaaagctaaattgtgaagacaaaacaataatgaaacagggttattcatcacgctaaagcgtacagtccataggatgatataactaccatgaatttggcctaaatgattgaacattgaaacacataaagcgagaactgtaggggattaaagacaaaatcagtgagtgcagtgctggtgggagaggcgcctggacttcttggcccctcacaggtcatgtggtagacataagttgttattactgtgagccagtagagactttcaggtttgatggctggaaaacaaatgctcattttataagtttttttttgttttgtgttttgttttgttttgtttttgagacggagtttcactcttgttgcccaggctggagtgcagtggtgcgatctcggctcaccgcaacctccgccccttgggttcaagcgattctcctgcctcagcctcccaagtagctgggattacagtcatgcaccaccacgcccagctcattttgtatttttttttagtagagatggggtttctccatgtcagtcaggctagtcctcaactcccgatctcaggtgatccgcccacctcagcctcccaaagtgctgggattacaggcgtgagccaccgtgcccgaccctcatggtataagtttttaaacttaatatatactagcttacagaggaaaccgatgtgatttccaaaaatttgaaataattagaaaccttattctcacattataatgcaataaaaatagaaataaacacacaggcggaaaccaggcatccctgggagtcccttggggcagagaagagcttcgtcgctcaagcaaaacttccatggaggcgaggactgtgggctttgttggaagctttatctccaacctctagaacacgagcactaagtagattctgaacaaatcttattaaatgaataagagctaataatcctaataaatatgttgaaagcactattctaagcatgtacatttattatgtcactcactcctcacagtccctgttcgaaggaggtgctgtcctcatccgcatttcacagatgggggaatgggaagggtaggctcagtcacttgccccagaattgacagctggcaagtgggagactgagattcaggctgggctgtcggacttggccgtgttctcatgtgcagaaccaccattgcctccaaattaatgaaaaaatgagataaggtaatggcttagagttaatgtgtaaagattgttattaaataagaatcaaaagaagtgatttaaacactaaagaggtagcaaagaaccaaagtaagttgaagaattactgtgttctttaaagacaaaagcagaaatgaatcaactaagaaaaagagagaatgaaaccaaagaacaggttttggaagggggcagacagcgatgaagcggggagagtaaagacaagtagacctggagccggtgtggtggaaaaaggagagaaatcatagcgtgtaagaagtagtaatcgtcgaaggaaggtgaatgcaagcgtcttgtgaatctgaaaatggcattttgtaaaattcactttccattcctgatttgtagtttgtttgcttatttgttaactttcttaaataatttcaaaagcatggaaaagttgcaagaatgatataaagaatttaatcaaaatttcacccatttgtcaatattttgccacatttgctgcacatttctctcatatgctctatatgttgtaacgagcaggcggtcttcccagcccctcctttaccttcagggccctggcctcacttcttgtccccctcgccccaggaggctgtgaaaagcaaagcactgtgcctcccaggcacatgatcttctcagaaaggaggagccccagggaaggaggaggcagcccctggcacacagcctatcctttgagggttgtgttgtcctttcttcttggttgtataaatcttcactattttggctgggcatggtggctcatgcctgtaatcccagcactctgggaggccaaggcaggcggattgcttgatgtcaggagtttgagaccagcctggccaacatggtgaaaccccgtctctactaaaaatacaaaaattagctgggtgtggtggtgggcgcctgttatcccagctactcaggaggctgaggcaggagaatcacttgaacctgggaggcagaggttgcagtgagccgagattgcaccactgaactccagcctgggcgacagagcaagactctgtctcaaattagaaaagaaaaaaaaaaaaaaagccgggtgcggtggctcatgcctgtaatcccagcacttgggaggctgaggcaggtggatcatctgaggtcagaagttcgagaccagcctagccaacatggtgaaatcccatttctgctaaaaatacaaaattagccgggagtggtggcacatgcctgtaatcccagctgctcaggaggctgaggcaggagaatcacttgaacccgggaggcggacgttgcagtaagccaagatcgcaccactgcactccaacctaggcaacggagcaagactctgtctccaaaaaaaaaaaagaacactcatttccagagtcaagttacgtgaccacaggtggcacagggcctgtgagaacagcctgcgacgacttcctgccagtcctcttcttccccatctgtgcccctactccacaggcacctgtggacaccctgacctgagctggtgaggcttcaccagtgcacgcctggctgcttccctgcctgccctccggccctgtgatcccatgtcctggaaagtgtaaactctttacaaaattccctgtcgttttagtgaggtttcagaagagagtagactcagataaatgtattccatcctccatctgtaatcataaagtaaaacattatttgtgatgtaatgcttttaaagaacaccatgagaaccctgacttgatttattgaatcgtagcacacatgtccagtgaaatttcaaacagttgacaatggcattacctatttgttggcatgtgagacatgctggacacgggggtgtgggtagagaacagaggagcccatgaagcctggctctcagtggtgcgctcgtccgcacacactcggagatgccagcagtgttctctctgggttggcctttcctgtgttgtttggatttttttttttctattttacagtgagcatgtattatttttctgaaaagaaaattcttcaaaaataagttatacatgtttacatatcacattagccattgaatactaagttgtttcatgtaaagaccagtggtcactatacacagagcgaaagatttcatttataggtttttatatggtccttcttgtagtgcccaccttgtaccttattttcctggattaaaaaacatacatatcacattattcttttctctgttcctgtttagagaccctgttgtattttcattttttccccctctctgggatttgctgctggcactcaagttcctgaaagaagcattctctcatagtctcaaaagagtcagaaagaacctcatttttcaggtgtagaaactgaggcccaaaaaggtcaagcagctggtcacggctagttaatagcagccagcgtctcttgcctttttcgtccgcttgctgctttctggtttttatcttcttacccatgtgagcttccagcaccacctgctccccccaccaccaaaaaaaaaaaaaaaaaaaaaaaaaaagctccactccaccggtcttttataacctatcaaactttaaggatatttttccattcaaatctagttatgccacagattgataatactaagatgtttgtgaactcaccaaacagattggcccccccatgacctagtgggtacatctgtagtaattggatttggggttcattcagcctctttcaaccaacatttaagtagttcctattgcactgccctgttacaagatcaagaacagcaaagcactattgctgtgctgtttatcagggcatatgcataattgtgttatgcagaaccagacattgtcaaattgagattccgcctttcatttggtacaaatttagttgctgagtgcagtgcattagaggcctgcttggacatgcctggagaggatgaaaatgttgcttccgttggttgcttccattagttgcttctgttaccatcaggagagtaacaagattgagttatagatgctggtaagtcacttgatacatcattaacaaaaaacaaaaacaacatttattgaggacatgctatatttcagggatttttctaagcactgtacatctcttaattcacatcaaccccagtaaagacaatattcccattttccagttgagaaaactgaggcccaaagagatcgttttctgcccagggtcactaaggtagtcagaggtggagttgggactccagctgggctttctgcctgagttcttaacacctttgttttactgctgcttcctgtcttcgaggctttacagatatttgctaaatgaaggattcagagttagaaatgaagggggcgactgtgcctagtaatggcctcagagtgctgtgccttgagtgtttttagtttagctataaaacttggaccatagggagcaagtcctaggaagtactgtgtacagaaaagtagactctagaggacagcctgtggaggtttccccaaatgccaccacctctcagatcacccaactgagcttccacattgaaagacacggggccggctcgttccgtgtccagacagacactttcactctgtgcctccggagatgaggctccctgctgagcggtcagtcctcacctgaggaggtggggcgaggaaagggggttgcccacggtcactgtggtgttggtgttctttttgaaacgaaaccttccagtcgcagacacaaaagccgtagagagtaaggcagaggatcggccatgcttctgggaggcaggggaggggagcacctgtcaaaggggaccctttgaggccaactggggcagtggggccaggtcagggagcagggctccagggccaggtggacagccaggaggctggagtcgtgcagtccctcacaggctgccctaggcttagtctggaaggtggggagcgcctcctccttcagagaccactgagctctcagctccccatggagcttcttggcacctgatttctagtgccaccttttgcggctcctgtggagagtccagctcacggaggccccccagagccctcgttatacctgcaggttccccccaccaaaccctgctgtgtcaggaaaacagaagttcagtggcagcgcagacttatgggtagagaagggtcccctgtctttcaacacttacccaaacactagaatgttactcatttccatgaataataaaaatatcaaatctttaggtgacgtatcttctccagtggaaaaatgaaccttttagctggtaaacctcttgaataaccggccagccatattacagtcgtgttacttagggagtgtgatatgatgggccctttgagaaagcgatcgaaagccaaggtttccgggtgcagcctgccccctcaagtccccactgaaacaggaggagagggcaggagcgcccgtgggctctcagtggctacgttgcttgttggtttgctttcctgcctggtgagcggccactggagcatcctgaggaaaggggagtgaggagcaagctggggttcggccccaaccggggtgctctgcgtgcactcatcagggtccccacccaggtgtgctggtgacaggcatgagggtactgtactggggagctgtgagtcaccacctgaggggcgcctgcttctatcccagaatcatcctccaggtcatgcatctatgtccagcccttcccaggtgtggtcagtcccctgagagcagcgtggccgtggtgcctgctcacacctggcatgggtagaccagccttagctcgggagggcatggatgggagtgatgtgtcttttttcttttttttttttttttactttattaaaatactgagttttatttcgcatgtattttttttatctccccaccatttccgtgtctgatcaccgctactactatgtcctatcatacttacttaaaaccatacatacttaaaaccaagcagagagtggagttccatctttaataactaaacaggcattttgggctgggcacagtggctcacacctgtaatcccagcactttggtaggccagaggggaaagattgattgagcccaggagttcaagaccaacctgggcaacacagcaagactctgtcttctacaaaaaaataaaaagattagccaggagtggtggcatgtgcctgtggttctaactgcttgggaggctggggtgggaggatcgcttgagcccaggaagttgaggctacagtgagctgtgatcacaccactgcactcccgcctgggtgacagagcaagaccctatctaaaacaaactggcatttgggaacaacatattcttggcaatggaacctggacagcattgatcaaacatggtagggaaagttctcattctgcattataaaaaggactgccagatatcaactgttagagatacgaaataagatggaacatttttaactgtttattttcttaaagagacttcctgccctgccagagatcttgaatagccccctagtcagtcatccagaagccattcacataattgattttcttggcttccactctgaaaagagaaccaccttttgctatacttggctgcatgtttgctttaatgtcttctgcagaactaggttcttctggtgttttaggagtattttcctattttttgaaggattcctgaccttttcttgacattggtgacttggagtcttttccattctggtttgattgttgtgcatgattgggtagagtatctcgtatagatttcttcactggagatttgtcttcagtttccttatcatcatcatcatcatcttcagcaacagcaaattttacttttttctgtggaaccttgctgccacctccagggggagatcgctttccagatattctgaagagtttcacatcctcctgtctctgactctgcatcttcctccccagctactaagtgccatccattgatacacacgggccctgaaccacacttcacccacaacgccacaggtggtggtatttcatagcccaagggaagcccttggctgtacagatgttttcaaagccatcagtgttaccgtaatcggactaccttcatcattcattgcctctgcttcaacaatgcacaattcatcctttgcccctacgatcattcttaaagatagctagtgctcattttcatcatcatccatcttaaagtgattatctgtttttggtgttttttttgttttttttttttttttgagttgatggccaggtgaggtggaggccagaacgcaaagtaggttaataccaataccaggtaactaattcgaatcttagagagtggaacggtgggtatttgacaagttcgaggaggctggcagcttgcgggaggggccggagcggtctggcactggtttctctctgtctcacctccccagagattggacacacacgtgcacacagttctgatatcgtggtttctggcacgtgacatggtacccgtgttgctctgtggccctgatcccccggctgcccctgcaaggctggagctccggcagcaccgcagggcccggtaggtcctggcacacaggccgcatgctcattgggttgtgtctgtcaccgaccctccctgctgtcatccccgggctggacgtcatttgaaggaagagccaagtttcagcaagagttcgtgtctagaaggaagcacttgaacctcctctgtctgagacatggagaaaggaagtagagaacataaaaagggcctggaaaagtgtgtgtattttcagtgtatctttttcacacctctacactgctttgtctgctggtaaacatattgaaggttctggaatcaatttcaagatggaattgaaaagaacttattacatcttcttgtcaaatgttaagagctgttacttttcctgagacagtacctgcctttgttctttggataaatgagctactgcattgttggagcttcttgtcaccaggtgcagtaatattgttaacattcagtatttcaccagtcatgctagtgaaagtggaagatgaagcgataacgggctgcacgaagggtgttgagcatttagtaatcagtgccctgggtgcctgttctccccaaggctttctagaactagagtcctatgtgggaaatatggcctgtatctggaaataatgctgtgctggatttatatctttatccctaggagtttgtttgacctgtctcaacctttccctgtttaaaaaaaaaaaaaaattgaatcttccaattcagctaacaccgttgaattcctcttgttgcctgcagccggagtgaaggttcattctgaatgtgcatgtgtgtccacaggagattttacagctgaggaacctgaggctgagaataatttcatgactttaccatgttctgatttggcagagtctgaaccgggagtcagtttgttcttccatatgactccctttactgaaaaattcactgaagagcttttccgaggaaagcagcctctcctggcctttgcctatttcagcctgacttctctccatccggggcgcctctccactccactccaccccacccttccccacccattccctggtagaagctgccagtcttcatgggcggaaagcatgaatgaactagaatttagcttcaaccactgccttttgaaatgaaaaatatctgccttattaaattatactgttaatttcatgagaaagggatgatggggttggtggtagaaagttgtgggggaagtgaatactacccctttcttcatatgcaaataaaaccaggctaacaaatcagaaaaacccaaagggtttaaggtaggagcagctcaggtttgtgagggaaccccagcttggtcctggggttagcagatcttcctctccaggaaagataatgtaaccttggtacatgtgtacaacaaagctggataaaccacagcattggaacgttatggtggactgtgagccatgggttgtctctatccaaacatgtaaacgagtgtcagtgtagaaactgcagaccagccccacgttaccaaatttatacccaaatgaagtgtacctggcggtactgttcattttgcccgaaatccacccacacggagtggaaagatggtttcagcatccctggtgacaggaagggctgtgcaccacctctccgggtttctcatggagccccgccaaacagacctagctacaggcagccacatgctggaaccgggaacacttagagtgggcacattgaagccagcttgcttcaactccttcacattgggtggtacagacagacccggagggaggcggggacattggctacatttgaatgaaataacatccatttagaaacctgagcagaggcacatgtgtgcagggaagctaagataccatatctcatcacacctaaggcactgttcattgtagtccaaaccatttttaaagaattaccaaaaaaagaaaaaggaaagtgaaagatgtaacttgattttagagacattaatatgaaaaatgtatgtattagaatggataaaataagacacttgcactttgaaattaagaaggatttattgtaaatttcagaagtcatctaccgagttacaaacagtacgagaagattaacccaattttgaagttatgtaggtgctaagggtcagggtagaagttagtcttgacattttgtagatatatagaagtatttcattgttatgtttattgagctttcaagttgtagaagcttggatttatagagtaagagatccttgttaccaaaaatgagggctggcaggcctgtaccggggaaggcagagcttgtgtgtcgggtttgcctggaagagggctgagggctgggttcatgggctgtagctaagggccttctcttctgaaggagaactgcctacctctggcttcttggtttcagttcacccatgtctctcctgaacagagatcaagttggatcgctcatctgcttaaaaatcctctgattcaaatctctcttcccacagaactttttagatttttctatcaaagcacctctgactgcagagattccacagaagagaaatgcctactaagagcagtttctttgaagacctgagttttatcttaaaagtttatgtagatgttgcattctactctgatacaggtggcgttattttgatataaatatatttcaaacggtacctctcagttaaattacctgagtttgttttcctcagatggatctgttcattcagcagacatctgtggtcccactatgtgctggccagttttagatgctgaggataaaaatggtaaaaagacaaagttctcctctgagaaaatttataattaagcatccagtatgattaatgtagggtatataaattattatcaattgttctcgttttgaagatactgtcttttgaggaaaattgattttccaggagaatgcagcctgattaatatctcctgtaacttcaggcccctgtgattgacaagtgagtgcctctagacagtctccccatttagtgcagccttcagtgccttcccagcaactgcagcctctcctcagctgtggttcctgttctccctgagccttcatccgcatgtctcccagcagaattcatcacctcccatattctggtagttttcttttagatcagatactgtcttttaatgtatctatcatcagtgcctagcacagtgcctggcgtgtatgtatgggatgcgtttgcgaaatacttcctagtgatgcaggctgtgtcctcatggttggggctgctctttttttttttttttttttcctgagacggagtctctatcgcgaggctggagtgtggtggcgtgatctcagctcactgcaacctccgcctcctgggttcaagcgattctcctgcctcagcctcccgagtaactgggactacaggcacatgccaccacacccagctaatttttgtatttttagtagagacggggtttcaccatgttggccaggatggtctcaatctcttgacttcatgatctgccctcctcggccttccaaagtgctgggattactgcgccactgtgcccggcatgagccaggcatgagccactgcgcccggccttgagactttagttcttatatcccaattgctccccacccatgctttagatctgataagcatgtcataccacagtttttattttatccatttgcaagcataattactgatctttcttttaagagagaatctttatataaatagaaaaaaattagagatcacctagatccttatcttaattgggaaagtttttcaatcaaaaaattagaagcttaaattcttcagcatgacacactatgtagaggaacgttagaaagtgtgttggggggccgggcgtggtggcttatacctgtaatcccagcactttgggaggccaaggcaggcggatcacaaggtcaggggttcgagaccagcctggccaatgtggtgaaaccccatctctactaaaaatacaaaaattagccaggcgtggtggcgagcacctatagtcccagctactcaggaggctgaggcaggagaatcgcttgaacccaggaggcggaggttgcagtaagccgagagccaagatcacgccactgcactccagcctgggcaacagagcgagactctgtctcaaaaaaaaaaaagaaagaaagaaagaaactgttgggatttcgtgagtgcgagtatgtcttctggtctcaggtagatccaggtgagtttagaggtcgtcggtgttgacgcatctaaaaccacgcaggaaacggctgacaatcgtgcagccgaatgtacccctggagcagcccagggacaccccgattggcaacagcgggagttgggagaagagagggaggccagagggtgggtgtgtggaaggagactcacgtctcactaggttctttccattttcattttttagccatatgcatgtatctttagcctttgttatttgaaatataactcacatacagaagcatatgaaacaaatgtgtagtgaataattataaagcaaatacccacataaccaccattcaggctgggcaccctaaaagccccctgtaagtcttttatagttttagggattcctgtttcttcctataaatgaaattatactgaataaatcctccttatctgcccctttgatgcaacagtattttgtaaggcatatccatattgtgtatagctgtatttcattcatctctatcgctttggaatgttacatagactgcatttgcatttacctaatccaccactgatgggcatttggttgtttctagtctgagctgttaggacgttgtgctgtggacattcctttacctcggttgtgatggacgtgtatgtgagtgtcgtgaggtggtatgccaggagtgctgtcctggctgtcaacctcgtgtatcctcaacaccactgataatgcactgccccgcccatgggtggtgttcgggctccagccacaaagcagctccttgaggcactatttggtgttgtccgtagtggttttaatttgcatttctctggtggttattaatgagagtgacgagcccttcatacgtggttagccatttggatctattttgtgaagaacctgattaagactttttcctattcttctatttgtactctgaagttttcttactgagttattggacatgtttatatattctggatatgagtctattggttatatgtattcaaatagttctatcctgtgccttgccttttcatccttgtggatgtcttgatgaaggaaaatgtttaatttcagtgtagatatatgtatataatttgatccagttgcttcctttctttctttcttcttttcttttctttcttttttgtccctgtgtacctagttgtcccaacacaacgtgttgaaaggccgacttttcctcactcctctgcaaccctctgctgtcacaagtcaggtgtcgatttatgcatgagcctgtgtgacagcacagagcctggctgttttcattcatgaagctttacaggaagtcttgatttctggaacagcaagtcctccagcttggttcttctcaggggtgtcttggttagtcttaaccccttgcatttccacatacattttagaatccatgtattcagttccacagaagtgtgtgttggaatatggattgggatagcattgaatccgtaggtcagtttcttactcgggtaactgttatccacaggctgctagagcaagcatcaaatcaatggttagctagtaaaagctcccctctgagtcggggatgggtgcaaggggccgttctcactgctcctctcagcgttgcccagaggtcctggtcagcgcagtagataagaaagagaagaacaatgtggggacttgcagatgaaaggaaaaccagagggatttagcaagatagctacatgtaaaagtgatactcaaaaaccattttttctgtattgcaacagcagttagaaaattaagtgtttttaaagataccattgacgatcacatcaaaacatagcaaatacctaagaataaaatctgaaaattaatgttttgcacattttgagaagaaaattagaagactttattgggagacatttaaagagaacttgagtaattggcgaaacagtccatgttcatgaattggaagactcaatcctgccaaattcttaagttctccccagatctgtatgggaaatataaagggccatgagcagtgaaaacgtgaggagggaccaggtgcaggaatcaaccagacattaagtcttctagggctctagaaactcagactccaggtggtgcaggatgaggcagtggccaagaagagagagagccctgcctgcacagacactgctctaggacacaggagacactagaagtcatggagaaatggtcatttcaaaaagtggcatgtgaatattatctttaaaaacaaaatagaactgctgagcttttgtttacttggtgggggaaactcatcctctgctaagtttcctcatctgggacatagaggggagtggaatttagtacatattaatgatgaatcccaaatttgccccaagttgttagttcaactttgttcctactcgttttgtactaagaataaatacatttgaaagacaagatggcaccgtcgctaaatgttggctcctgcctttccgagagcttgagcgcttctttctgttttgcgtgagatctcttgtctgtgggctcgcgacttgcatagacctccccaggaccctgggagcaccttgcatggaagaatacacttggggctggcatggtggctcacacccgtcatcccaacatttttgggaggctgaggcaggaggatcacttgagcccaggagttcaggaccagccttggccaacatagtgagattgtgtctctataaacaatttaaaaactagctgggtgtgggtgcatgcctgtagtcccagctactcagagggctggggcaggaggatggcttgagcctggaaggtcaaggttgcagtgagccaggattataccactgtactccagcctgggcaacatagtgagaccctgtctctagttaaaaaaaataaaaacgtgcatggaagctgagggtgctgcttgacctgatgacgctgtggtctctgtgtttgaaacttggctgcttcagctgcttagtgaatattacgtgagtgaccagggagtacttcccacccttgtgagcctgcacattctggggtatcttttgagttgtcactgtctaggctggtagtttttgcagctgtgtctccttgctccatcggggtaatgcttatttggaaggccccaacatctgtgcagcagaaagtcctggttctgctgtctttctgcagctgccatgctgaaagttggtcctttatggtgtcttggagcatttcttttgaccaccaagacttttcatgtaaatgtgggcttggcttctttttttcaatcagtttcctatccacagtttacatgatgcctcttggtgcatagtgacaatttagtaattcagccttacttcctcatattctatgatttggtggctaagcatgtatgtcacagctctcactcccttctgtaattgaggtacatgttgctagcaacatcggtgaagttggctgtggtattcgccgtttaggactcatttacaaaagccttcactgcccagtagtggtctccaaactcttctgtccacgcttgcctggcagcaaaaacaacctccagcacacacctccactgcgtgtaaatttgtctgttgaatattagtatgttgtaatttcttgttctttgtagaagaaagtataaatagacaccctgctgttttcttcctacgttccaatcttgagtaacccccaggctcaccctgcactctagatatcactgaccagtgaaacgcattcaatttctgtacctccctgactgttgggaccaggagcatgtataaagctagacaggaatgctcccagcctactttaaaggagatctttgttaaacatctctatttatcactgattaataacaggcttccctttagtaaatacgttttttaaagaatagcacattctttttttttcttttttttcattttctttttctttttttttttttttttgagacagagtcttgctctgtcacccaggtgggaatacagtggtgtgatctcagttcactgcaacctcagcctcccgggttcaagcgattctcttgcctcagcctcccaagtagctgggattacaggcacctgccaccacacccagctaattattttgtattttttagtagagatggggtttcaccatgttggctaggctagtctcgaactcctgacctcagatgatccacccatctcggcctcccaaagcgctgggattacagacgtgagccaccgcgcctggccagaatagcacattcttatctccaccttctttctgtcattttggatgccctgggtcttttctcctcttctcctacgggttttgcatgagtatgtccatgtatattgctccggggtatgattgaggatttatcttgaaatatttggaaattgtctcaaattcacaataacatattaattaaataatgggaaaagctaaaatgatctatacaagtatgaggcatttgtaataacactttactgttacaaatcagaatacgtaaaggtatgaagcatattcttccaccacctccacccatttttgtttccccgtggtacagtcctgtcaacgcagcagaaaataagatttttaaaatatgttgatgaagaagttgttaaattaacttgtattcaaaaaaaaatggaaatatttgatagggcccaaggatgcagttttttacttttttacccaattcattgttacaggttttttttaaaacagtaaaattcttttaaaaaaaaaatagtcaaatgagattttttaaatgaagaaaagaaatgaaaaaaagagctcatgagattataatcacaggcatatctgcttatggtctataagcaaaaattctacagaaacaccctgtctggaagcctagaagaattgaaattcacttgccttttagaacagtttggatagaaattttattaaaaaccgtgttactctgctcttccttcttaattgtaataaatttgcttttgtgtttgaatgacaacttagtcttttattctgagtatcagttactgtgcagtgtttataacgcgaatgatgcttttagggcattttgaggcatgtaagagtgatttaactccactctgaatgatcccaacatccttttgagtttcagttccctgaaaagggtacatttggccctcgtgtccgtatctgccacttcatagcaccgtggccttaggcaagctgtgttggctctcgtacctgtgtcctcgcctctagatcggggtaacggcactggcttgaactgctgttaggaggatttggcgaggacatgttcttaaaggacttaactggctactccttaggagccaagctgtgcatagcgtggctcttagggagaacggtggactctcagttctctgtagtgccaagaatgtgagaatgccaaacagctccaaatacacaggctgcgacaacacacacgagctcatttaaggtaatcctggcaaattagggtacaaacaaaggtgtagaattgatgagaattgaaggcaagcaaagaggtaattccaaaaatgaacgtttttcattgaaaaagactggatatctgaatgtgaagagtcctgaacgctgtaatgacagttactcgtttcaaatagttgcacagccactgagttctcagagtatttaggaataaaatttttgttctcatggtgttttaggatcctacaggcagtacaccccactcccatggccttgcgtgtgtgcttctgatctctgaatgcagcgtaggaaacagggaaaccgtagcttcctacagaatgggtctgctcagacagcagagtctgtgtgcttgttatttgcaaggctcaatgttgggcctttgggcatatagagaactagaagacatagtcacatggcacctaccctcaaaaagcatctagttgggagtaagaggtactaagcagatagctaactgtttaaagcactaacaagtgccagatgacttgctcagagtcatacatcttacctaggcagtaaggaaaggccttgtagaagaaacctcaacaggaagttgacagtaggggcagggaagggcaagaggagtgtggaaatgctcggcaccagaggaagcagaggagctgcaggaaagcagcaacaccccgccgcccccaggacactccctggagcgaggctggcatggggcagtgggtctcagggccccagtgctcctaaaaaactctgcaggacgtgaaagagcactctttatgtgaatttagctattgctactgacctatttgaaattaaactggagaaatttttaaacatgtatttattaatttactaaaatataataaacatattacattttaacagaaataacacatttttaaatgatctagccacgttggccaggcgcattggctcacacctgtaatcccagcactttgggaggccaaggcaagtggatcacttgaggccaggagctcgagaccagcctggccaacgtggtgaaaccccgtctctactaaaaatacgaaaattagctgggtgtggtggcgcacatctgtagtcccaattactggggaggctgaggcacaagaatcatttgaacccaggaggcagaggttgcagtgagccaagatcacaccagtgcattccagcctgggcaacagagtgagactctgtctctaaaagaaagaaagaaaatacccatgttttctaaaacaaaaactaatttagtggtaagagtggcatagttgtatatttttgcaaatctctgcaatgtctggcttactaggagacattaagacaaggattcccctgtccgcttctgcattcagtctgttgccatatgttgctttggtggaagtttgggaaaacgtggttgggaagggaggagtattttagtagccttttcagatagtcgtggacatttgctttgatattacaccaaaagttagtatgggtcgtttcttaaaggaatctgtaaggtggaatctgaaactatatcagtaaaagccgtctgtaaattttattccattaaatcaagtggtctactttgtactttgaatggctcttttgcccttgaatggtgttaacactatttattcatcatttggaaaatacttgttcacggagttatgcaaatctcctaaaacattttgcaaatctttgacacatttcagtatgtatgtcagtcagtcccgtttattcgtgtcaccactgatctcctcttcagcccagggaagatgtcacgctcacagtggcagacagaagttttccagacttcccagaatactggaccgtcattcagagcttggtttgaatttagcttcatccacttgccagcactgagtgattttctaaacctctttctttatgtctgttgtgctgttataaagattaaatggcaagaaagtgtcaatatgtgtaaagtttttaggatgatgtctggcccaggtaagcactcactaagtaatagttaccgttattgctgtttctaaattgccatcatcattaacgtcagtcgtcatgtgtgataagccttgactgtagaccaggatgagggaaatgcagtgtgcttggtggggctctaaggtgctaactctttgaatgtttggaagttaacagtcagtttggactgttacatctttggactgatgccagttgctctgtcatctagcaagcgtggacaaccacctgcccttcccatgttgtaagctgagggcctataggcagacataaggaggcatccttccccctctggtcttttttaccctgcctgaacctaaattctgcagatatcacctggtgtcaatgtgtccacgccctttccccagacatggaccttactggttgcctctcattccactgcccgacacggtgcctgtgatcattgctgctcagagagtatttgttgaatgaacacatgtagatggagtttatttctaacagtgctctcaacatggtttgaaagagttaaaaagcataaaaacttcctcataccaaacatataatatgaccagcgactagctgggttttttcgttttattttctttaaggaatagcctttgtttaccccacccatctccttttttcttgaatctctattcaaaataaaaatagaagaaagcttaaatgtgtttcacaataactttgggttaagcacttttgtgatcaatatactttgctttctgcttttcagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatggtaagtgattacagtttaaccagtgtgtcccagttctgatttataaacaggacaggccaagatctctgagcctaacacagtgctacccaggagaagaatcctcctgttccagaatttgtagttgtgcttgaagaatgaaaattttctttgtatcctggattgtaatgataataataggaagggaagtcagttgtcttctagggaccagtctaagtgctttgcatttattaactcatttaatcctcacaactaccctatggagtagaagtgttagaatttgtatttctatttattattttatcttctttaaatttttttaaaacatatttaacattaatatactagtgcctttttatagttcagaagtaaacattttgtccatccatgtgcaggaaaattctaatgatgggatggagttgaaatattgacagaaccaagctggtgtcagaatagttcatgctgattggctgagaaggcctccacctgtcagtgctgggatcaggacagcccatgctgattggctgagaaggccgccacctgtcagtgctaggatcaggacagcccatgctgattggctgagaaggccttcctctgtcagtgcttcctctgtcattcctctatcaatgacagtatgtcctgactggctgaaatagtcttatcatcctgcagttagttcactgttggttttattcagcccccagatctcagtcctctgaagtgtcaaactttacagcccattcctcagtcagtaccacctggaaacacttcattcagtgccattaccaaaattcattgtttgacgctgaaatccagttttctgttgatttttcttgaattgttgatattttatctgcctttgaaactagtaccccccacacacacacttactggggagtcagtgtggcttagtgtaaaatgttaagtccaattttcattgaactctttgttaagttactgatttttttttccaaagctatatatttcagaattgactggacttcttgacctaaaatacttttatttccttctttagtatgtttgctttggaaaaagatgaaagtaatgttcttcgttgtagttcagtctactgtgtcagaggttgagatcaacttgattgttttaacttgttgtttttaactcttaaagttcagaattcactggcatggctaccatgtagtcggcctaaggactacaaaggccatgcgggttcctgtcccagacttgtgcctgaagaagagtaataggcataaactgagcagagaatatataccctaaaaccttacctgttcagactaatgacacttggggaatagcttttttctttcattaattttaactctcaattactttggaggcccactctagccccagaatcataaaaatctctaatattttctcctattactttcataattttgttttgcgcatcacattttataatcttttttcttttaggtatggatatgtaatagttgtacatatttatggagtatatgtgatatttaggtagaagcatagaatccgtaatgatcaaatcagggtaattggggtttccatcacctcaagcgtttatcatttctttgtgttaggagcattccagtttttttgtttgtttgttttttgttttttgtttttttttatgatgtgggttagggatagaacttcattttcttttaaatttattttcttctaaaattattgaaaaattatttctccctacatcatgtattgactatttcatttccccctattgcttaatgcttccttattatgtgttcattttattttactgtatgttagatttataagtatataaattctatattaagtttacacgtgtggaagattttcctatgtttaagaaagtctctgattcccactctttaacctaagagggaagaatctacaaagaatgacaagactcccgctggcctggttcaggtcaaatgcccgcccttgaaccgagtgtgctcccgactgcttgaaaccgcctctcgtttgtatttcacagtagcagtgtgggttactggcaccacttaggatacttaaaagcccttgaggctgtttttatagattaagtcatcattgcctctcctctccctgtcataattgtttcctaacttgattctcctcctgctgtattaacttgtttcccacccaaacctcgcgctgggctccagagcgttgccagcccctgggctccctaagcagtaagcagacactgagcatccatcatgggccaggcacgttttggggtgaggaaatagaatggcgaacaagacttctgccctcctaaagctttcattttcacctaaagctttcattttcacgtgggagacaaccataaaataagccaaccaataattttcattttagattacggtgatgccgtgaataaaagtaatccagatgaaatagatagggttgcaagactgggaatgtgatttctgccttatgcccacgtgggcgggaagaaggcgcagagtggaaactgggtgatgaattagactgtcctgtgaagatgggcacacatgagatgctgtctgtggtcactgtgagagcaggggacattttctttcctttctgctctaagttcagaaggcaacatagcctttccctaccccttgtttgtctggatctggaggtagaataggggatggggacagattggatttttggttttgttgttttgttctgtagctagagggcattgatgagaagtatagtgaaagaaggaagaacacaggcggtggggtggtgcctggccttggtttgtgaccctcttgtcaagaatttaagcaaccagtacaaggcctctgtcccaagcagtgcctgggcctggtgtggcaggcagcaaaagcctgggcctctttgtggttcacgtctgatgagaagctctgcagcttagagcccctgtgtgcccaacacttaagcagcctttagccatgcctgtttttctctttgtttcttattggggatgggggtgtgtatattttggtcataacagttttagagacattaatttccactttttttttttttgaagaatccaaagctttatagttgttgtactcctgatgctgctacttttaagtatcctgcttattagactggactgctagatggttttttttaaacagatctactgaggtattattcacatagcctagaattcacccatttaaagtgtatgagtcagtgatttttaatatgaatatagaattgtacagccagtatcacatctggttttagaacagtttcatcccctcaaaaagaaatcctgtactcattaatagtcactgccattgttccctcctccctcacccacccccagccctgagcaaccactgattgactgttcatctctatggatttgcctgttgtggacatttcatgtaagtggaattacagaatatgtaccctttggtgtccgccttccttcacttagcataatgttctcaaggttcatccacgtgccagtacctcatgcctttttattgccccataatattccatcatacagatatactacgttttatttatccacgtatctgttgatggacactatattatgtccatttgggggctgttatgaatgactgttgtgaacattgatacgcaagcttttgtatgaacgtgtgttttcgtatctcttgggcatatacctaggagtagagtcgctgggtcatatggtaactttaacattttgaagaactaccagaccgttttcacagtggctgcaccattttacgtttgtatcagcagtgtacgggagttccagtttctccatatcctcaacacttgttatgatctgttttattacagccgtcctagtgggtgtgaagtgtacctcattgtggttttgatgtgcatttctcgacaaccagttgtgttgagcatctccttgtgtgttgtgtatttttatacatcatagacttcagacctagaaattaatggaaacgtcctgatcatctagcttgacccttttcttttccagataaaaaggcttattgggttcagagagatgcgggtggtgaggagcaattcccaggggagccagttcttggcgtgcagtttcccaggcctaagttataccagctccatcattaatttcagccgtatttaaatataatcagcctcctgttttttcaattaaattatctagttaatctgtttctcgggcacagaccttcttctgatagtcacaataccagtagcaaaactaattgtagcttttaaaaaactcaatgtagtaaaagtaaagctgctttgttaacagtaactaaagagttaaggttaggggttgcaccctttcaaaatctgaaactttgacatatctagcagtttttacatggtttcagagggttcaagcctcttagagcctacagtagaccccaaattaggaaacgtagagtctcttctaaatcgggattctcatccaaatcaggggatcacagatacctggtctccttgagagcctttcggagggcctgtgatgttagaactatttccatcatactgctaagactttaattgactttttcactgtattgaaatttgtaccgatggtgcagaagcagtagtgggtacaacattgcgcaccttagcaagaagcacagtgatggcaccaagctgacaaccacacaccccagtagaaatagaaacagccagtttcacttagtggtctaaatgaagcaatagaatagattaattgtattatttcatgacccttgtgcacacatggtcttaggactctatgatgaaatgtgaaggtttcataaagctcttctgctgccggcgccagtcaggagggagagcgcttgtgggatggagctgccagccaaacatgccgctgttttcatggaacaccatttttacctgaaaactgacagacaaaccagttattcggactttgaatatttggcaggcatcttctgaaaaaataagcaaaatgagaaagtcactttaaggaaaataactgacagagtttgttgtcagtgataaaatgtgagctttctagggaagttttgtttcattttgtttttagagatgccgtcttgctctgttgcccaggcggagtgcagtggcacagtcatagcccactgcagcctcgaacttctgggcttgagtgatcctcccacctcagcctcctgagtagctgggaccacaggcttgcaccaccatacccagctgattttttaaatttttttgtagacacggggtctccactctattggccaggctggtctcgaactcctgtgctcaagcaatccacacgcctcagcctcccaaagtgctgggattataggcatgaactatcgcacccagccagaaattttcagttttggaaaatttgtatgcaccagggtgagcttcagcctcccaatgctgcagacactcctgctgagctcagtggtgatgggaatgagtgggatttttaatagatatgatgaagtgagtcaccacttggaagagccacctaactcaatgaacaagtattttccaaatgaccggtaaaggttacagagtcatttgtggcaagagagccattcagagtgcgcgatccagcactggatttgaatgtgagagtatagacccctcactgataaggtttcagcacccatgcaggagctcacccctaataaactactactggttgagttttgatgtagacaatgacctaaaaacactattagatagatactcctcccttgtcaactacattgtctgtgtgagaccagactttcatcctatatttcaacctaaacattctgaacacagaagcagatatgataatctagcatttttctattaaaacagacattaaagaaatttacagaaatgtaaaacagtgccactttgctcacttaatttgttctggaaaatatagttattcataaatacatgtcatttacactaagacatgatggattttttttttttttttttttttagatgaggtcttgctctgttgcccagactagagtgcggtggcatggtcattactcactgcagactcaaactcctgggctcaagcaatcctccccctccccctgcctcagcctcacaagtagctgagtctacactgcaagtgtgcgccaccacaactggctaatttttttttaaagagatggagtctgggccaggtgcagtggctcatgcctgtaatcccaacactttgggaggccaaggcgggcggatcacctgaggtcaggagttcaagaccagcctggccaacatggtgaaaccctgtctctactaaaaatacaaaaattagctgggtttggtggcacactcttgtaatcccagctacttgggggtctgaggcaggagaatcgcttgaacttggaaggcagaggttgtagcgagccgagattgagccactgcactccatcctgggcaacagagtgagactgcttctcaaaaaaaaaagacatggagtctggctatgtttcctgagttggtcttgaactcctggcctctagtaataatcctgccccagcctcccaagttgggattttttttttaatttctgtggtttaatttataatatggccaatatcaatagatatagttcttataaacaaaagttctttaggatttgcaaccgttttgaggagtttagtaggggcctaagaccaaaaagtttcagagctacttttctaaaacagtgccactcaaaggctgcagcttcaacagcctttaggcttgttagaaatgcagattcttggccaggtacggtggctcacacctgtaatcccagcactttgggaggccaaggctggcggatcatgtgaggttgggagttctaaaccagcctggccaacatggtgaaaccccacctctactaaaaatacaaaaaattagctgggcgtggtggcaggcgcctgtaatcccagctacttggaagactgaggcagaagaatcacttgaacccgggagtgggaggttgcagtgagccaagatcgcaccactgcactccagcctgcgcaccacagaataagactctgtctcaaaaaaaaagaaatgcagattctttgggtcccaccctagacctgtggactctctgggggtgtgttgcagtgctgtgtgttttcagtgctctccaggtcatcctcaggcaagccaaaacttcaataactgttttgaataatcgtcctgcattgtcccatctttggatcgtcagttcccccagagaacaacttgttatactcttgcatttcttccactgaattcagcacactgccttttatagactcaataaatattcattcaatatgaggttttctgcatagacttgggcattaagactcgtcttaacagtcacagatgaaaataacctgaagatcagaaaaggaattgcttggattggtgattgaatgagtcggatgactcagaagtacttcgcattagagtggacctctccagaaatatccaaatctattgtgctggaccactgagaacgcaacctggtgtactcaatcatgcaagaaatgtgtattgcagacaccatgctacctcttggggctaccccaagaactaaaataatatagtctctacctatatggcatccacccttactggtctgggagacaagaagaggcagcagacgtaatgatacgagggccaaggactgcggtggcggtcagtgtaaggtctggtaagagcacaggcataggaggcctaaccccttgcctgggcgccccagagaagtggcctctctacaccagcggccagtgcttcaggactagctggctcagtgaaagcaatatagaggagggaaggggaggggagtgttcccagcagaaggaacagctcctctaaagcccaaagactagagaaagtaagacgtgtttgggtttgagccaagcctggagctcccgattgggtgggctagagtctggatcctggggagcttgatggaacccgaggacctgaggttgggtgggagagctgggaccaccccgtttgctccggctgcagtgtgaagaataggtgggaatgggtgtcagaatgacgcatgaagggaccagctcaacatctgctgcggcatttcaggagagaagtggtggaatgagccaagcggctttgatggcagagagaaatgggcaaatgcagagatgttaagaaggtagaaacacgattcggggtggatttgtttgagattcctggggagaggaaccaacgcgcaggtttctgacttgagcaagtggaatgctggttcaggggaaagagcatgggccctggtgtaggaaaggcctgaggtgggtctcatctgctaacattatttagagctctttgggttaacgggggcaggcacccaattcactgttgtttacactcacaagggagtttaccaggcagacactgggtctctcacacttagtccacagagtcacagggacagcttttccttccgtgtcccatgtccccgctctctgtatgcagccttccttctttggggcatccctctatgatgacagaggaaagcatggcccttgctggcttgccagaagaggcctgatgtctcctgtctcctacctgcccttgatcccgttgccgtaactagggagatggggtactgtggttgtgactcagactgggtcatgtgcccaccaaaccatgcgatagagtcaaggagcaagaattccccagaagggagggagtcgtgtgcttctctgggcagatgaaacggtcggatctgtacccaactttaatctgctaactgtgctactttgggtgaacggcttggttctgcaagcttggttctgtctgctgcagacaaatagctgtaatgcttctgcctcacagagcagctaggatgaaaggggaacacatggaaagcttgggcagcccccgtgacaaagttgtcagtgtcctcggaagtggccagaaagagacaagcctccaagatttctcagaatgcttaccagggggacgcctcaatgcagccttctttcttcatattcgtacgggacttatttctaattctcgctccagactctgatatcttgaggttacttaacttttttttgagacagagtctttctctgtcgccaggctggagtgcagtggcgtaatctcggctcactgcaacctcccaggttcaagtaattctcctgcctcagcctcccaagtagctgggattacaggcatgcgccaccacacccagctaatttttgtatttttaatagagacagggtttcaccatgttggccaggatgatctcaaactcctgatctcaggtgatctgcccacctcagcctcccagagtactgggataactggcgtgagccagcgcccagcctctattttcttatttagaaagttatcatgctgtggaactacttcatagagagttagttagattagtttaaatggtgattggaagattaaaaatacatggtctgaagtatgatttcatgtttgtaacatataaataaattcatgaaaataaaatcaaacttagggagagaaagtaacttgtgaaatactctacagagtacggtgacccagccctgtggcaccatccacaccacagattgatttggttccattttatcgatagatttttaaaataaagctgaaggcctcgccaacatggtgaaaccccatctctactaaaaatacaaaaattagctgggcatggtgttgcacacctgtaatcccagctacttgggaggctgaggcaggagaatcgcttaaaccctggaggcggaggttgcagtgagccaagatcacgctactgtgctccaacctgacggacagagcaagactccgtctcaaaaaaataaataaataaataaaaaagctgaaggaatatagtacaaactgttaatagtaggtgtctttgggtggtatcattaatttttcccttttactatacacttttgtaatttttaaaaaaattcagaatgggccaggcacagtggctcatgcctataatccaactttgggaggccagggcaggaggatcacttgagatcaggagttggagaccagcctgggcaacgtagcaagaccttgtgtctacaaaaaaaatttttttaggccgggcacggtggctcacacctgtaatcccagcactttgggaggctgaagcggacagatcacctgaagttaggagttcaagagcagcctggccaacgtggtggaaccctgtctctactaaaattacaaaaattagccaggcgtggtggcgcatgcctgtaatctcagctactcgggaggctgaggcaagagaattgcttgaacccaggaggcagaggttgcagtaagctgagatcatgcaactgtactccagcctgggcgacagagcgagactctgtcaaaaaaaaaaaagcaagaagaaagagaaagttttttaatagctgggtgtggtggcgcacgcctgcacctatatgcctagctactcggtcggggctgaggtgggaggcttgtttgagctcaggagcttaaggctgcaatgaggtatgattgtgccactgcactcctacctgggcaacagagcaagactctgcctcaaaaaaaaaaattaataattatgtaccacatttgtcatcatcaaaaaccagtaaagatatttttctttcttaaaaataaaaacaagcggccaggcgcggtagctcatgcctgtaatcccagcactttgggaagccgaggcaggtggatcacctgaggtcaggagctcgagaccagcctgaccagtatggtgtaacctcatctctactaaaaatatgaaaattagccaggcatggtggcgggcacctgtagtcccagctactcgggaggctgaggcagaaggattgctggaaccctggaggtggaggttgcagtgagccaagattgcaccactgcactccagcctgagcgacagagcaagattccatcaaaaaaattaattaattaattaaaaagataaaataaaaacaagctatccgtatgtaatatagtactgtttttatcaggactcttgttggtttccagggaaaactagttgatcacattattttaatccgcactgtctgtaagtgatttgatgttgacttacacgttttatgggcatgagagtgttcttaggatctgttggccgggtcctgggggaggtctcacaccctgcacccccagatgggtgtcctgtgcttcacttagggactgatgtggggcacgttccttcttctatttttatagctgatatttacagtgtgttctggaaagttttacttgctataagggtgatgatagtttgggagaggaaagaatgtgttgaattaagagggatagtacattgaccaatggagttgcagtcaaatttatttcaagtgaggatttaaatcatgcattcccaagtactttttgaaatccagagaatgatttttctactttaaatatcagtaagctgttttttagaggtttgtttgttcttacgattttgagattttcctttgatgtttttaaattataaaagaaatacatgcttatgtgataacaaatgaaacaaatacgaaagcattttaaaaagttaatctttttcctacttcacccctccccagttctacccatctctacctccaatcagccaattcatgtttattgtattttcagaaggctgctgagaaacttttgggatgatgagtatgttcattatctgattatatgattgtttcacagatatatgcatatgttaaatatcaaattttacactttaaatatgtacatttaattgtatataaattatatctcagtaaagctgggtgttttcagatgtccaaacttgttaggtatttcttttggtctaggggtgcagtgaagaaattactaagacaccaagggcattgtgaaccaagaagttttgggaacttatgacctagtgaatatctttccataactttttttaaattaattttttatttacatatagtgaaattcactctttcttgtggccagttctcggaactttgataaatgtgtatagtcacgtcttccgcaccacagtcaggatatagaacagtttcttttggttttgtttgtttgtttgtttgtttgtttttgagacggagtctctgttgcctggctggagtgcagtggcaccatatcagctcactgcaacctccgcctcctgtgttcaagtgattcttctgcctcagcctcccgagtagaagaacagtttcttcagcctccagaaacatggctttatgctcactttgtagtcagagccttccccttcctttctctctgcccctcactagtctgttctctatcacatcattttgtcttttccagaatggaaactccatagaaatggattcagtgtatagcctttgggtctagcttctttcgcttagcttgatgcattggacattcgtccatgttgtcacacagtttgttccttttccttctcagtgttgtctcattatataaaagtaacaccatttgcttatccatttcctatggagggatatttgaggtgtttccagttttatttggagcaataaaacttttataaatacttacataccgattttagacataagcttttatttaacttgggtaaacacatagggatgcaatcgctaggtgaatggtaagtgtgtgttgagctttctaaggaactgccaaaccgttttccaaagtggctgccccgtgtgattcccccaacagtgcgtgagttctcatgcctcccgtatctttgtcaatatttggtgtcatcagtccttttatctcattttgattttaatttgcatttccttaatgactaattatgccaggcttgtttgtttgttttttggagacagggtctcgctctgccagccaggctggagtgcagtggctcaatcatggctcactgcagcctccacctcccaggctcaggtgatcctctcacctcagcctcctgagtagctgggactgcaagcgcccatcacacccacctcatttttgtatttttagtagagacaaggtctcactgtgttgcccaagctggtctcgaactcctgagctcaagtgatccccctgcctcagcctatgaaggtgctgggattccaggcgtgagccaccacacctggcccaagcattttttccctgcgctttttgtcgtttgtatatcttcattggtgaattgtctgttccaattgtttgcctgtttttcaattgggcttttttttttttttttttttttttttgagttttgagttttgagacttctttacatatctgggtacagattttttgcgagatacatgatttgcaaatattttctctcagtctgtagcttgtctttttttttgttcttaagtgtcttgtacagagcaaaaatgtttaattgagataaagtccaacttaggatttgtcctttatcagtagtgcttttggtagcatatctaagaagtctgccaaacctaagctcacaaagatttttctcctatattttcttcatcgtttcacattttacatgtaggtctgtgatccattttgtctgcagttcgttctttggcgtatggatttccaattgttctgtttgttgaaaagactgatgaatatccattgaactgcttttgttcctttgtcaaaaatcagttgagcatgttgtgagtcttcttctggactctgtcctgtcgcgtgtttgtgtatctctgtttgccagtctcacactgtcttcagtacagtacttgatagtaaattttgagatcaggttgtgtgactgctataacctctttcttctttttgaaaattgttttgactattctagttattttacctttccatataaattttaaaatcagcttgttatctacaaaatattctccaggggtttactgcatgcagtgaacatgtagacttggagaccattgacctcttaacagtgtgagctttgcagcctatgtacacagcatgtctccccattttggtcttcttgttttgtagttgtcagcaaacagatgctataaatatcttcttagactcgtaaattagtattttggtttttggttgtcattgtaaatagatctgtttatttcccatttgtaattgtttattgtcttgttgtaattatatcaggttttgcttcatgttatatatattcatataaatattcagtgtatatcccctcttggtgaattaactcttttaccatgatagatatgactgtattgctggtaatattatttgctctgaaatccactccgtctcaccttaatatagccattccagcgctcttctgactagtgttggcatggtatgtctttttcttcccttttacttttgatcagttcgtatctttatacgtaaagtgggtgtatggtagatagcgtattgttgagtcttggtttttttttgttttggtttttgttgttgttgttgttgttgttgttgttttgagacagagtctcgctctgtcacccaggctggagtgcagtggcacaatctctgctcactgcaagctccgcctcccgggttcatgccattctcctgcctcagcctcccccaagtagctgggactacaggcgcccaccaccacacccggctaattttgtatttttagcagagacggggtttctcaccatgttagccaggatggtctcgatctcctgatctcgtgatctgccctcctcggcctcccaaagtgctgggattacaggcgtgaaccactgtgcccggctgagtcttgcttttttattcagtcagacaatccctgtctttcagggtgttgaaaccatttatttttcatgtgattatgaatgtacttgggtttaaatgtaccaccttcctattttttttctatttgtcccacctgtttatcgtttctcttctttgtctgcattcttttggatcaattgagtactttttatgattcccttctatctcatttgttggcttctttatgataactccatattgtttgattttaattgttagtcttttctagaacacacctttaacttatcacaatctaccttcaagcgataacatactatttcatatagaatataagacatttacaacagtatacttctatttctcctctcccagcctttccgctattatcatacataaacccctcaatatcttattatttttgttttaaagaaatttaagtgatttttaaaaatctttttttattatactttaagttttcgggtattaaaaatcttttatatttacccagatagttacaattttcagtgttcatcattcctttgtgtagattcagatacccatctgatatcaattaccttctgcttgaaggactgtcttaatatttcttatagcacaggtctactgatgatgaattcttttagctttcgtgtatctgcaaaagcctttcttttcttttgccttttttttttttttttttttttgagacagggtcttgctctgttacccaggccagtgtatagtggtgcaatcacggctcactgcagctttgacttccaggctcaatcagtcctcccacctcacaccccaaccccaactctgccccagtagctgggatgacaggcacatgccaccatgtccagctaatttttttactttttgtggagacagggtctcactaggttgcctaagctggtctcaaactcctgggctcaagcagtcctttcatcttggcctcccaaagtactgagagtacaggggtgagcctggtcttgccttcagttttgaaagatctgcttgctggtatagaattccgtgtcgaccgttttatccttgaaaaacttttgctcgcctgttgtcttgcttgcattatttctgatgagatgtctcctgccattcttttctttgttcctttggacataatgtaccctttccccctctgggagctttcacagttgtctctttttaagtcatttgattatgatgggccttggcatggtttccttcattttgcctgtgtttagagtttgtttataattttcatcagtttgagaaattgtctcttcaaatatttttttctgtcccatgaccctttctctcctttagggatcccaataacgtgtattaggcttcttagagttgatgctgatgctctatttctcttaattcttttttttttttctgtgtaacatttggatagtttcctttgctttcttcaacttctttaatcttttctgccatgtctattctgttaatttttattacagtaaatttttcatttcacacattttttttaattaagtgagcaaatttacttaagcaattagagatctgtgggtacatattgttgttgtcatctctagtggtttgatttgtgtctttttaaaatatctttcacgtccacctaactttttggacacaatactgtattcatgtccttgtctgccaattctaacatttgtgtcatttcagtttagttcagttgactggtttttcttctcattataaatccttctcctgcttctttgcgtgtctggtaatttttaattggatgtctgacattgtgaattttgctttgttgagtgctatatctctattcatgttcttgagatttgtttggggatgcaattaagttacttggaaatagtttgatcctttcagttcttgctttttcagatgttttaggcaggaacagttatattaaaaccagagctaattattctccaccactgagacctttctgattaggaagccagtgccctatggattatgaatttttcccatctggttggtgggaacagacactgttcccagccccgaacaagtactgggttctcactaatcctttcaggtggttcttttcccaacctctggtagttttctcacacaaatatgctgatctgtactctgctgaatagttgagtgacctctacaaataaatcactgtagttcttctctgtgtgcagctgtctcccctgtggaactctgccttgcaaattctaatccagtttgaatcctgggtcccacctgggttctttctgcctatactacaacctaaaaatctatcaaggcaggagcctggggcggtgtgggacgtgcctcacttgttcccatctcagggatcactgtccttatccttcgttgtctgaaatccagtgtcttgaaaaccgtaattttatatatttttgcccaaatatttggttgtttcaggcagtagcataaacctcatccttgttactccatctcatctggaagcataagtctgcttcatttataatagatactcaataaacacttaactccgtccacccaggggatctagcaattattataaaaatgaaagactgtttgcataatttataatgccataatttcatacgtcatttggggttaggggaaatggctgtgcatacatgactgggaagtgataaggagtttagctctgaaacttcccttctcagttgatttatatcacgttggatagagagtatgttgttctgctatgctaaagcattactaaactttctcataccttactgcaaaaagaaatcagaatacatgataaagcaaatatattagaatgctaatggtaaaatctagatgatagctgttcgctataaaattctttcaactttattgcattgaaatttttcgtaataaaaacattgggaatacatcattcagaatctatacgaaactaatctttggcccagagtaaataacttaagagcacttccaaatccagtgttatctttaaatgacactagttgaattgaattataagtattatgaattatttcttatgtataaatattctaaactcaaaaaatataaactcatgcacataactgtaaatgatttattttcatgcttatctgaagatgatcttgttatgaaactgtagaaaattaaaatattcattgtttgaaaagtttagactaaatttcctttattaagtattctacaaaggtttgtaagttgtttgttttttttttaatttgagacagagtcttgctctgtcgcccaggctggagtgcagtggcacgatctcagctcactgcaacctccacctcccaagttcaagcgattctcctgccccagcctccagagtagctgggattacaggcctgtgccaccatacttggctaatttttgtatttttagtagagacagggttttgccatgttggccaggctggtcttgagctcctaacctcaggtgacctgcccgcctcagcctcccaaagtgctgggattacaggggtgagccaccgcgcctagcccgtaagtttttatttccatatctttaactgctatttaggaacatatttgaatagattgtaaaaatagcaagttattcaaagtaagaattttcaatgttgtggttcttttcttgactgtcacatcatggcatctatttggaggtgaaatcgattctttgaaagcagctcttgctgtggaggaagcgcgaggtagatttgtgggaagaaggctctgctctcccttacctctcttcactgccgagcactcattgtgtgccagggccagcaggaagatattaaaccaaggacttcccggccacccagtcatacttgagataaatattccaaagaaaatgtacagcatcatagaagagcttaaaattaggggcccaattaggactgtaattattttgcagctgagacgtaaaggtttaatgagacatttttcacagtttccaggtaattaattggtgttgcagttaataaggtgactgatgcgtgcttttcccaggatccatttactctcagcaagtgtttgaggacctcctaggtgccaggcacagtggtaggtgctgggattgctgtgcatttatgttctctagatgatagctgagttctggtgccatgaaagcagattcaaactcactttacaaatggggaaaggggtagtatctccctttaagactgctactacgatttttactattctacctaaattttaggttaagttcattgagttcatcaaaaattcagtttaagattgtgtctgctttatacattgctctgcgaagttccatctttgtaatatgatctcattccacatcaaaggttcctccgttttttcgggcattcttcagtgccttttattagagttttctgctttctccatcaaggccttgtaactaggtcagtaattcccaggcactttgtagtttttgtgtctgggtagctggagtcttcgtctctgtttcttttttgtatttgcttaattgttagtggaaaggtggttgctgttggtttcatatttttgatatttgcatgtggtagtctagttgtgatggtctgtctgttgcttctgttttccagctatatcatttgcaaacaaatgacaattttgtacttaaatatatatatattgcgaaggggcttaacactttctgcccttcccagaaatgtatctcttagcaatatgactcgtagaacctaacagttccatcacaggaggaagtgttctgcagtaactgtaatttggcctttgatggattcatctgttataaatcctgttgacatgaataaaacagagaataaataacagaataacccttgtggttttgaacagagaactgtaaataatcaaacctttctttcctgttgcctctaaagttagactgtcagcggtttttttttttaatgtatcccttcatgtcttaaaatttttatatgttacactgctgcagttatgttacggcataaatattcactcattggtaatgaatgataacacatacagaaaggctgcatgatattgctgaattgtaagaattttccgtaaagttgcttcttgggccattctagtttacatctaatttaataaatttagcaatttggagaacatctgcaggactgatgtaagtactgaaagtggaagtgtcagggaggcagcagaagcaggtgcttcctgatattaaccagagacggtcctggcacagatggggccgtgtgaatcacatgcagacatacgtatgcactcacgtgcgtgccattattttcatgtggaggtcaaacagtcagaaacgtttgggaagtgctgtgtaatgctaactgttcgtgcataatgttttcccatttagtaagtgctgttgcatgtgttttctgtgattctcaccacagcccaatgcaaaaaataaaaaaaggatttacgcttttttttttttttttttttttttttgagatggagtctcactctattgcccaggctggagtgcagtggtgcaatctcggttcactgcaacttccacctcccagattcaagtgattctcctgcctcagcctcccgagtagctgggattacaggcacccaccaccacacccagctaagttttgtatttttagtggagatggggtttcaccatgttggctaggctgctcttgaactcttgacctcaagtgatccacccgcctcggcctcccaaagtgctgggattacaggcatgagtcaccgcgcctggcctttaccctttccaatggaggagaaaattgaggctcaggcaggctgtttggtctgaggtccttcttctaggtgggaagagggtgtagagagactgtttccatgaggctgtgctgcctttgttgggcagcgtgattctgcgtctgtgcctctgggtgtgcgctggatccgtaggtctcatttgagagatcacagtgaccctgtgtgctgcccagaagacccgggactccttagacctcagagcttctttggtgttcactgcataacgttgatgtcttctctgtttcctcagaccggatccatgcatccaggtagcatggcagtgacatttgcacacagacatcagcaccccaggtttctgtacctggggctcctgcccctgattcgcccctgcagcttttgtgttaagaaatgttgctaggtcagaaacccaagaagaatttgaggtgatagaccgttggccctctgttccttccccccgccccagtattactttttacttaaccttttctagagatatgcactaaattaatgcaatgtaatgtggtaagaaaggtgtgtagaagttaggagtgcaagtttttttccttacacatgagaaatgactttcaatcaatcagaattggcctggaatgaaccttcccggacctaggtcggtcatcagtcaaggacgctgtatcagtctgctcaggctgccgtaagaaaataccacaggctggtggcttaaaccacagaaatgtgtcttctctccattctagaggctggaaagtctaaactcaagggtgtagcagggtttgttccctgctgagggccttttctggcttgcagacggccactgtgccctcccatggcctttgctccgagcaagtgcagagaaggcgagtgtgagccttctaccatccctccttacaaagacactaatcctggagggccaaggccccacttatgacttcattcacccttcattattttctctgaggacccatctccaaatccagccacaccagggtttaggtctttaacatgaatgtgaggaagggaggccacaagcattgagtccatgacagacactgaaaagaggacattgtgttcagagcaagccatctgagtcaccttgcaggccctcagctcagcatcaaggattcagtgagtgtgcaggtgtttgagacggggcctagctgctgggctgactgtcactgtgcgggagagcttcaactggaaaccctaatcactagctttcctgctagtagaaaccaccagtttacttaggaatctcagctgactgggtgcctcagtcagggctgtgcagagaaacagcaggagagacagagattgagatctcaaggacttgccttctgcagtgggtgagtccagcgggcaggtctggactccgtggacaggcagcgggcacgagacttggccgtggtggacactgcaggccgcaggtggactctcctcagagaagctgcagtttgggtctcacaggcctctcagctgactggttgaagcccccacattctcaagagtgatcgctacttgaagtccattgattataggtgttaaccacatctataaaatgccttcacaggaacacccacagcagtgtttggacagctgggcactgtggcctagccgggttgacacatacggccagctggcacagtcggggacattttactttttttcagttatcgcctttaaccacgatgggtgaaatcacactttcctgtgcctaaataacatcttaggcaagttggttaacttcttagtcatccctggtcacagaaatccaatctaggttaaagctttcatctcagaccctctgcaaatggcatctaagccgcaccccaggcagcctggccagggagggacatgctgtgggagaggaggggaagcaagggtggctccgagcccctcttgcccgccctcccccggggctttgagcagaacccagagcagaggggaagggcagctgcctgttctgctcagttgctccctgtggcctcggccagaatggtggtctcttcctctgtggcatgtctgtgactcttgggcagcaggcctcttccagagggacggctgtttcctctcccccaagacctacagcctcgtctctgggtgagctgacccctctctcccttggcagcttcctgggcggcgtggccctacggctcctgctctggcctctgtatccctgatgggcagccccagaaacctcggaagcagtgaccgtgctttccttccaggcgccatggttcctcaggccctgatgtcacaggctgttcccagagtctcctgccaggcatagtcctgttcacagattcctctgccacccagagttcgtgcccaggctctgccctccccacactgtgctctgcccctgtcggcaccaggccgggcccacagctctaacccaccgaagaacaaagtgccatctccctttcctgaaggtgaccctgtcctgtgggtgactggaccctcaccccagtctcttggctttgagagagagggtagaaaccccagttcacgaatgccacactccccgtaggagctaaagactcaattcagactttcctttctctgcccttcatggccctggaagttatggagagcttcagcagtggctgctaatgacaggaccctgggaggacatggcggcctgcccaaagtgtgtgtgtgtgtggcctttccttaatagttgagcttttagcatctgcttgttcacgtctgtgggctttggggtcagggtgccaggaggggcagactagacccctgtctgcgccgagtgcctgtgggccagcaactgaggcagggccgtccacctgtcaatcaccgttctttgggaggctccttgcagtgccctatacacacactagcttcacagaggaggggacagtccctggagagtagacattgccagaaattataacaccagtgagagtcaggttaactctcggttttagattgcaaacttttgtctttgtacctatgtcttaggaacattactcatacttttactagaagtgttttttaattagttgttcctggcttttcagccccttttttcatccctgcgtttctacagtatccgtgaaggccattacagttggtctttacgtcagctcccctctcagatgacacagagaacaagctcagatgcttgatactcagatgcttgatgctcagagcttttatagctgatgactttctgaaaaatgatattaaggtttggagttcagtatcaataccagtaaagaagggaagaaacaggcaggtgcggtggctcacgcctctaattccagtactttgggaggccgaggcaggaggattgcttaagcccaggagtttgagaccagcatgggcaacgtagcgagttcttgtctctgcaaaaaataaataaaattagcagagcatggtggtgcgtgctggtagtcccagctacttgggaggctggggcaggaggatcgtgtgaacccaggagttggaggctgcagtgagcgatgatggccactgtactccagcctgggcagcagagagatgccctgtctttaagaggaaaaaagaaaagggaagaaacagcagtggtgacattgagtattagcttggtctttacaagactgggtatctaaagccagccaagtttgccctggactctctagaaacatcttctcgttgttatcgtagagtcagattttaatcttttatgtcaaaggttttgattttgtgcttctgagagtggtgggactggggttgtgatcacctataagagccattcaccagaacccagttatataactggcatacgatccgttcagagattcaataaggtaaccaatcatatttagacttagtataaaagagggttgggcatggtgactcacgcctgtaatcccagcactttgggaggctgaggggagcggatcacttgaggtcaggagtttgagactggcctggccaacatggtgaaaccgtggtgaaatcccatctctactaaaaatacaaaaattagccaggcatggtggtgcacgcctgtaattctagctactcgggaggctgaggcacaagaatcacttgaacccgggaggcagaggttgtgatgagtcgagttcgcaccactacactccaacctgggccgcagagggagacgtcacctcaaaaataaataaataaatacatagatttagtacaaaataaaaataggttataaatgtatgacatggaaacagtaatcttttctgtttatgtcactgatctgtcagtatgtgttatacaagtccaaacagactgagagaaatctaacagcccatgcctgggcgcacagccatgctgcccctaccgatcctctgtgcccctgagcagtcctttctctggaaatgatcttagctgccgactcaaaggtcgtcccactctgactgttgctttcctcatcgttgcggattgcagaggatgttggtgccattgtcacacgggtcctccctgcgtgacgcagcccttgccatttccagcattttcagctgtgaatctctgctgcgtctttcgtcatctcatccctttcttactctcattttgagcattctccttggtcttgcacccactggatagtataagacctcagaagtcatcactgtgccatcagcctttgttggtgttggttgtcattcaaagtttgacagtcaagagtccaagtaactttggtggtcaacttgcgtgcgcacctgtccaaagtgatgtttcctgctgcagttttgatccaggctctctctgaggacccacacagcttctgcgttttgaggatacggaggagctaagttaccatgggaagcggctactgttagaattacctaagactttataaaatgttgtctgtaaatattttaaatgccctgattgtaattatagaatatgtggattttagtttgcagttaacatgtttcgaacattaccaccttcctccaatcctacgggagcggaatttgacccggaggaagatgaaccaacgttagaagcagcctggcctcatctacaggtatcgggctctgggtgatagactcggagggcactggtgacacatgggaatggcctgggatccacagagcgggcgcactggtctggccagatggacctctcctcctcagtagcatgggcctcgtaaacccatatgtacaagaaaaatatttcagcagaataaagttaatgtgtgtgtttgaccactttacaacagccagtgaagatgtgtaattgtgagtatgttctcagtgaagatggccgctgtgttgatggccgttgaattgaattcaggcccagaggtcctaagccaacaatctcccagtttttgctcctcatatttaataggtgcctgctgggcccccaggtcctgcgctggccactgcctttccccagggcatttgtaaggcagaaggttggttggcaaggaggcgccagggtcggcatgagcagagcgggggccaggtgtgcgggtgggagggccatccatccgtgacaggcggcccacgctgtcccacccagcatgtctgcacagggaaagaattgtcccagctccaggaggtcatgattctgggtccacatcttagggccctcttacctggcagccccagagttcctgtgtatttggttggctctgcgccttggcattgtgggacactcctaggcgacaggctgcaaatcccccctgcagagttgggtcatggcttggtttgtggcatctgtgccctgtagtccctgaacagtgtactataactgatgacatcagccatggagatcattttgtttaaatgccgtttaagggtgtagtctgtgggtttcaccaaataaaataattaccatcaccatttatcattgaattaagccatgtaatttagcattaattctgtagatatgtggctttgagaggctaatatttgcataccaataaagattcaatttctggtatattttaaccgccattcaataaaatctcatgttatttgactcattgttttttttcctcctagcttgtttatgaatttttcttaagatttttagagtctccagatttccaacctaatatagcgaagaaatatattgatcagaagtttgtattgcaggtaaggtacaaattagctgacactctgaaagccctgatggaatgatgacacccagccactaagtgtctttttcttctcaaagcttttagagctctttgacagtgaagatcctcgggagagagattttcttaaaaccacccttcacagaatctatgggaaattcctaggcttgagagcttacatcagaaaacagataaataatatattttataggtaagtcacgtgtggatggcgttgtccttgtgtgtggtgatgctcatttcccccctcgatgctcccctaccccatcgtctcctctgacaggactcagcatgtggagggggtttctcaaagcctatttgtcatgtgcaggtggacccccttgtgcactgtgtgcagggggctgctgggctcatcctccctgccttcctcccctctccccacagctccctcctgagccaccaagctccccagcgcctcatcctgggtccctccattgttcctgtttctactgaaaggtcaagtttcctggaaatgtggatgaattggttccatccagaccaactgtattagtgaaggttctctagaaggacaggacgcataggatagatgaatatatgaaggggagtttattaggagagttgactcacacgatcacaaggtgaagacccacaataggctgtctgcaggccgagtcccaaaacctcaaaagtagggagacggacagtgcagccttcagtctgtggcggaaagcccaggagcccctggcaaaccactggtgtaggtccaagagtccagaagctgaagaatttagagtccaatgttcaagggcaggaagcatccagcacaggagaaagatggaggccagaagactcagccagtctagcccttccacgttcctctgcctgcttaattctggccgcaccggcagctgattagatggtgcccacccaggttaaggatgggtctgcgtctcccagtccactgactcaaatgttaatctcctttggcaacaccctcacagacatacccaggcacaatactttgcatccttcaatctagtcaagttgacactcagtattaaccttcacaccagctttttccttctacctgtgcatcacctcattcttcccgtggagtctcagtgagaggaggcggggcaagaagtgatgtcattcatctgtagaaagcctgagatctgtgcacctcggttaaaggtttggagactcccactgtgcaccaggggagggaaagccccgctggagcagccggtggaggaggacagagtccagtggcaggcccacctccaggcccgcccctccccagccagcctctgctcagctccaggctccttccacgccagggctctgtagccagtgttggagcctcctggaatgtcttttttacaccagcccttccctcagcctcccaggcttcctgaaacatcccttcactgggaggctctgcctgacttggcggtgggtctggtctcccgcaagggcagccaccatgtcagttgatttgtcgcacgccccaccccactgccagtttcgtgctccccactgcggtggcaccaagtgaatgtcaatagaggaaacagttcctgttgtttctttttgttcctggaaagttcactaaatgagcagtttcttctacaagttacagcttctctggtcagcttgcctctaaggcatctgactccaggatgttgcgaggtagtgacacatcctggtgatggtggggacggtatgatggcgtgtctctgtgagataagagcatgagcaggtcccacacagcctcgctgcagggccagggtgtggacagagcacgggccatggcctggagaaggggccaggtgtcagccacgcccaacacgggcctcggggtcctttcttagtcacagtgaccacgggaaaagaaaaggggcatctgagacagacagatggcagatgagaccccccctgccaaaacccacagccctggcccctcccatcccgtgccggcttgcacagcctgcgtcgggagcaccctgcctttccgtctgcagtcattagggcccgcagccccggcctctcccatcccgtgccggcttgcacagcctgcgtcgggagcaccctgcctttccctctgcagtcattagggcccacagccccggcctctcccatcccgtgccggcttgcacagcctgcgtcaggagcaccctgcctttcccctctgcagtcataagggttgcattccctcctgacctgcacacctgatagggcatttcggcgtgagagcctttgattttgcgtgtggctttcctttgaactccttccaagtaccccacatctcgtttgtaaaatggagcccggtgctggacatagcccagacctgacacattaactataacagagaatgatgtcactttcctaaatgttatgtttctattttatgtttcttggtatcatgattcctttttaacaagatcattacttgcctggtatacttatctatgaaaacataatatacattatttaacatacaacaggtacaatttaaatttccagtcttcttgacctaaaattaaagctctacctaacatatttctgttttcttaattctagtaggttttgttcagatagcagaatcacaaatctattgaacatctgcatttaagaagtagaaaatgggccgggcgtggtggctcacgcctgtaatcccagcactttgggaggccgaggcgggcagatcacaaggtcaggagatcgagaccatactggctaacacggtgaaaccccatctctactaaaaatacaaaaaattagccgggcgtggtggcgggcacctgtagtcccagctactcgggaggctgaggcgggagaatggcgtgaacccgggaggcggagcttacagtgagccgagatcgtgccactgcactccagcctgggcgacagagcaagactccgtctcaaaaaaaaaaaaaaaaagtagtagaaagtgttttgtaccttaaagaaccttaggaaatacttaaatagattagtattccaaagttattacgcataatttacttgagttctcactaaaggcttggtgctagaatatggcatttgtgtctgtgtgcatgcttttgatagtcttttctgtaattgtgtgcatgcttttgatagtcttttctgtaattgtgtgcatgcttttgatagtcttttctgtaattgtgtgcatgcttttgatagtcttttctgtaattgtcctgatacgcgcagtcaaaagcaagcatgctatctagattccgtgattggtttgggtcctcattgtcaataccactacctcctcatttcatgtgaggaaaaaaaaagaagaaagatcttgagagttgcattcagctcatctaggtttttttcttttcttttcttttcttttctccttttttaaggcagggtctcactctgtcacccaggctggagtacagtgatgctgtactccatagctcactgcagcctcaaacccctgggcttaagggatccttctacctcagcttcccaagtagctgggtctacagatgtgtgccaccacatgcggctaacttttaaaatttttgtagagatggagatctgtctcactgtgttgcccaggctggtctcaaactcctggcctcaagtgatcctcctgcctcagcctcccaaagcactgggattacaggcgtgagccaccacacccagccagctcatctaagttcaatatagaacagctgtgtcttgtaagaaaaaacattttgaacatatttggctcaacttaactgaaaatgtaaatataaggttgctgtttatttctatggtttatcattaccgtcagcttaagtgtgagttaaacagtgctgtccataacccatggtgcctgctctggcacacagcgggacctggaggctgggcgggcagggcagtgtgccgttccttctcttgctgcataaccagccatgggtcatgctctatcctcaccctggccctgcagcaaggctgtgcagcacctgctcatgctcttatctcacagagagatgccatcaaactgtccccatcatcaccaggatgtgtcactacctcacaccatcctggagccaggagccaccgccagctcagtggcttctgtcagcatggtccatcactcctcacgatgctgtcgtctgcgctaggctcatccagacggttctgctccgtggcgtgtgctggggctggagtgttcacaggggctgctgagcaggtccccacgctgcctctgtgatgccttgagctcctccaggttgtctgagtttctacagccacggccacgtccaagaggggagaggcaggacccccagtcctcctaagagtttggcttggaactggtgcagagtgacttctgccctttgtgttggtcagagcagggcacaaggacagcccagcttcagaggaaggagaaatagagtccacctcttcccatgaggccagaatacatcatacaggcaggaaaggcatttagaatcctttctggagacttctatagccagcaggttcccagcttagtgtctggggggtctgattccctttctgctgaaagagtgagaaacactctctccggctcccagggatctctgtttccctcccagggtgtccctgtttgtctcccgctggaaaaggaagaaggaaaagaactgtccttatttcttctttcttctgcctacatcaaagcaggtttaaaaaattagaaattaagaatttatcagtaagaatgtagtaatgttgatttaggaaaacaaaatggcttataactgcaagccatccttatgtaaatgttaaagctgatggatctagaccagaaggggtccaggggtctttgtctcggagaggcccagatcacagctctccaaggtccatgcgagaggaatagtaaactgaagccacacggctgccgtgtatgcaaagggagcctgcagggtgagtttcgtaaattaaagcacctctcggtgtagacacacacagactgacttctgcttggtcacagcttccaagcctcagggtaggtgcaggctgagggacaccaggtgcgagcattttctgtttcttgtcatggcaccagtgtcgttcctgtcacccacggcactgagctctgccctggtaacgtccctccctccctcttaggctttggccacctgcattgttgtgctactgggtctccctgctaaaggttctgcttcctggttcctgcaagagcagatctcagtttttctgttgtgttgttttgttttgttttgttttgttttttgttttgaaacagggtctctgttgcccaggctggaatgcagtggcgccatctcagctcactgcaacctccatcttccaggttcaagtgatcctcccacctcagcctcccacatatgtgggattacaggcatgtgccaccatgcccggctaatttttatatatttagtagaggtggagttttgccatgttggccaggcccgtcttgaactcctgacctcaggtgatccacctgcttcagcctcccaaagtgctgggattacaggcatgagccactgtgcccggccagatttcggcttttctaagctggccttccagcctctccatgcatcttgcccaccccactccacggcacagacctttgttccagccaaacgagttcttctccctctccacactgccatataaaaaaaaaaaatctgtgaaaatcctccttcagtacccaattcaagcaccacctctcagtgcattctgatgtttgggaacatagaaatgttaagacccattcttgaaaaatatttcacatctgtggatgttaaggtcacactatttcatttgtttcaaacaaagtgaacgaaatttcagagttgaattttttaatcttctcaaacttatttttggcttagagcggtctctaatcaaatggttttcatctgatgggcagggatctttcagaccctctcactgcatgcaggatacccctcgtggactgctctagaccaatcccaggtgcacgaggcttggggcaggagaggcttctttgtttctgtaggagccctttgcggggaggacattttcctgtttcctaacatgtccctgttccctctctttgtgcccggtttattcagcagacgtgttttcagcatcaaacagatgccaggcttgctcctagccctgggaacatagtcacgagaagtccttggccctgtctttgcagtggccccatctggagggagacaggctggcacagagggtagggtgcgtgtcctggggctcccctagaagcaggcgcagtggacagagatgtctcagaggaagggagctgggtctgtcgcagatgggtgcttcagaaagatcgcacctgagacagcacggaggatgcgtgtgggtgtcagtggggaactgggcaggtagaataagaggagttcaggaatcacttctaccctttgcaggaactgtgctaaatattgcgggctttaaaattaagtaagacattggcctatgttgaaatacagcaaaaacgtaagatggattaatgaacgagtaaaagatggatgaacagatgtgcgtgtgatcaagcagatggagcacattgctcgtggtcgaatctggtggttgaaatgggtgttcactgtagaattctttccgttttcctagatgcttgaaattttccaaaataaaatattgagaaaaaaattcgtgcaagaccaagttctctgccctcgaggcatttacagctgcaggccttgaggagtttctttggttcctgaagggctgcttgctcaccacgagcagtgtttgcacaaatagatgcgcttcttgttgcctggctccatggctcctcctagagcattgttttcttattcaggttagttcagtgtctaattctaatgggaaaattgttttttctaggtttatttatgaaacagagcatcataatggcatagcagagttactggaaatattgggaaggtaagcctctgttatgggtagcaaacggctgtagatggaatttataccagagtgatccatttcattgagtccagctgcccgctttaaagcaaggcagtttaaaccattctctaaaagaattcaaatacaatttcactgaaagcaggagttggtgagctcttagattagagcacgccaaatgacaaatctctcccatttttatggttctgtacgtagattctacttcgtatacctcagtatcattactatggaaacacaattccagttatttcctcaagagcaatgttaaaaatagttaacctaagaaggtttatattagaagcttgaaagaagaatagattgtacatttggggtatcatgtaaatgctaatatttttaattacttcagttttttatatgtatatttataaaataattaacatttcaaaactttcatcatctttatccaagtaaagtttttagttgcccttttttttttttttttttttttttctttttgagactcttgctctggcacccaggctcaagtacagtggcacgatctcggctcactgcaatctctgcttccctggttcaaacgattctgctgcctcagcctcccgagtagctgggactacaggtgcccgccaccatgcctggctaatttttgtatttttagtggagatggggtttcaccatgttgcccaggctggtctcgaactgctggcctcaggtgatctgcccgcctcacctcccaaagtgctgagattacaggcatgagccaccacgcccggccacttttatttaattgataacccgtagattttatattagaccttctaacccactgtttcccagagttcctcagggtcccatggttagtaagtgtggaagtgctttttcctgcacctttttagggatgtagtgtagatgggcagttccgggttctcaggagcctgtggtggagaagtctggcactctggatggatctagtgacgctctgcagctcctgagcacaagactctcttctcagggtggatcaggtcctgcccagtagttctgagaaaagctattcttgccactttagatgtaatttgaaaaaatgtcctcgctgacaattcttttagtttagacaaacttgggcggggtttctccctcagtgcagtgcagtgagtggtgaagaggatgcctctcttactagatgtgtgaccatgggcaggtacttctgtaagataggcgcatcctcgcatttccctcctaggttgttgcagggaccggagcgctgtatgacatgtgttccacagcccgccatgccgtgtgcgtagggcccccgtgtgcatagggccgccgggcagctcccgccgagaggctgattagttttatccttcttccagatgaggctgagccttcgggtgaccctgtgagtgagcacaccctccttgatgggccgctccaggctcgcccttcccgcattgtccgctgtgccgcgcagagtcagtaatggaagaccaagttagagacagctctgtctacttctgcagctcagtggcagtcactcccgtttgcctaattacaaaaccaagacaataaactagttgtttgagacaaaaactttgctttggaggctctaggtaggacctcttttcttgcacaagggaacagctttctgtttttttgtttgttttttgtttttgtttttgagatagagtctcgctctgtcaccgaggctggagtgcagtggcccgatctcagctcactgcaaactctgcctcccaggttcaagcaattctctgcctcagcctcctgaatagctgggattataggagcccgccaccgcgcctggctatttttttgtatttttagcagagatgggctttcaccatcttggccaggctggtcttgaattcctgacctcaggtgatccacccacctcagcctcccagaatgctgggattacaggtatgagccaccgcctggccctaactgatttttaaccagctctcatccagcatccactgggtctctgttaccaacattagaataacatacctgaattactccaggcagcaagaatgcctaccagatggataaggctgagggaaggtgttgggtggggggtggggggggtcccacgtgaactgtcccgtcttcctggcctgtttagggaggaagattttgccaccaggagctcctgctgttgagccagctccctgctgttctgggtaacacctgtaaacccagaatttttaaattatgtagttacaaagataaaaataactatacttcctggtaggcatttagcatttttaaactttttgctggtatcctcttttttctgatacacacacacatacacacacacatatgtatatatataggaagaatcctcggatttccctcttaggctgttgcagggaccggagcactatatgaagtgttccacagacccctatataggatctcgctatactacccaggctagagaacagtggctcttcacaggtgtgattatagcgcactacagcctcgaactccgggttcagatgatcctgccgcctcagcctcccaagttagctggggcacaggtgcatggcaacatgcttggctacgtatattttgcctgctgggttttgatggtgaaaacaaaaattgaaagacggcaagatatttgtttaaaacctggaattcgtaaatgttcaaacctaataaatgttctttttacagtataattaatggatttgccttaccactaaaagaagagcacaagattttcttattgaaggtgttactacctttgcacaaagtgaaatctctgagtgtctaccatccccaggtaaggggcagcaggactctaggaacacagctgttggcatttgatcaggattgaacacgagatagtgaatccggccttgactgagagtgctttcttctttataggcctgtactaactttggtaacaaacttctggtgataatcgaaagaataagggggtaaagagagattccttttaagaaattcagaaaaatctctgtaatacagaatttttcagttttaagcattgagaaaggagtaactctctgaaaggagtctaggaagacttctgagaggagttttctgtagtgtaatctaaaattcagtaccttaaagagaaaagcctatataggtccatggccaatgaatggcctatgaaaacgttttttaaaaaaataaagctgcctataatcccagcactttgggaggctgaggcggacagatcacctgaggttgggagttcaagaccagcctgaccaacatggagaaaaccgtctctacttaaaatacaaaactagccgggcatggtggcacatgcctgtaatcccagctcctcaggaggctgaggcaggagaatcgcttgaacccgggaggcggaggttgcagtgagccgagatcgcgccattgcactccagcctgggcaacaagagtgaaactccatctcaaaaataaataaataaatgaatgaataaagctgtgaattttttaaactgtagtaatctaagtacagctgtactgaaaaattggtcaataagtggttaatggactgcatttacctggatttggttttctctcactctttggctgcagtgggcgtctttgttcacttccggctgtcacagggccaggcactgagcagtcacgccccagcacaggcacaggggtgcacaaggctcctctctgccaggccccactttcagagcttatggtaggggctaaatgacaaaaagtatattctttaattgattcttcctagaacatatttattttctctgactgctcttaactggtaatatctttgcatccagccagattatcatattgttgtacaaaagaaattaatagttcagagatttaagatggaaccagattttaatttgttgttccccactgttagatgactcgttgattgtagtctgcacaaggaccccaagaaaatcccatcatactggattgacttagcggtggttagactaaaaagactgtttcctgatttatttttcttatttttatttttcagctttctgatctatcaccaattaatgggcataaatgttaatgcccgttaatcacacaagggctttgtctgtaccgtgggtccttgtcttgctgtgggaaggtgtttaacgatgattctagaagaagcacagcagcatttttatgttgaaatgttaatgctctttctccttttactttttagctggcatactgtgtagtgcagtttttagaaaaggacagcaccctcacggaaccagtaagtactgatgctagcgcgtcttgtaagatgtgtgcatttcactaaatgtaaatattacaacatctgcttcaccaaattgccattcattcagactttttcatcttaaattgcaatactaataaacaggctcatttcattcatgggttataggttttcaaagtatagtcattttaattgcagattcctttattatagtgattattttatgtaatgagattgccaccttgtccctcgttgcactttactgtttgaacgtaaagcacttgagcggttattgtagccactaaattttagtgtgcaattcagtagtttcacatctgcttggtttgacaacatattgaactgattatgatcagaggaattatagttagggtttgaaattattgttgtactaaagaggctttaccgccttgaaaatacttcccaagttacactgtaactattttatgatcattgaatcacaagtgaacgttagattactgctgttctgtgcgtggatctgtaattttttttcagcctccataattatgtcagaggatttataattttcttaacattttatgtttattaaaataggctatcatagccagggttaacaaagccagacatgtcaggtgccagtttaagcatttaaatacattttttgaaacaactttattgagatataattcacataccacacaattcacccatttaaagagtacaattcaaaaatttttgatacgttacattttgaatttttttaaattgtggtaaaatacatataacataaaatttgtcattttaaccgcgttaaatgtacagttcaccagcgttaatgacattcatagtgttgcgcaaccatcaccactatttccaaagctttgtcatcatcccaaacagaaattctacccattaaacaataactctccgttctccctccctctggcccctgctgacctgtaatctactttatctctgaatttgactattctaggtaccttatataaggagaatcataaaacgcttgtcctttcacacctggcttatttcactcagcgtaatgtcttccagggctcattcttgggttgcgtatcagaacttcattcctcatcatggttgaatgctgttctatcatatggatagaacacattgggtttattcattgttttttcagtgtacacctgggttgttcccaccttttagctattgtgaataatgctgctatttggatactggtgtacaaatatttgctataatccccattttcagttcctttggatatatatccaggagtggaattgctgaatcatatggtaattgtatgtttagctgcgggacagacccccatactgttttccacagtgactgtcccgttttacattccctgcagcaatgcacaaaggctcccatctccccacattctcaccagtgctgatgctgctgctgctgctgttgctttctttttatttattttattttatcttatttttttgagagaaagtctcactctgtcacccaggctggagtgcaatggtgcaatcttggctcaccacaacctctgcctcctgggttcaagcgattctcctatctcagcctcccaagtagctgggattacaggtgcctgccaccatgcccggctaatttttgcatttttattagagacagagtttcaccatgttggccaggctggtctcaaactcctgacctcaagtgatccacccgcctcagcctcccaaagtgctaggataacaggcgtaagccaccacacccgacctgttgttttaattatagccatcctagtggtgtgaaagagtatcttgttgtggttttgatttgcagttccctaatgactgatgatgttgagcatcttttcagcgcttgttgaccaaaatctgtatatcttcttggccgggcgcggtggctcacgcctgtagtcccaacactttgggaggctgaggcgggtgaatcacttgagcccaagagttggagaccagcctgggcaatatggcaaaatcccatctctacaaaaaatacaaaaattagccaggcatgatggcgtgtgcctgggcaacacagtgaaaccctgtctccaaaaaaaaaaaaaaaaaaagtgtatatcttctttgcagaaatgtccatttaaatccattgcccattttttacattggagtttttttttaattatttgagtatcaaagtaaggaatgttaggaaccaattcaaatgtttgaatgctcttttaaaagtcactgttagactagaaaaagtagatcttgtcactcctgggccctttctctctttcacagttcttttgtgaagttgtaatttttatagtgaaattgcatgagaaattcttaacattgaatttctgagttaaactggcttttgggctctgctttcttgtaagtttttaaattctatgtgtagattccctccatttcacccacaaaattcaagaagagctcttgtcctatgactgcagaggtagcaggtgctacagagccacgagctgggcccgccctgtcctgccgggccctcgtggaaggacgcatccctgcacactctccctccagcccctagatacctccgcctgagattttggggacctcccaaggaaatgtaccaaatctcatcacacttcagcatcaagcatagtcaaggcttagggtgaggaggtgttatttttatccttcttaacgactgaagacatgtttaggtaggaaaaagaaaaatgaacagtgttaataaaactcattggggattttttttttaaactgtattttctccagtggttacatgccctaactcttctgcctatatctgaggtattctccaaactgaagggtgagaggttgtatttttttttttttttgagacaggatctcgctctgtcacccaggtcccacaatagcccgtctgcaagctgaggagcagggaagccaggcccgttccaaagctgaggaacttggattccgatgttcgagggcaggaagcgtccggcacgggagaaagatgcaggctgggaggctaggccagtctagtcttttcacgttcttctgcctgctttatattctggcctctctggcagcttaggtggtgcccacccccattaagggtgggtctgcctttcctagcccactgactcacatgttaatctccttttgcaacaccctcacaggcacacccagtgcatccttcaatccaaacaagttgacactgagtattaactatcacagaggttttactggagaaagtaatatgtaaaaaaaaaaaaaaaatttatctctcccctcctctcccaccttttcctattcaaaaataaaagacaactgggcacagtggctcatgcccctaatcccagcactttgggaggccaaggcaggaggagcccttgaagccaggagtttgagaccagcctgggaaacatagtgagacctcctctctaccaaaaaaaaaaaaatttaattagctgggcatggtgacatgtacctgtggtcccagctactcgagaggccgaggtggaagagttgtttgagcccagggggtcaaggctgcagtgagctatgaacgcaccaacttcactccatcctgagtgacagagtaagaccctgtctcaaataaataagtaaatacaaatggaagggaaaaaaagctatggaaggagagatttttgaaagtatgtatttttctttcatgaattttctttgtgcgtatttctcatatcctgtagtggctgaacaattcaccaaatgccacattgcgtttaccacagacagaggctgctcccacctaagccactgtcccagcatctctatcccgccatccactgtctgtcagcctgaccctaaccttctccaccgagggctcggtgaatgagcctcaccctattctctcttccaccgaaaagtaacacaaaagcagagaatgtttgtaaaagtttttaattcccactaatatagtaaataaagtgaatatcactttgcaagagtgagagctgttaattgcagtcctgtctaaaagagggcaagagaccccgtgccggcttcagttgggtccttccggcgtaaatgttacatgcaggactctgacttggcaccagcacaaaggaggtgcaaaccccaccaacctaggccccgatgttcccacccggggacacttcattgcttagtttcctgctgcacagataatgtaatagtaccgtcctggctttagaaagcagattcaatttcctacatgttaagaacattcagaccctcatgtcagtaaattccctcttttgaaatgcctatttatgaaaacacaaaggccattttgtcttatttcagcattgaaagcttgttaatgagatgatcaaagtataggctttggtgcaggtgtacatctcttggtagcactaaggacacctggtgtccacgtccatctcccaggcctgcaccaaagggactcctgaagccatcaaatgtccaggctcaggaatgtttaaagtaagatccacttagaagactgagatatgaaggacatgtgttgccccatttgtagcctgtaattagtatttttcatttgctaattgtgtacagtgctcaaaagctttctgggcacatgaaacactttctctgttggaagaataacaaaagctcatcagagattttacagaagtaaaactgtgttccgttttcacccacctgcctcttcagtctcatcacattttactacatggcatagtagcggctctcctttctccttggtctaccaggacaggaagggggctccccaagactcaaggctggggccactggctcgcctgccctctgcagggagcgggcagtccttgggcttccaaaggaaaactcggggccttgtgctgcacccagcagcacacagccattgttgcctcggattcacattccctgagtagacaccctcctccacagagcacgccacactgacgcagcaaaatagctgataccgatcacagctcattccaaacaatgtgaacaggaaggcccgtgtgtgaatccgatcccagaaatgataccttttccagagaaatggaatagctaaatcggttgtgttgtatagttcacaaattaacatatttctcctaataaaattccatttgacaaatgaagagaaatagatgtaggaagtgatttccatctgctgtgtccttaatagtgattccaatacacgcaaagtgtggtaggaacacaataaatacttattcaatagttttgagctaggagaaccattaaatgatgcatttttagaaataattccttttaaagacacttgtatggtagatttttatgtcagacttgaaaactagcagcacttccttttttatttttatttggctcttttggggtttttgtttgtttgttagattcttggagtacagtggcgcagtcatggctcactgcagcctcaacctcctgggctcaagcaatcctcccaccttagcctctcgagtagctaggaccacaggtgcccatcaccacaccaggctaatttttaaattttgtgtagagacaggacctcaccacggtgcccaggtcggtctcgaactcctgggctcaagcattcctcccacctcgacctcccaaagtcctgagattacatgcgtgagccaccacgcccagccttactttcctttgtttcatgaattttggagttttataaagtgtaatatcataaaagattacctgggagcccaaatgccaaagcatcaaaacaaaatttttctaaatggatgttaaatgtccacctttttaaaaaatcactgtaatgactaaaaggctggcctgctaagccatgagttggtgcgatctactgagctggaaatgactagtgagtgaaaacgaccaggcggtcccgggggccagcacttgtggcaattgcacagcacaagagtcgggtagaagccccgcggtgttgctgtgacgaggccaaagagctgctctaacgcaccggattgcacttgtacaattcagtgtgtaagcacatatatgcacttcatatgcaaatgcctgttttggattgttgtactcttttagaactaagatggctaaactctaaaaatattatgaaatctgcatggattcacattcagtattttgtactggtatgattgtggtaagacatttggaaactacaggaacatataaagaaaggttgcccagtggaaattctttctagctgtctgacttggccaaggaacataaaacatccactatccacaaactgggaaaccactgcagtccgacgggctgtgcctggcagagagctggtggcacagaccctctgggtggtgacaatcctggctacagctgccactgcagcctgctcaccgcaggcccagcactgctcaggctgttgtatctgacgcccacaggtgtgcgcacagagagcacagtacgccctgcccgggaggtcccatcgcagtacctgtggatgtgagttaataaggtcagcttaattcacatcactccttttgatatattttaacacagttgaaaacactgtctatgcatacagaagtatgtgtgtttgtgtataaacacatatggatggttgataaatttgagaaagaaatgggttgtgtacacgtggcccacagtttcagtactggctgcttccacaactaaaatgtacacatgaattgataatgctctgtgttttctccgttgatcttattctttctaaattattgtcctaacttcttatttttttttctttttttaaaaaaaggaatggactcttactgaaatggtgtttgatcagagaaagtgggttatataaactaaaattgtgtaatttctgaagtgtataaaattaagccaggcaggtggtacgtgcctgtggtcccagctactcagaggctgaaagaggaggatcacttgagccaaggagttcaagtccagcctggacaacataatgtgacccatctctaaataaattgattgatcagatagataaccagacagacagacctacttctcaaatacagaaaatcacatatgatgactgagtcactgttccctctgtaaggaagatggcaccatctccgtgtgttgccttgcagtggggccaccgcagtgaaaacacagacttcttaccatgcaggtgttggggcctcgtgggcatcagtcactccacgtgtcatttcttttgtaggtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtatgtggggcttgggggacctgattaaattcttccagtgttcatttgggaaaggaaaagttccatgcgtagctggccatgctttgcctctcatgcaatttaaaggtaaaatccaagtttttacttgaattatacttcaaatacgatgctgtaacttgaattctatagaatacccttgagcatcttgtcccttctgccgcgatactttttctcactaagagcagtcatctggcttctctgtaaagctgtctttatcttcatgttcagtgtgcttccaagttcataaacaccctcctttccacacctgagcatcaatattgatagacaacgggtggccaaagcctcggctctgagatgctcttgctgccgaggcccttcgttcctgacactgtgtaaatctgtctccctttaccctttcaaaaaggctgagagctctgacttttgtcactgccaaattcctgtgcgagaggacgaccttggtcagagctactttctactttcttttcccaatttccttaacccttcaagccagcctcggctcatcacctcttttgaaggccacccccacacaccttcccagcctgcctgcctctgttggacgtgctagccacctgtccttttgcatcattgagcggattttattgtgcactcatcatgaacaaggtgaaaataggcacaaaataagcaagacctcccggtgcccagggagcaggccacacagtggaagagagtgaccatgtcacaccaccaccttacagccaaacgtgaagggccaggtggcgtgtgcagcaggctctcagaaacacatgggcagttaccttagcacaagtctaagtggttagaaaaagtccacaagaatgaggggtcctccaaactgagcctttcaagatggttttggaaagagatcattgaaaccaacaaaactaagacaagaaggcaagtgatagaagagtaagaagctctggagcacgggcagccatagtaaagtgaggccaggctgagtcgggttaaaggaaggaactgctgtggtgtagtctcttccatacaaatattcaggttattttcattttataaattccaatgagttttcacattaggaactaagaaaggaaaattatgttttgggttttttttttttttttttcatcaatcctggcctacagagaaaataatgtttctcaaggctttcagtgtgagcactttgcacaaaggagcatggtttcctagaaactgtagagaccagcgccacggagccctggctgaagtacagggcgttcgtatgccaaggagagactggcagtcgtgggaagtgtcccaaaaacttgagccccttccccagatgcaaaattagctatcgctatgggtaacgttagaccttcaagagaagacagggacaagtggactcacaatgtgctgttttgcataaaagcatgtgacagggcaaggaggaagggaagtccaggtggggaaagcagagccaaggtggccgcgcagctgccagtggcttgggtgccactccacatgtcacagaagccttcacgtccctgccaggaacagagcatgaaggctgccagggcggcctgccatgcctctgatgagggagttcagtgccaggacccactcaggccttcagctgcaggcccagccccccaactcgccctcgtctgtgtcccccacgcacgcttgcgcccatcttggcttctgcttcttagaggacctgatcagcacagagtacattccagaatcttttccagacacatatgcataaggccaactcattcttaattttttttttttttcctttgagatggagtctcactctgtccctgaggctggagtgcagtggtgcgatctcggctcattgcaacctctgccttccaggttcaagtgattctcctgcctcggcctcccgagtagatgggattacaggtgcgtgccaccacacccagctaatttttgtatttttagtagagacggggtttcaccatattggccaggccgatcttcaactcccagcctcatgatccgcccacctcggcctcccaaagtgctgagattacaggcataagccaccgcgccagctcattcttaacttttagatgtttttttcacacccaaaaaaagtactggttttaaaaactggaaaaatttaaagtttaaaccatcaagcatcttaagcttctgttttctaaatcaggcttaaaatattacccccaaatatattggtgggtggtgggtgggtggatggatggatggatggttttgtttttggtttgttttctttttagacaaagttttgtgcttgttgcccaagctagagtgcaatctcagctcactgcaacctctgcctcccaggttgaagtgattctcctgtctcagcctcccaagtagctgggactacaggcgcctgccaccacacctggctgatttttgtatttttagtagagacgggatttcaccatgttggccaggctggccttgaactcctgacctcaagtgatccacctgcctcggcctcccaaagtgctgggattacaggcgtgagccaccatgcccggcctagatggttgctttttaaagtacaaggtattgaactcttaagtaagaactagcctaggagctgtgatgcgattgtgccttgttttgaatccacgccgcactctcatgcatgccctcccctcccccattacctaactcactccttttctgcaaagttcatcccagctcactgcctctgaggaatcagccctgattcctgagcctggcacaggctcacctgccattctctcagcatcccacccatacacaccgcaccacaacctcaggatctctaagctgtaggcttctggcaggagaagcgtcagccccatgctgctcagagcctccaagtgctgctgtgagttgtgtgcagatgaagggtgttgacagtagttatacaggtgaagctcctcttcccagaggcatacatgctgtgatggggacaggccaagtgtcctggtgactgcctcgaactcccagatagttctgtggaacgtgcacttgtgtgctggtttactacggagagaaaaagcaaatagggtagggtatgaacagtgttgaatctgggtggagggaggtgggcactcattatgttagtcttgcagctttgtctgtttttgaaagttttagtaataaaaatggggggctgagtgcagtggctcacgcctgtagtcccagcactttgggaggccaaggcgggtggatcacctgaggtcagaagctcgagagcagcctggccaacatggtgaaaccccgtctctactaaaaatacaaaaattagccaggtgcgatggcgcatgcctatagtcccagccactcaggaggctcaggtaggagaatcgcttgaacccaggaggcagaggttgtagtgagtcgagatagcaccactgcactccagcctgggcaacagagtgaaactccatctctttttaaaaaacaaaaatggatgggctaggcgtggtagctcacgcctgtaatcccagcactttggaagaccaaggcaggtggatcacctgatctcaggagttcgagaccaacctgaccaacatggcaaaaccctgtctccactaaaaatacaaaaaagccgggtgtggtggcgtgcgcctgtaatcccagcccctcaggaggctgaggcaggagaatcgcttgaacccgggaggcagaggttgcagtcagccaagatcacgccattgcactccagcctgggcaacaagagcaaaaatccatctcaaaaaaaaaaaagaaaagaaaaatgggggaaccaccctctagtggcttcccgtgagtaagcgccagtgcactcaggccctgttcccctgccctcctactgttcatgcccccactgccctctgcagtggtcctcagccagccccgtgctgacaactcaggacctctcctccctctggtccttgctcagatgtcacctcctccccattgaagccaccccaccgcacacgcaccgccgctgcctgttctcctgccctgctgccctttgtatgtgacttatcgtttctagtaaattaataatcatccatcacctgtctcctccccactagaatgtaagctccgtggagtcaaggatttctgccttgctttgttcagtgctgaatgctcagcagaacacagcacgccctcttgacctgacagatgggggaggcgggtggataggtggaatggcctcctttgagttgtctcctcagcatctagccagcatctagcataaatgtttacggaataagtagagaaataggtgacaatgttcttgatgagttgatgtacaagaagttgtctgcctctttgttgaaggctcttcagggttacaggttacagtctagaatattttgaatttgtagaaataatcataattttctggtccaaggtagttcattacccgactcacaggtttaacagcaaggacagccacctgatgtctcaggcacaacctccagcaagccatccacttgtgtctttcaggtggcagagcgagctctctattactggaataatgaatacatcatgagtttaatcagtgacaacgcagcgaagattctgcccatcatgtttccttccttgtaccgcaactcaaagacccattggaacaagtaagaaagaactggctgccatctttttcagtcattttaaaatatggcacgttttactgctacttcagtaagaataaatatcagaattttaaatatcaattaaaaaacaagaaggtcagttgctttgtggactcataaattaagtagcagcgtgggttgtttctgtggccgttgaatttaccaccttataccttcattcctgccagtatagaggcacattggtttgcagccacctcccagtagcagcagtttctaggcctcttcctgagcgtcctgcagagaagctgaaggtctctgcagagcccagtggggctcagccccggcgggggcacagtggccactgcattctcggggtgtctattgagctctgctgacatgcaccctggatgagcccctgtgtgagacccaagaaccaccccacagtggtcactacctggagaagaagagggaagccaggtgatctgaacacagccccatagtcccagcagccaaaaacatttcctcctactccgctccttcatcttttgacttaaagaggatgaataaatccgtttactgagcaatagtcttctgagactttaaaaggaaactgttgatatgggtgccacattatttatttatttttcttttttaaaatttgtattttatttgtttatttttagacagggtcttgctatgtccccccggctggagtgtagtgtcacgatcatggctcacttcagcctcgacctcctgggctcaagcaaacctcctgcctcagggtcctgagtagctgggactacaggcacccaccgctacgcctggctaatttttgtattttttgtagagatggggttttgccatgttgcccaggctggtctcgaactcctggactcaagtattccacctgcctcagcctcccaaagtgctgggacgacgtgagccactgcgcccaggccatattatttattaatatggtatcatctaatattcctgctatttaaagaaatacgactgagtttttctttccccaccttctttcatctctttccattgtatattgtaattataactcagaacttaaagaagagcaggttatgctatccagccctcctcccttagtttatgggtgaggaaggtgagacttggagggcattcgcagcccagtctgcggtcccaaagctggtgagcggcactctggcccggtgcggtctcctaactcgcagtgtctattgggcacccctctggctgtgctgcacagtcaccctgctgccggcggaccagccctctcccatgcaccctctctccttgtccgctcgaggctgcaggtggcactgcctccttcccagaattctgcagggcagcagccagacaggtgttagccctggagctctgagccagacccccgagcgagcgtccagccagtccactcgcgtcaagtcttctgagggttgccgcccagaaattcaacagagaagggcaggcagatcagagtgaggatgactttggttcacattcctgccttcctcctgagcagctgtctgaacccggggaagttagctctcaccaggtctttcttagccacagtttctctttggaaaaactgagaaagtaaagtgctttgccttgcaacaatcttcacttggttgtgaggattaagataaagttaatatgcgtaaagtacctggcttatgataggcaccaagtaagcatttgctgtcacttagtggttgtagggccagcagccatgctgatagcagtggaggcagcagccaagaccctcatggcaatagcgtggtggttgtagttgttaatacagcacatccaccctcaacaacctgttctttgtagcattgatttattttatttatttatttatttttgagatggagtcttgctctgtcacccagactggagtgcagtggcaccatcctggctcactgcagcctccacctcccaggttcaagtgattctcccacctcagcctcccaagtagctgggactacagacatgagccaccactcctggctaatttttgcatttgtagtagagatggggtttcaccatgttggccaggctggtcttgaactcctgacctgaagtgacccacccgcctcagcctcccacggtgccgggactacaggtgtgagccaccgcgcctggcttgcattgatttttttttttttaatcgcaacaatgacaacaaagcccctggagtgtcgccatgtttcttgtgtgtaatttagtttagtatgtaagtcagcacaattcataactgacttccaatccccgcccattgcaaagaaaaaaatgttcttttaagtgttttctaagtacaacttgggttttattacaaagtggattaagaaggaattatgatttgagggttacgttttttgggatttatttgtttttagctactggcacctgttgctcacagtcctgcgggtcgagcaggtcctgctgcgcaggctttcgctggtgtctgctgggggatcggggctcttacagggctgcagtcccatggcagctgggactagagtcacccagaggctcagctggaacaatttggcctctttccctctccatgcgtgtcagagcctgagagctaagcattgattaagctgttttatgctcattttattttctctttcaaagctctgtgttgccattattaaaattaatttttctgtcctcagggaataagatgaaaagaaactgacatttataggaaatcaagtattgccattattgtcctctttataattttgtcttaactatatttgttcaagtttcaatgtttttaattcagtttctgagcaaggtcgtttttggctactgtcagctggagacagtgagtggagtggcctctgtggctatgtgagagccactgtgaagaaagtctcgggatgtgtggctgtcagaaaacaagtaacgcggaatgagcaggccttgcattttagaccttagggatcctgtgcgatgtgggactgttggaatatggagcagcctgagagtggagaggcgagggctcagcaggaatgcgtgctcccaggctcaccgtgcggttttctttataggacaatacatggcttgatatacaacgccctgaagctcttcatggagatgaaccaaaagctatttgatgactgtacacaacagttcaaagcagagaaactaaagtgagttgttcctttcacaagttactgtttccaggatttttttcttaatcctaagtaaacctcttccactgttttgtcctaaaacggtattcttcactcgaaagcaaaaccaagcctttcatacttggaaagcaaattaaaactgtgttataataacgtattttgaaagaacaggtgtttaaaggtagctattctccccccttgtattgccagattaatcatctttgcaaaaagtgcttatgtaagcaagaatttaacattcagaattttttcttttcttgggctataatgggcttaaaggctataatgtgtagtccattttcatgtttataaggcagggatttgaattatatcctataaggtttatcccagagagcaagaatcttcatttcaatgtagctttattctgatttaatgaactcagcgatgtgggtgttctctggaatctagtctgtcctttgcaaaatcagggtcctgccctcgtgcctttgagcccacatgtgtccagggatgatctaagtgacaaagtacttcgtccctaggctgtgcaagtaataatgtgattaaatagttgttggaggtcacttcttccaagttgagtatggactattggcagattttattttttgcttgtcacttaaaactggctaaggtagataagctttgcacgaatgtaattcaaaatacactgtatacatatgtgtgtatctatgtgtgtgtgtgtgtgtgtatatatatgaaacaactgccatttagtcattccttagacaaatatgtgaatatttaccttatacaccaggccctgttttagattctggcaatatagcaatgaataaaacccacaaaaatccttgcccctgggccgggtgcggtggctcacgcctgtaatcccagcactttgggaggccaaggcgggtggatcacaaggtcaggagattgagaccatgctggctaacacggtgaaaccccatctctactaaaaaataccaaaaaagggccaggcgtggtggctcatgcctgtaatcccagcgctttgggaggccgatgcaggcagatcacgaggtcaggagatcgagaccatcctggctaacacaatgaaaccccgtctctactaaaaatacaaaaaaaaaggccgggcatggtggctcatgcctgtaatcccagcactttgggaggccaaagcaggcagatcacctgaggtcaggagttcgagacaagcctggcgaacacagtgaaaccccgtctctactgaaaatacaaaaaattagccgggcgtggtggcaggcgcctgtggtcccagctactcagagtctgaggcaggagaatggtgtgaacctgggaggcggagcttgcagtgagctgagctcacaccactgcactccagcctgggagacagagagagactccgtctcaaaaaaaaaaaaaatacaaaaaaaaatcagccgggtgtggtggcgggtgcctgtagtcccagctactcgggctgaggcaggaggatggcgtgaacctggaggcggagcttgcagtgagccaagatcacgccactgcactccagcctgggcgacagagcgagactccgtctcaaaaaaaaaatccttgcccttttggggtttatattctgggtagtgtggggaaataaaagaacacaaaatacacctaagtgaactatagagcatgagagatgacaagtcagtcaggaaagggccggggagacagaccagccattcctctagagctgccagctgcatggtctgttctcatctcagctctcagtgcagttcgcaggtaggaagcatgcaagcagcagggccttctgatggcagatcctcctctcgtggaatcccacagctttcccaacaggaccttaaaggttgtgtagtacattttctgggttgaaaaacttggatcctggccgggcgcagtggctcacacctgtaatcccagcactttgggaggttatggctggtggatcatttgaggtcaggagttcgagaccagcctggccaatattgtgaaaccccatctctactaaaagtacgaaaattagccgggcggtagtagcacgcacctgtaatcccagctactcgggaggttgaggcaggagaattgcttgagctcgggaggtggaggttgcagtgagccaagatcctgctactgcactccagtctgggcgacagagtgaggccctgtctcaaaaaaaaaaaaaaacttggatctgagttaagcgattgaaagtcatgtgactcgcagtggagtcagtcaacaacccaggtctcctggctcttaagacgtttcctttttaatattataggaatgggaatgctggctccttttacagtactggtccctttacactgtactgcatactcgttttttcagtggatatatgagcttcttgtcaaaattatgtgggtcccatgaagaaacatctaaccaggggaagggggaaggattgagacataagacgtacttatataagatttcttttaagaattccaatcttggacatgttaaatttttttatattttctcatgtttaaatctcagttcgtttttcatgctgtgctcagcacgtaagtgtggggaaatggagcaggggggctgcgggaggagccgctggctgggctcaacatgcctgtgccttttccccttcagtgtgttcttgtgtctgatgcatctctaacacagatgacattttactgtttttcagagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgtaaccctccttttgtacaagtacttattttgccccatatcgttttaccacagaattgacttttttcctctgctttttaaataagatctgaatcttatgcatatactgtggtaaaaagaaaacttgaatacagcctgagactgtgcctcctctctcagatatcatagatgctgtcactcaaacagcatttccctttctttttcatatgaaattagttctaaaagaaaggaaattagattggaaatagattaagtatgacgttttgatgtcctctttctttgtatgaggtttctgtaagcccagccttttatcattaaaaatcagctgaattctgccacattagcagccaaccctccttcccaccccagcagcgggtgccagtgtgctctggtgagtctgcgccgatggccggacgtcccggagctgccggcagttccagctgccggggctgccagggtccgggagggtttcctggtgtcatggtctttgggtttgatgtacgctgctgtaaatgactagagcgttatgacagtttcttcacgttctgtgtgcctgattataacagtgcctcttaaaaagaaaatctttttcagaaaatcttttgtctgaatctttgccactcttaagaattctcaagctttccttcaactctccagaaaagattttaccgaacaatgtatttcttttagtgagagatatgcatagttacctaagttggtttttagatttctctgacacttaataaaaagttatacatgaatataaagttaaaagtatatctttacctatataacaacatactggtttgtatactctgataaaactgcaatcaggaaactcaaatcaggaaaacggaatgacatttctaattgtgagcccttgagtccacctaaaacaggtagccagcatttttctagcagttatttactcatgctgacagaaatgctgttttaagattactgtctaaaactgtataatccttaattgaggtaggtagctataggcgtctccttttaacgaattgaatttatgttgaaagtgtggttaaaatactgatatttgttttaaaacatggtaacactataaacctgggcaagtttataaggcccagccctgcctgacgctgccctgcgtgtcttgctttgttctgaagagcctcaggcaaagtgggtgctgatagccctcaggattgtcaaggaccccagtacacatgcagttgaaatcagtagcctcgaaaacatgtgagaaatgaatacacacacacacacaaacacacacacacgaatcagaaggtctgattttatgtacctagaatatagagataacttattgaaaaattgcataaaattgttacattacaaatcaagagctggttgtttgtgttgacaaacatggcccagtttcactactgcacatactgtacgtaaccaatgtttcttctgaaatacgtattgttctcttttttctttttctcaacttttcctgaatgttctcaagtaactttctgtattctttttggttgctctctttgcaaacgtctgtggtggtggcaggcatgccgtggttctgcataggagctttgacgaactgtgatgctgggagcttagccctgccttgtcctcatgtctgtgttgacgccatctgtgacgcagtccccatgagtctcgtccacatgctctagtcgcatggcacatggtctcctaaacagaaaatacttcatgggtcaatacctcagagctggaaactctggcctcgtacttgcttctcattctcaggagaaaatatctaaattctgatcactgcttcccattacaacagcaacaaaaagtcaataattttgtggataatacagtctggttatttctgtagtgaaaatagttgggttttcaaagtttggttttccatctcagatctgcctgtggagaattggtttgcgggctttgtttttaaggtgggttcccagggactcgctgtgtgttccctgatgccccccgtccttgcagaccgagccttcgtccactcaaacgtgtgacagcacgtacccagcaggcgttggggacccgggaaggctgcggtgccctcaggagtgtgtcttatttgagcagttatggcaactttattggggtttttaatgtcacagatgatttaattttctaaaatcatgaaacattggcagtttctaacataaatgtgtttctcctaatccatcaaaaggggccatataatattttactactcacttcccccagcttttgtgggaatcatatgaaatgaagacaggcacttctgtgagactcagagtagctgtggctcagtgtttgcaacgaccaaaactgccatgagcaacccagggcagggtctgggacggatgcctgcctttccttcgagagaggagctcatgtgcggaatgcacctcagtgaaggtttttgttttggtttggtttggtttggtttgatttggtttggtttgtttgagatggagtcttgctctgttacccaggctggagtgcagtggcgtgatctcggctcaccacaacctccgcctcccaggttcaagcagtcctccggagtgcctcagcctcccaagtatgctgggactacaggtgcacgccaccatgcctggctaatttttgtatttttagtagagacggggtttcactatgttggccaggctggtctcgaactcctgaccttgtgatctacctgcctcggcctcccagagtgctgggattacaggtgtgagccaccgcacctggccttcagtgaaggtttttattcctagtcagaaccctctcctgccagtgcccgctgtgtgaggtttattttgctgtgaacatctggtagcattcttgtgtagggacactctcctttgccccgagggccagagagccgtgctccaagcggaggctgttggtgggtcccatgaagagcactgcttgttgcctggagtagtcaaaagcagaagaagcgttggtgtgaaacagtccccgcaagtctcaggagtcttgcagccacttaggtttctgtatctcccacctgactgtgagccccctcgaggaaaggtgctgtgtcctgaattgtggaaatttctagggatacaaagatgagaacaagacatagcccccagcctcagggagcttacagtccattaggagaggcagatgaattcagctcagatgatcagattgtattaataacatacctgggggagtgtgctggagatggcaggaccagcttattcgttcccatctctaaagaaagacacacacagtacgggggcctggcctcttggtttgactgaaggggcctcacccagtcagacttgagggaaggtgcccgcggcagaggtagagaaaagcagggacacagtgggtgacaggtgtcggtcctggtggggtgtcagttatggggtgggccggtgcgatctgctgagaggtgagggtggagagggagcagaattcccccaaaatgtcagcagatattaaagagccataaagggcaaaatggcccagcccgacttgcatttttgcaagctctttggcgcagcatggatggagtgctggggctgtcggggtagggtgtggagatgtgtggagatcgtggtgctgggcggagctgtgggagtgaaggcacagggcgctgaggacctggtctgactggccttcaaggaaggaacccagctgagggtgtgtgccccgtctgtttttgggggacgtggaagccaggtgggctgagttgagcagcagggcctgggcctggaggcatggaagccagggtgaataaggagggacagagggtgtgggaaaaggccgaagacagcccacagaggaaggagcccaaggcacctggaggagaggctggggtcacagagaccgagggagggtgcaggttcagggctgaatgatggcgtccatggtcatcattcctcagagaggcccagtgaggcaaggccgggaagggcttagcagccagagggcacccataggcctcatgccagaggtggctccgtcagaggatgagggccaacaccagacggtggctgagaacggagctgctctgggctggcagggtgtgaggggcaggggtgagggggcagggggtgagaggcaggggtgaagcaggtcagcaggagggcgctgctgtgacaggagctcagcctgaaagaggccgaagctgtgggactcactgggcagagaatggaggggtgtggatgagagcagcctgggcaggaacccccgctcccctctcctgaactcagaggccctgagcaagttccccagcccctccatgtcccagttcccccatcagccaggtgagggtggcagtacacacacacgaccacgcaggacaaacaggcgccccacacagttcccagctcacagcagacacagatgccacttccttcgcctgtgccctcagagccagcagacgctcgtcacagtcatactgtcctgtgcaccctgtctcatggaaccctcacagccaccctccggggtgaccttacccccgcactacactcatggaaatggagtcaaccaggcccagtgactgagggctgagccatctgtgtttcaatccagagcacagggagagtggagaagtcccagggccgcccgtagggaatggagagggagcgtcaggctcacccaggctgcgtttgttttggtggagagcaagtcacccgggatgtgatgagagggtttcataagcaagccgggaaaatgggataaaggggagagagaaccgtgccagctgtctcgatgagaggacatgatcgtgagaggaaagggaaaagaatcatgaggttggaggtcgctggcaaagaatgggcggccagaggtgagggttccagtggtgagacagctcccaccaccgagcccagggtgcgacctcgcacttggctgctcacgtggagtcagaactgcagaggccatggggtgtgggccagggtatgggcgggccactgtccatcagatgcagaggggtcaggaggggaccagctgctttactgtctccactgagtgctttctggtttcagaagtcagcagccgcatcatgttgcaggtgtaggcgagtctcccactgagtgggcttcctgcgggagagggccctggggggcggcaggggagatgagtccctagccaggatgagaagcttggagttcagagcctgggcacctaacagagcgactccacgctttgcattgcagtacacagtgtatagtcaagccagcaccatgagcattccggttgcaatggagacagatgggcctttatttgaagatgtgcagatgctgagaaagacagtgaaggacgaggctcatcaggtaaaagtgcaccgagctcagctgggcacccatgactgatttgcttaagaaatgcacatttttgtaggcgatgtgatttgcatcagtgccttctgtttaagctgaaattaaaacttaaattttgctagtcttataggaaacattgtatcgatagatcttagtgatcaaattactagaaacagtttttaaggattaagtatgtgcctgagatgtgtatctccatttactaacagcagtagtaatcccaactcttaactgttctttaaatgttcactccagcaaaatcgaaagcttcacagccatatccacccctcgctgttttcttcacagccctctggcttctgcttcgacccagagaggctcccttagctcttcacagcgggtgctaacaacccctctccctaggacacctcaccctccttgcccctccccctgtcccctcacccccttgcccctccccccttgccccctcacccccctcgccccgtccccttcccccctcacccccttcatccccctcgctcctctggccccccacccctccccccacccctcagccttctcccctcgcccccctcatccccctcgctcctctcgcccccccacccctccccccacccctcagccttctccccttgcccccctcatccccctcactcctctcgcccccccacccctccccctctcccccctgacccccctcgcccccctcgccccctcccgggcactgtctttcagtgctttggtcacaggccacctccaaagagagcctccgaccactgttactcctcagctgggcctgtagacacttaggacaactgactcagttcctgcctgggttcaaggagcgtttcagctgccgtgtttccctgagcgtccctccctgtttcaaatgcctgtaaactaaaacagtagtcccaaatggcctggggacattggcctttctcactgagaaactttaacctctttttgaccagcgaaagaattccaaaagacatccccttctaaaattctgaggtaagaagtgaaagtaggcgccccgcctgtggagtagccattgttttactcctttactgcattaaataaaatatgttgtttgaatgaatgccccccatttcttttttacttcttgaatgtgactgctagaagattcggaattagcacatggctgacgccatatccccggctcctttccggagttgcacaggaaagggctcacggcaccaagtccccacggcagccacggtcatcggcctcttctgcccctctaattcctcaactcaggttaagagcaaaatagatgactgaatgcttttcttagctcatcaaagcctgaaaatactagaaatacagtggaaaagctcactgaagacttggaatatcagtaactaattttctatctaatccagttggttccatattctcctcaccatgaatgttcttagcaatgaatagatgtcatcaaaaatatgaaaatctgtatatatttctctctttgtgggagtgttaatgttcttcttgatatttttttttaactcaggaatttaaggttgcctttttataccattttgattttgtggcttcaaatttgctcaagacttgttaagttgaccttgttactgcacacagaaggaaatcacagtcggtgtctcttctgtgagggaacctgcctgggagtttgtggccacgtgttcatttttaagacacgaggctatacacagttaaaaagccaattcttggccgggtgtggtggctcacgcctgtaatcccagcactttgggaggccgaggcaggcagatcacctgtgctcaggagtttgaaacaagcctggccaacatggggaaaccccatctctactaaaaaatacaaaaattagccaggcttggtggcaggttcctgtaatcccaactacttgggaggctgaggcaggagaatcgcttgaacctgggaggtggaggttgcagtgagccaagatggtgccactgcactccagcctgggcaagaaaagcaaaactccgtctcaaaaaaaaaaaaaaaaaaaaaaaccaattcttacacattaaatagcttagggttggggaatttttatttttggtatagcctttgacttaggtcagaattaaagctagacaaagaataaactaggtccaaaatgtgatgtacctgaaaggtgtgtgcatatttgcaatttaggtcctgctctgtagtagatcaagaacttgatcaagaatgcaaaccaaaatagcattctctcctgagtaaagctgcctttgaaagtcaggcctagtatctgtgtgatattcggggccccagaacgtccaactgcttggtctgtccactgcccttagaaaggggcacgtcccctcctgggagggttaccttatacagtgacaggaaggaaccagtcctatggccatccacgtgtctacttgtaaatacacacacaggcaggacagttcttggagaactcctgtagcatgtctgcttccttgttttcacaactcttgaaattgtattctgtcaccgggtttcctgtgtgactgatattcttacaacagtgattccctcacctcatccttagatctctatgaattatgttcctgagtcagaagactcagaagagtcattgggatgtctgttttccccagattaacgtgctctccattagaatctcagcaggctttttatcctcaagaagttgagaaagctaattctaaaattcacatggaaatgcaaaggatctagagtagccaaaacaactgtgaaaaagaacaaagttggaagactaataatactatgcaattccaagacttcttatagtttttgtttgtgtttggagacagggtctcactgtgtcacccaggctggagtgcagtggtgtgatcacagcacactgcagcctcaacctcctgggctcaggcgatccttctacctcagcctcctgcagtgctgagattacaggtgtgaggacctgtgcctggcctgactccttgtagatttctgtggatcagttgaatcaattgaattcagttgaattcaacctatccagatgaaggtatttatgaagtgcagtctctaggtgtaatatttgaaatgataaattctgctttttttttttttttttttttttttttttttgagacagggtcttgctctgatacccaggctggaatgcagtggcacaatcttggctcactgcagcctcggcctcctggactcaagcaatccgcccacttcagcctcccaagcagcagtgactaccggcaccaccacactcagctgatttttgtatttttagcagagatggagttttaacatgttggctaggctggtctcaaactcctggtctcaagtgatctgcctgccttggcctcccaaagtgctgggattatgggcatgagccaccgcgcccagccaataaacttttcttaagttgaaaaatgtttggagtcgttttctggaaattctgaaagcactatggttaaagcaaaaagaaggtaccaattcaagtctgcagtgagctatgatcgcaccactgccctccagcctgggtgacagagccagactcggactctgaaaattaaaaaaaaaaaggtaccgggatgcaggaaaaacgtgcacaatttggtgaccaaattgacgtaagaaatgatagctgaaaattaagcttttttggtttttatatatagtcatttgattatattcagtgcccttttaattttattttcagctaactttatttttccaaaataatttcacatttctttgagatgatgtgagtgttgggtagggagaggtgtgagaggtagttgaaggaatagctggagagtgggaagcaggctctgatgctgatggatggagtaggctggatttttgtggagaaattcaaccatgtatctacctatcctttatttacatttccttcaagaaactagtataaccctatacagaacattcaaagaaaactagcaaatatcatgtgaataacatttatattatagacattttaaatgtttgcaattctcatttttaacagttggtcgggagaaaagcagtgtcaaccacgcaagtaaggaaggtgtagagagacggaaggtgggcagtgcaggctctcattactcaacgtgtagagcacattgaaggcctgttctccaggagaagaattgacgagttaacgtggacatgaagtattttcccttttgtccatgtcattccagattgtgatggtcaaaacaaagaaagaaatttggcagctgggaggccgggcacaatggcagatgcctgtaatcccagcactttgggaggccgaggcgggcagatcacctgaggtcaggagttcgagaccagcctgaccaacatggtgaaaccccatctctactaaataacaaaaaattagccggacgtggtggcaggcacctgtaatcccagctacttgggaggctgaggcaggagaatcgcttgaacccaggaggtggaggttgcagtgagccgaggttgcaccattgcactccagcctgggtgacagagcgagactctgtgtcaaaaataaatataaaataatttttaaaaagaaagaaatttggtggctgggcaccatggctcacacctgtaatcccaacactttgggaggctgaggcaggagaattgctcgaagccaggagtttgagaccagcctgggcaacacagcaagacctcatctctagaaaaagaaaaaaaaaaaaaatagccaggcatgtggtgcgtgcctgtagtcctagctactcaggagactgaggcaggaggatccctgaagcccaggagttggagtctgcagtgagctgtaatcatgccactgcattccagcctgggtgacagagaccctgtctctaataaaaataaaaaaaaaattttaaagaaatttggtcccttaagaaatgttgattatttctatctgaaattaagtagtaaagtttgaagttacacctttataagaggaaggaaacttgcatagccatgtatgcccaatgcctggtgtgctttcagcatttacggtttacattgagccttccgggtctgcccgtgggctgcagaagagaggccacctctctctgacttgtgtctcctgtggtccgctccgcccctgccagcatgttcacctgcacatcccctctgccaggccgttcatcagcctgccatctgcatgctgtcttattctccctgcctgctgctgctctcatttttttgccttgtggatggtaaaattattctctgctttacacatcaatttaaaatgtctaagcagaaaggcccagatatatccaccggttttctgtcctttcagaagctctggggtcatgtttgtgttctcagtttgcattcactggttccagctccaagctttttactgttgcctttttctatgaatatgtttcttctctttggagtgcctatttcagctgtaattacatatttcaagtatataaaaatcttggttttgttttgcttcactttgttttacagatcaacatagaatgggcataaaattcagggtagaatttcacctctgggttgaaggtagacatgctttacatcctcacacgttaacacgctcttacaagtaccgtgatgggtgaggggaccgtgaccttcaccatctccagagatggatgattctcctaaaaccctcacgctggtttccagggaaacaagaaaccaaaagtcctgcccctaccatgagtgaatgttaatattcaaataacatttctagaaataatcctaaagtgatgtgacaaaattctttttaaaccttgacattattgctgttttcatcggtaaatttgcaaagaaccctgctgagaaacacttagcaaaaatttgaactttacattcaggacttctgcaggtccttgaatttttcattaaagcgaaggaaaatgtattttacatccatgtcaaaatcagacatctggaatttgtaaggcgtttttacgcttacgttctttttgttgtcaaaagactgacttaaattttgtctgctagacataccacaaaagtaacttagtctttttcaatacactgaacaaaaaggaagacttaattttggtgaagaaactttatccagaaaagtttctaactaattggcagtcagtcttctggcatatacatcatgtttgggtgatttagatggtttattgttttgtttcagaatattggtattaacacagtgtctctacttttaaactgaattatgtgtttattcatggaaatggatgcttttgatatgtaaactctccaaattaagtttcccttttattgcagatacagttatccaaatcctcatgcaaaaatgggattcacttaatttttttttaagtgaaaccaaaatttcctagactttagaaagacaatggattggagaagagagtatatatttttttcaatttgatagaagtttgaaatccaatttaaatatgttttttattcattctttttctttacctccaaggaaatttctacatcttttttttttttgagatggagtctggaggccctgtcacccaggctggactgcagtggtgcaatctcggctcactgcaacctccacctcacgggttcaagcgattctcctgccccagcctttcaagtagctgggattacaggcgcgcgccactacacccatctgatttttgtatttttagtagagacggggtttcactatgttggtcaggctgatcttgacctcttgacctcgtgatccgtccgcctcggcctcccaaagtgctgggattacaggcatgagccaccgcacccagccagaaatttctgcttcttgaaatgcttctgtaggggacatgcccatgaaatggctttaatgacatttatgaaataggaggttacttaggaaatttactaaaatgcatgaattctgcaaattagaggtactgagtcctttgtacaagcactgcacatttcagaagaccagaatgccagtattgaacacacaggtcctcaaacgagtcacgatttttagtagcaagacatttttggcaaatttccatgataagacctacgccgtttccctgtggccagggtgccgccagcgagtgggtgaggcacacgtgcctcgcggttatcctttgacttccacctcagaagtaagcttgcttttcagatagcttagtttgtagccaacgccattgcatttctaattccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctcatcatgaaactaaatttagccatggtgttgagcaagctggctctgacgttatcgggttcccgttaggtcagggccgcccacacacagggacgctgactgcagaggggctggccatctccatccagcccgcctggagcgctggctgcgccagatgctagccacagctgttcaaagctaagtctatccactgatttttttacttacttagtggaaaaggcagtgtgactttttatagaccgcctcttggtttggtttgggttttggggctttttttgagtaagaaaaggtgaatcaatacaatttatagaaatgaaagtcttgaaaatagggaattgctgaaagtatgaatttaggatcctagttcgcccacctcctcctcagtggagagatcattatcctcgctgatgctcttgcgagaagcccatggaaacaggactaaagtgttatctgctcgtgtcgtggttataacctcacctctccatagctgcgtgtggtcagcacgccggctggcgtgggagggcaagctctgtgcttagcttccttctctacccagtggcgtctgtgctcccttcgcactgacagaggtgcagacgccgtcactctgcagctgggggcacgtggacgaggctgagacccaggcagagtgtggccttcgcccaagggtccggtaactttgctggctgtttcgaagaaccgcacatgccccacttccacctaaaagtggactcgccagccagaagacttcacatcctgcaccgctactcacgtcgatgtttccgcagactagatgctcgcccgctgcggtccttatccctcatcttaaaattggaggaaacctggtgtttagtaacttcctacagcacgagagttcgagaggactcactcacagaggcatgctgcgatttcagcccagctgcatgctgctgctattttggggtagcaagaagcataaaggcaaaactgtactggcttcgtgtctccttccgtgagggttggcagcacccatcagcagtaatgacaaggagaactcatatttcttagcactgcctttatgccaggagctgtggtgggtgcctcatttccctgggttaatttacttagttctcacaacccaccaaataatttactactattatcctcattcacaaatgaggaaactgaggcacacaaaggtgaagtcacttgaccgaggtcacacaaatattgagtggagccaggtttcgacccaagcagtgtggcctggggtccaagccccgaccgtcatgttacatggtggaaatgccttctagatgggcagcatcatgggtgacggtgaacacaggtgagggcctggggacatgcccgcagcaccacgccaggccataaggaacacacccaggtggacagtgtgaagttacggtattgtcaacctaaaggaagaaactgagacaaattaatatagggagaggccaggccccacggctcatgtcggcaatcccagctactcaggaggctgaggtgggaggatcacttgagcccaacaggttgagactgcagtgagccgtcatctcactactgcatgccagcctgggcgacagagcaacaccttgtctcaaaaagaaaatacagggagagagcttatttgggccaaggttgagagctgcggcctaggaaacacttccaagttgccttgagaaatgctctgggggagaaaaagagaggcttctgcatttaaaggaaaaaggacggatcaggaaaggggcaattactcaagttgtttttcaggagttctcattggttgacagaaacacttggttagttctcataggttgacagaaacacttggtgaatgattggctatacattgttgaactacaggccacgagttaccgtgtccaacgtggcatttttagctacatggcgtagctattggtaccagtctggaacccacacagcaggtttcaggagacgatctcccaaggcaggagggggagtggggcgtggctgctgtctcattccagtgcctctgggcctgatcgctgaaagggggctcaccttcctcaggtaaaaagtgtttccttcttatcctgaactccaggtgaaacccttgcatctgcattcaccaccacttgacacaggagaaccccgggccctgcaaggtcgaggggtgaccacggtcatgggccccagggtctgtccttcatgaccattgccccatggagacacccagggccgcccggagcccatgctcagccccgatgttgcattggggaagcagcccctatagagacagtgtcaagggatagctgtgacagctgtgggctctgatggtgcacttgaccccagaaccagaagagcttgattccagtccagtggctcccgttcctcggaggctattgtttttttgttttgtttcgtcttgttttgtttttgagacagagtctcactgtgtcgcccaggctggagtgcaatggcgcgacctcagctcattgcaacctctgcctcctgggtttaagcagttctcctgcctcggcctccggactagctgggattacgggcgcccaccaccacactcagctaattttatatttttagtagagacggggtttcaccatgttggccaggctggtctcaaactcctgacctcaggtgatctgcccgccttggcctcccaaagtgctgggattacaggcgtgagccaccacgcccagcctgaggcttttgtttttatgtaagtttagattttataaaactttttttttttttttgaaacggagtctcactcggtttcccaggctggagtgcagtggcgcgatcttgactcctcacaacctccgcctcccaggttcaagtgattctcctgtctcagcgtaccagggagctgagattacaggcctgtgccaccacacccagctgatttttgtacatttagtagaggtggggtttcgccatgttggccaggctggtctccaacttatgaccccgtgatcctcgtgcctcagcctcccaaagtgctgggattacaggtgtgagccaccacgtccagcctgaggcttttgtttttaggtaagtttagattttataaaacgtcagcatttttttaaacaaacgtgctaaatttcagcatatttggagaccaccaacacattagcctctgttctcattatattactaatgtgaacctataaaattatcaaaaattcagctcttatttaacatgtagttttatataagatttcatttggaggaaaaaaaatggattctactgtcaaaaagtttgaaatgtactaagcttaattcagttccttttttagagacaggaatagacctagaggtgcagagatgggcccaaactgactggaagccaagtgccccctactctcataagactttctgcttcgtatgaaaagcatgatgtaaattccacagaacttgggggtgggggtgggggcaggggccacataaaaactccataatctctagaattcctattttcctacttacaggtcttactggtcatgtctggtgtagggtggttgctcttgaggggcttttagaaatacacagctaagggcacagcaggggagccctgatttttaacaaatccagaattgtatttaaaaaaaaatacacaggtaaataaacaagctggggctggcccaggtgtactgatttgtgtacttttataggataatatataacaaattgattactggccaatccaagaggggtttttgtttatgttttggggcctttgtttttagagatggcttcttgttgcccaggctagcctcagactcctggactcaagcgatcctcctcccaagtagctgggaccacaggcctgtgccaccacacctggcaatccaagagttttttgacctatcttcttaatttctgtaaaagcaatcagtaacagatactgttggtgaacgaatacgcagcacagctgtgatggaaaaagaatagtggagggggaatgaggagaaccagtgctcaggagccccagagatgctaaatgggcactttacagccaacagcgctgctcaggtgcttctgcctcccagaagtgtctctctcacacacacacacacacacctggccacccccaaatcagaatatggatcagagggggtgccaagcaaggggaggattaggctggatcctggcgctgaagcataacattgagaagccaaaggctgccattctcccctgctcctctctccctccctttctcaggtgtggtggcctcatccatcttcatttctgcctccaaaacaaggctcccttcctgctggcgagccccctgctgactctcccttgggttcccctctgtgcgctgccctgagccggagcttccatgtctaatgcaacgcaggtgagcccgtccgccaggtacttcttgggtgtttaggtgcctgttgaaaatgggtcctcaattggccgggcgcggtggctcacgcctgtaatcccagcactttgggaggccaaggcgggcagatcacgaggtcaggagatcgagaccatcctggctaacacggtgaaaccccgtctctactaaaaatacaaaaaattagccgggcgtggtggcgggcgcctgtagtcccagctactctggaggctgaggcaggagaacggcgtgaacccgggaggcggagcttgcagtgagccgagatggcaccactacactccagcctgggcgacagagtgagactccgtctcaaaaaaaaaaaaaagaaaaaagaaaatgggtcctcaatcaaagagtgacccccagagtgagcgccatgcctgaggcttagagcagggtcacctcctcctttcaaacaggaatccatgctgaggctggagcctctttagacccacgtggccccacagcccacagaaccaaggctgaccccaaggcttgagctaaagcaaacagtcacgtatatcacgtgttgctatcagatgacttgtgagaagctgccttgtttccagtgctatcagagcccaggtgattctctagcaaatgctttgccgggaaacctggaggtttcttctttcgggattgcttctttgtgagtttcaaacagagtaaaataaaaagtctgccacagaaaattgacatcataattaaaggcccagaggtcggcgtgagactggcatgaggggcagaggaaggacatggggcccacccggagtctccgaccacccccaggctcaagagttccctctaaggactcacggaagtgagtaaagctgtcggacacacggctacaattatgagagtgaacggacactgatgaaaatcagcaacaggacaagatgcacaaggcagggccatccaggagatagcgggctctgctcagagctgccagccgtcctctccccgtggagccctgcggcgcgctggcttctcctggtgacggtgtgcaccagctcgcatggagtatcgccaaccagggaagctcgcccgagccttggcgtccacggttttactggttaatcatgtgtacatggtggcctcagtgtccagcccctccagaggtggggccatcctgtgtggcccaagacccccagcataaatcacgtttgcctagactgtccagcagggcccaaggcccccagctaaacaaagccactctcaccaggcacagcatgccaagggcctctcggctactgcaaagctggagaaaaggccagacttctctttggacaaggttgaacctttactgaacagctgtcctccccacaagaggaactagagcacagaggggctcatctgctgggccaaggtagctaagggcaatgtgagggtctcacagtcaacccaggacctccctaactcaaagctcttccctaactcaaagctcttcccgctacacagcaagaagaagggacttcccagctaaatggtgacatctgctttccactgaatctgagaaaggagaagcttccagaatgagactaaataatttgcagaggagaaggaacagaacttgccttcagaatgtggaccactccccgtaactcagagacaaaacaatcccataccttgaagtagcttggagatgagctttattttatatcaacattaatacatatgggtatacctagctttatttcccccctcaacttagagtctgaatgtgtggtaagcatgttcatcgctggataagcatctggtatggtctaatcggcaataagtaggggagtgggggccgggcgccatggctcacacctgtaatcccagcacttcaggaagccgaggtgggcggatcacttcaggttaagagtttgagaccatcctggccaacacggtggtgaaacccggtctctactaaaaatacaaaaaaattagccaggtgtggtggcaggagcctgtaatcccagctactcgggaggctgaggcaggagaatcgcttgaacccgggaggcagaggttcagaggttgcggtgaggtgagattgcaccattgcactccagcctggcaacagagcaagagtccgtctcaaaaaaaaaaaaaaaaaaataggtgtggtggtgcacgcctgtaataccagctactcgggaggctgaggcaggagaatcacttgaactcgggaggtggaggttgtagtgagccaagatcgcgccacttcactccagcctgggtgatagagtgagacttcatctcaaaaaaaaaaaaaaatgtaggggagtggaaagttttcagggaacccaagagcctgagtcttcctgaatgagctctccagcaaggtgaaagcccagcagagtctccggtgggcaaaaatctcaggcagaagaaacttctgtgactgcattcacttattcataagagaacacccacggccccactgccccagctgaggatgaggaaagcaaccacagctgccgctctcactagcttctttctccagcctagagactggcgtgactccatctcgccgtgaggtgcccagggtgggagaagacctcatggccatggtgggcagcccgtggctttatgagtgaggacagccaggagcaccgaaccccaatacccggaacactagcacagcaacagtgccaggcagaccccaatctctcaattcctggccccgcacttgcgtcaatatggtaccgcagtgagaccctacatctgctccaccgaggctgaccctggaaccagtgctggatctctgatgactaggaggacccggtggttaccagggtcccacagccagtctgcagacctgcccaggcatgacagtgtttccatgtcctcatcaaaacgagagaaaagacggctgggtgaggtggctcatacctgtaatcccagcattctgggaggcttaggtgggaagacagctggagcctaggggttcaagaccagcctgggcaacacagtgacactgaccctgtcactaccaaaaaaataaattagctgggtgtggtggcgcgttcccacagtcccagctacatgagaggcttgaggtgggaggatcaattgagcccaggaaattgaggcttcagtgagccgtgcacttcagcctggatgacacagcaagaccctgactcaaaaacaagagagaagagcaatggaatgggttcctctggaaactcaatttgaagaaggaccctttttctgacatgctcttcctctgcttttagcattgaaatatacctttggaaatggcaagtgtaaatacgagtttcttttataattctccgcttgaaaaaagtcggcaataccgttttaaaatttgaacagtatgataatgctgatcggcctccagaccaatgaaatctcaaattctaggaacccctggtctagttcaaaccctggttttacagaaaatgaaatagagaaataggaaagccccataactggcgagccagcccctgttgtgtatctaataagatctcacagagttagccgggcgcagtggctcatgcctgttatcccagcactttgggaggccaaggcaggtggatcacttgagataaggagttcgagaccaccttggccaacatggtgaaaccccatctctactaaaaaacaatacaaaaaataagctgggcatggtggtgcaccccagtagtcccagctactcgggaggctgaggcaggacaatcgctggagacagaggttgcagtgagctgagattgcgccactgcactccagcctaggtgacagagtaagactgcgtctcaaaaaaaaaaaaaaaaaaaattcacaaagttgtgcattcgtgggtagtactgtatcttgactaccatttggtttctttctagattgtgaatttctttaaagtctctaggaaaatgaggccgggcgcggtggctcacgcctgtaatcccagcactttgggaggtcgaggtgggtggatcacaaggtcaggagttcgagaccagcctggccaatatggtgaaccctcgtctctactaaaagtacaaaaaaattaggcgggcatggtggcacgtgcctgtaatcccagctacttgggaggctgaggcagaagaatcgcttgaatccgggaggcagaggttgcagtgagccgagatcatgccactgcactccagcctgggcgacagaacgagattctgtctcaaaaaaaaaaaaaaagtctctaggaaaatgcacaattgaaagatttatttgagacaggcaatggacctcctgtagaaatgctttactttaccaagtaaaaattcagatatttcttacatagaaaacatttcccatattaaaaagctaaattttggtcaggtgcagtgcctcatgcctctaatcccagcattttgggaggccgaggcaggaggatcacaagttcaggagtttgagaccagcctggccaatatggtgaaaccctgtctctactaaaaaaaatacaaaaattaggtcgggcgctgtggctcacacctgtaatcccagcactctgggaggttaaggcgggcggatcacaaagtcaagagatcgagaccatcctggccaacatggtgaaaccccatctctactaaaaatacaaaaattagacgggcgtggtggcgggcacctgtagtcccagctactcgggaggctgaggtgggagaatcacttgaacccgggaggcgggggtttcagtgagctgagattgtgccactgcactccagcctgggcaacagggcaagactccatctcaaaaaacaaacaaacaaacaaaaattaaccagacatggtggtgtgcacctgtaatcccagctacttgggaggctgaggcaggagaatcacttgaacccgggaggcggaggttgcagtaagccaagatcgtgccactgcactccagcatgggcaacagagcaagactctgtctcaagaaaaaaaaaaaaaaaaaaaaaaaaaaaaaagctaaatttctcaagatacttgagaaaagatctttggaatcatcttcagtctgccatacacgatgtaccagaaatgctcagtcatttatagccacacgttttctatttttcacaaagtgccctagaataaataaataagaagtggccaagcttggtggctcacgcttgtaatcctaacactttaggaggccgaggtgggtcgattgcttgaggccaggagttcaagaccaacctggccaacatggcaaggccctgtctctttaaataaaaaaatatatatatatatatttttttttaaaaaagaagtacccatgttttccacaagttgaccttgaaaaactagggtgtaaaaagtcaaatctggctggacacggtggcccatgcctgtaatcccagcactttgggaggccaagatgggcagatcccct

SEQ ID NO: 543 - DNA, 30802 bp, Homo sapiens
ccgggagcaggggacaggaaggagaccgcggctctcccagtcctgctgccccgggcctccagacggccagactctccccacaccggcctggagggggacgcgccgaccccagctgggaggggtggctggctgcgtagatccgtttgggccgcctgcctggaaaggcccaggtccgggcctcgtcctcctcttcacactctcccccgatctccaaccaccttcaccctcgcccccaccaccaccacccccagctcctcctggccgcctgcggtccagctgaggcccgcctcctccaggaagtcttcctggagagcctgtcctgggttaggcccgcccagagccacctggggcgacttatttcatggcaccttcgaccttgctctctgtctgttttgtgtctggcttcatcaccaaactgagcctcttgggggcagtgaccgggtcttaggtcttagttggcccttaggcgctagggctgagaagacttaggcggacaggagatgagactgtgtattcgacgacacactttagagatccagcccggaacacagccataccagattttaaaaaaagccaacataatatagcatgttaaaaattattgtaggccgggagcggtggcccacgcctgtaatcccagcaattcaggaggctgaggccggaggatcacttgagctcaggagtttgagaccagcctaggcaaccaacatagtgagactccgtctgtacaaaaatgaaaaaaaattagccgagcgtggtggcctgcacctatagtcccagctacctcgggaggctgaggagggaggaccctttgagccccaggaggtccaggctgcagtgagctgtgatggtgccactgtactccagcctgtaagacaaagggagagaccctgtctctaaaaaataaaaaataaatagtatacacatatggtgcttatttgaaatatacatattgtgtattttttaccttctatataaatgctattatttaaagaaaacaatatgattagttcacagtggcaattagtaataataggactaataacaaataatatgtgtgagaaaaatataaaaatagttttataatgtttcttcctgtcctgtgatttagcaatttattttaagtcattattagatacttaaattttgtatcaaaatacataaatgtaagacttttaaaatggtgaatgtaatataacagcagtatttaaacagatattactaatatttaatcaaaaataacaatgacgggctgggcgtggtggctcatgcctgtaatcctagcactttgggaggccgaagcgggccgatcacttgaggtcaggagtttgagaccagcctggccaacatggtgaaaccctgtctctactaaaaaaacaaaaattagtcgcccgtggtggcacccacctgtagtcccaggtactcagcaggctgaggcaagaggattgcttgaacctgggaggtagaggttgcagtgagccaagatcacgccaccgcactccagcctgggcaagagtgagactccgtctacaaaaaaaaagacattttggtcctatgatatagtaggatattttgactctttttatttccttgcctgcagcctttagtaggaagttcttccttgatgtagtgatgaaactgaatatagttaaatggaaaatcctttgacttgcagctctgctcttagagagccctcagtacactgactcctgaggtcagtccaatgtgatggcctcaagctgctatctcaacaaaagcgtttgagaatggaatacttaggattgtacctacaagcaacggcagggttttagatttgtagggattcgtttccagctgtccaaagatgtccattcactttgcatctgcaggctggttttggtaaaccagcagtttgtcatcttttgcatctatcatgtaggatatccatggctaagatatccatcctttttgaactttttttttttttttgagttggagtcttactctgtcgccctggctggagtacagtggcgtgatctcggctcactgcaacctcaactacccaggttcaagtgatcctccggcctcagcctcccaagtagctgggagtacaggcgcgtgccaccacgcctggctaatttttgtatttttagtagagacagggttcgccatgttggccaggttggtctcgaactcctgacctcagctgatccacccacctcggcctcccaaagtgctggaattataggcgtgagcaatggcacccggccctttttgaacatttctgagcacactggatgtcactgtaagttaaacctctctctgtctctctccttctctgtctgtgtttctctcaggaaaaatagttttaaagcacaaagatactttgaacttgtgaagttgaagttgaagttgaattccaaataagttacagttttagtaaagaagtgagaaagtcttgtttaaattggctgtccttttctggtgacattttggtttcgtttccaaaaaatgagtcatttttcattatatgagctttgtcagtacctacctataacatcgacaactcagggacagtcagttcatgcttttccagagcccttatgggctcctcaaagatcatcaggcagttttggaggaagaacttataaatttcagtttgactgtttaaccataatctttttctctattttcattcttaatatatttccaaattagacaaggacattcttcttgtcccatgctttgaaaatatggttgtatggcaggctgcctttttaccctggcaacagtgacagccctcgtgtaggcacatgtccaaaggaggccatctccttccatttctggaatgtgaaaaatctcattaagtgctttttcatgctttgaggaaactgaaaagtaaataaaagctttcattttgaaagcatcaatatcacagggaaggaaactccacccctttttactgatgtgtacaaaatgtgcaggacacttcgtggctaatatttttaacttttctttggtaaagcgttcatagactgcatggaatttgcaaaaatttacatttgcacggtctgccaaataggcagacagatgggcaaagtcatgtttgtatttggacaagatagcatcaacattctttttttttttctgcaggtggattaaaatcttcatagaaataaaaaggatgatttgaaactccattttttcaaatcaaagtatttacaagttaggagaactgtttttcattgccatgattggatgcagcacttggttactgtagaaagcatgattgttggtgggatctggcagaatccgctgcatgttgtaaagggtcaacacagctgccatcgacatttctccctttgttcacccacgtgatatttcagttacagcctgtaaatgaggaaatgtgcccctactcagtttcaaaaaacaatcaaaggagcagcacaatcacacaaattcatttttgtagtttgccctagctaattcagcagccactattttcaattggtgtcttttgtggagacaaaaagctttttggttaatgtggacatacttgcctatctcactgaggacttgtgaggcagtctctacagtcccttcttccaccatgcccaaccccgaattctctctgcttattgcgcagtatcccttgttttgattctttacctccctcatccagttgtctgtgtcactcctcctgtcgttaaaataacatggccatttgggtcacgcgggcattgatattgcaacaccatttcctcattttcatcacctgaatgcttaagaaaacatggcctcagtagtcaccatgctaaaattaaactagcagtgtctcaatacaaagcacaacaattaatccgcaggcaaagtggatggtcacgttcaagattatagcgcgcttaagttacatcacaaggagtgacataataatggatgatccactatggtgtactacaaatcatggtggttgtcctcagcaacagacactaaggaaggtgatgtgcccatttggcactaaaaccagtgttgccttcggcctctgtttctggggttgccatgtgggttttatacctttcccctaatctcctgtatcaatcactgaaaacctcgacttttctcttcccaagggagagtttacttccctttaactttttggcttcttctttaggacttttagtgttaaaaatggtacaatcccagacaaatgggatagttgatcatcttatcatgtttatagaatcaagaaataatgtctcaatttaaaaagtcaattgtatttataaacactagcaacaaacaattgtaagttcaaatttttaaaatgccacttacaataacatttttaaaacatgaaataagtagggataaatttaacaaaatatgttcaagacctatacctgaaaacaattaaacattggagagagaaattaacaaagagctgaataaatgtagagaaataccatgctaatagatgagaagactcaacattaagatgtcttttattcctaaattgttctatagattcaattcaatccaaatcaagatttcaccaggaattttttttttagaaattgagaaattggttctaaaatttatatagaagtagaaaggacctagaatagccaaaacaattttgaaaaataagaacaaagttggaggacttacactacttgatttcatgagttacttgaatcttgtaatagcaattaagacattataatgttggcataaaaatgaaagatagattaacagaacaaaatagagtccagaagtagatgtatgcatatacggtcaattgatttcaacaaagcaccaaagcaattcaatgggagaaaggatagtgtttgcaagaaatgggactgtgacaactagatctccatatattttaaagaatgattcttggcccctacctcacaccatataccaaaattaacgaattcaaaatgggtcagagatgtaaatgtaagagtgaaaaaccataaagcttctagaagaaaacataagagaaagcctttgtgaccttgaataaggcagtgttctttggtaggacacaaaagcacgaatcataaaagaaaatgttgataattggacttcatcaaaattacaaacatctgttcattaaaagacactgttaagtataaaagacaagtcacagactgagaggaaatttttgcaaaatacttagctgacaaagggcttgttactaggatacatacaaattctaaaaactcaatttaaaaaaccctcaaaaacaaagaaacaaacaaaaaacagcccaaagacttaaactggcacttcaccaaagaagatataaatagcaaattagcacaggaaaagatgctcaaaatcaccagagaagagggaaatgaaaattaaagctacaatgagataccactacacatctattaagaaggctaaaaattgaaaattaaaattaaaaaacaaccgacaacaccaaatgctggtgaggatgcagagcaacaggaacactcagacattgcttggtgggaatgcaaaatgccaccaccactctggaaaagtttgactttatttttttttcccaaaagtaaacacgtactcaccacatgactcagcaatcttattcctagatattacccaagagaaatgaaaacatatgcccacacaaggacctatacataaatgttctagcagcttaatttaatgatagccaagaactggcaaatggataacagattgtggcacatctatataatggagcccagtcagcaataaaaagaaataaagtactgatatagaattccacatgaataaatctcaaaagctttatgctgagtgaaagaaggtagtcttaaaaagctatgtactggttgggcacggtggctcacgcctataatcccagcactttgggaggctgaggtgggcggatcacttgcggtcaggaattcaagactagcctggccaacatggtgaaactaaaaaatacaaaaattaggcaggtgtggtggcgtgtgcctgtaattccagctactcaggaggctgaggcaggagaatcacttgaacccaggaggtggagattgcagcgagctgagatcacaccactgcactccagcctgggcaagagagcaagacaccaactcaaaaaaatatatatatgtgctgtaggattccctttatatgctattctagaaaatgcagattatagagatagaaatccaatcagtggttgccaagagttggggtggaacacagaatttctgagggtgatgaaaatgtgtatatcatgatgtggtggtggatgcactataacatacatttgtcaaaacaagcagaactgtacatttttaaagtgtgagtttccctgtgtgtaaattataccacaataacctgacaacaacaaaagagagagacgttggactgcatccatcccactccacttcttaccagggagctcccgggagcctctctagtgtctgtcctccctgccctgcctggggtgggctgagcagcacagcgtccctgcagagagaatggagaatgggcaatgcccacacaggggagtggcatggggtgagaaggaaccttagtcccgtcagccctgaccaccagcccatctctcatcactgttcagcagagtgagctcaagttgggtttctggcatctattggcagagccagggccaaaacgcaaggggtggggagtgttgtacaggttagggctgactgaatgatcagccctaatctgtacaacggatctgtgcagtctgagcttccacacagcagcagctgtccttgaccccttcccctcctagtcggcccctccctgaccttcccaggcctgtgggaagtcctgttaagtcccaggccatgtccactttgtataaaatacttaaaaataaggccaggcacagtggctcccgcctgtaatctcagcactttggcaggctgaggagggaggatcacttgaggtcaggagttctagagcaacacagcaagacctcctctctcctaaaaatttttaaaaatcagctgggcgtggtggcacgggcctgtgatcccagctactgaggtggctgaaacagaagaatcgcttgagcccaggagatctaggccgcagagagctgtgatcccgccactgcactccagcctgggtgacagagccagagagaccctgtttcaaaacttttttaattaaaaaattaataaaagatttaacgtgacccttataacagtcacctgagacggacgctgaccccattttacaaatgtggacattgagacacagggaagttaaatccccctgtcagaaaaaggctagcggaggtttaaggccgtgggaacgtgactccagagctgagggctttggaaccccgcctgctccggtagttgtggctggccttgccccacacacatttggttctagctcctttgcttgggtcttcatccatgcagcgaattccttagccacaggtgtccctctgctctctaactcacagcgagctcgctgcccaaagtcctgctccggcttcctgggtggacctgaccgcgttcgggtgcacgtggggcgactcacacctgacaagtaaagcgggtgaggccgcgcctgtgaagggcgcctggctcctccgcaggagcggtgcggcgcggcgcccccggctggaaccaggtgtaactgcagagaccctgggatcgcaggaacggctggcggcaggactgtccctacctcgagaaggtgacggggtttcctgcgctgccagccgatgaggcggccgtgacgcagcccgccgtgcagagtccccgtcggccgacaggcgtgcagagctctgcagaggacccttccgccctctgggcagcctgccaagccgtggcacccccaacccccagcactgggcacttgggagcattgcagccgccctggctcgtaccggtgccggtgctttgggcacctgggctggtttggacatgggtgccccgggcagagtccatttatgcaggtcagaatcagtgtgtggagcctgcatagacttgccctggagcggctgcctgtgctggggtggggaggagtagagggcgagaagttggtggggaagggaagcggcgccaaaagaatacccacaacatcttgcacctggaaggcaaagcagagggcagtgatctctgcagacttgcgggggcgacgcctgaagcaaacagggacatacaagctggtgccttctgtggttgtgcatggggtcttcatgcttcctgtctgagttcccagaagcttgtctctgcttttctaggcagctgccacagcctgtcacaaacagctcctggttctccacttctcatagtctcgatttcaaaatccattgcctcaccctccacctcctctccacctccacccctcctagcacctcctgactgcttgtgttctgtgtctccccactgtctcccaacctggggtggggttgggggggatgtctttcctcctgtctgctctttgatgtccagctgaagtgtcacctcctacaggcagcctcccctggctatgccagcttgtactgattgccctctcctctgaattctgtaagcatttcctatgtgtacctgcccctgggcaaggtgggcctgacttgttagagtgttagagttttaccctgttcctctaggagggcctggtaccaccacagcccagcatggtgtggtgcctcagcaggaggcatctggttacaatcaacacaagctgttccagccaatttaaagaaacttcaggaggaatagggttttaggagggcatggggaccctcctgcacccgaagccaggatgtgccaccaatcataaggaggcaggggcctccttccgctgctccctgggactctctaggtgtccgtggcctcagtccccctctgcacacctgcatcttccttctcatcagcttcctctgctttaagcgtaaacatggatgcccaggacctggcctcaatcttccgagtctggtacttatggtgtactgacagtgtgagaccctactcctctgatcaatcccctgggttggtgacttccctgtgcaatcaatggaagccagcgaggcagggtcacatgccccgtttagaggtgcagacttggagaaggaacgtgggcaagtcttcccaggaacaggtagggcagggaggaaaggggggcatctctggtgcagcccggttcggagcaggaagacgcttaataaatgctgatagactgcaggacacaggcaaaggtgctgagctggaccctttatttctgcccttctcccttctggcaccccggccaggaaattgctgcagcctttctggaatcccgttcatttttcttactggtccacaaaaggggccaaatggaagcagcaagacctgagttcaaattaaatctgccaactaccagctcagtgaatctgggcgagtaacacaaaacttgagtgtccttacctgaaaaatagaggttagagggatgctatgtgccattgtgtgtgtgtgttgggggtggggattgggggtgatttgtgagcaattggaggtgagggtggagcccagtgcccagcacctatgcactggggacccaaaaaggagcatcttctcatgattttatgtatcagaaattgggatggcatgtcattgggacagcgtcttttttcttgtatggtggcacataaatacatgtgtcttataattaatggtattttagatttgacgaaatatggaatattacctgttgtgctgatcttgggcaaactataatatctctgggcaaaaatgtccccatctgaaaaacagggacaacgttcctccctcagccagccactatggggctaaaatgagaccacatctgtcaagggttttgccctcacctccctccctgctggacggcatccttggtgggcagaggtgggcttcgggcagaacaagccgtgctgagctaggaccaggagtgctagtgccactgtttgtctatggagagggaggcctcagtgctgagggccaagcaaatatttgtggttatggattaactcgaactccaggctgtcatggcggcaggacggcgaacttgcagtatctccacgacccgcccctgtgagtccccctccaggcaggtctatgaggggtgtggagggagggctgcccccgggagaagagagctaggtggtgatgagggctgaatcctccagccagggtgctcaacaagcctgagcttggggtgaaaggacacaaggccctccacaggccaggcctggcagccacagtctcaggtccctttgccatgcgcctccctctttccaggccaagggtccccagggcccagggccattccaacagacagtttggagcccaggaccctccattctccccaccccacttccacctttgggggtgtcggatttgaacaaatctcagaagtggcctcagagggagtcggcaagaatggagagcagggtccggtagggtgtgcagagggccacgtggcctatccactggggagggttccttgatctctggccaccagggctatctctgtggccttttggagcacctggtggtttggggcaggggttgaatttccaggcctaaaaccacacaggcctggccttgagtcctggctctgcgagtaatgcatggatgtaaacatggagacccaggaccttgcctcagtcttccgagtctggtgcctgcagtgtactgatggtgtgagaccctactcctggaggatgggggacagaatctgatcgatcccctgggttggtgacttccctgtgcaatcaacggagaccagcaagggttggatttttaataaaccacttaactcctccgagtctcagtttccccctctatgaaatggggttgacagcattaataactacctcttgggtggttgtgagccttaactgaagtcataatatctcatgtttactgagcatgagctatgtgcaaagcctgttttgagagctttatgtggactaactcctttaattctcacaacaccctttaaggcacagatacaccacgttattccatccattttacaaatgaggaaactgaggcatggagcagttaagcatcttgcccaacattgccctccagtaagtgctggagctggaatttgcaccgtgcagtctggcttcatggcctgccctgtgaatcctgtaaaaattgtttgaaagacaccatgagtgtccaatcaacgttagctaatattctcagcccagtcatcagaccggcagaggcagccaccccactgtccccagggaggacacaaacatcctggcaccctctccactgcattctggagctgctttctaggcaggcagtgtgagctcagccccacgtagagcgggcagccgaggccttctgaggctatgtctctagcgaacaaggaccctcaatcccagcttccgccctgacggccagcacacagggacagccctttcattccgcttccacctgggggtgcaggcagagcagcagcgggggtaggcactgcccggagctcagaagtcctcctcagacaggtgccagtgcctccagaatgtggcagctcacaagcctcctgctgttcgtggccacctggggaatttccggcacaccagctcctcttggtaaggccaccccacccctaccccgggacccttgtggcctctacaaggccctggtgggcatctgcccaggccttcacagcttccaccatctctctgagccctgggtgaggtgaggggcagatgggaatggcaggaatcaactgacaagtcccaggtaggccagctgccagagtgccacacaggggctgccagggcaggcatgcgtgatggcagggagccccgcgatgacctcctaaagctccctcctccacacggggatggtcacagagtcccctgggccttccctctccacccactcactccctcaactgtgaagaccccaggcccaggctaccgtccacactatccagcacagcctcccctactcaaatgcacactggcctcatggctgccctgccccaacccctttcctggtctccacagccaacgggaggaggccatgattcttggggaggtccgcaggacacatgggcccctaaagccacaccaggctgttggtttcatttgtgcctttatagagctgtttatctgcttgggacctgcacctccaccctttcccaaggtgccctcagctcaggcataccctcctctaggatgccttttcccccatcccttcttgctcacacccccaacttgatctctccctcctaactgtgccctgcacccaagacagacacttcacagagcccaggagacacctggggacccttcctgggtgataggtctgtctatcctccaggtgtccctgcccaaggggagaagcatggggaatacttggttgggggaggagaggaagactggggggatgtgtcaagatggggctgcacgtggtgtactggcagaagagtgagaggatttaacttggcagcctttacagcagcagccagggcttgagtacttatctctgggccagggactgtattggatgttttacatgacggtctcatccccatgtttttggatgagtaaattgaaccttagaaaggtaaagacactggctcaaggtcacacagagatcggggtggggttcacagggaggcctgtccatctcagagcaaggcttcgtcctccaactgccatctgcttcctggggaggaaaagagcagaggacccctgcgccaagccatgacctagaattagaatgagtcttgagggggcggagacaagaccttcccaggctctcccagctctgcttcctcagaccccctcatggccccagcccctcttaggcccctccaccaaggtgagctccccctccctccaaaaccagactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacagtaaggccaccatgggtccagaggatgaggctcaggggcgagctggtaaccagcaggggcctcgaggagcaggtggggactcaatgctgaggccctcttaggagttgtgggggtggctgagtggagcgattaggatgctggccctatgatgtcggccaggcacatgtgactgcaagaaacagaattcaggaagaagctccaggaaagagtgtggggtgaccctaggtggggactcccaccagccacagtgtaggtggttcagtccaccctccagccactgctgagcaccactgcctccccgtcccacctcacaaagaggggacctaaagaccaccctgcttccacccatgcctctgctgatcagggtgtgtgtgtgaccgaaactcacttctgtccacataaaatcgctcactctgtgcctcacatcaaagggagaaaatctgattgttcagggggtcggaagacagggtctgtgtcctatttgtctaagggtcagagtcctttggagcccccagagtcctgtggacgtggccctaggtagtagggtgagcttggtaacggggctggcttcctgagacaaggctcagacccgctctgtccctggggatcgcttcagccactaggacctgaaaattgtgcacggcctgggcccccttccaaggcatccagggatgctttccagtggaggctttcagggcaggagaccctctggcctgcaccctctcttgccctcagcctccacctccttgactggacccccatctggacctccatccccaccacctctttccccagtggcctccctggcagacgccacagtgactttctgcaggcacatatctgatcacatcaagtccccaccgtgctcccacctcacccatggtctctcagccccagcaggccttggctggcctctctgatggagcaggcatcaggcacaggccgtgggtctcaacgtgggctgggtggtcctggaccagcagcagccgccgcagcagcaaccctggtacctggttaggaacgcagaccctctgcccccatcctcccaactctgaaaaacactggcttagggaaaggcgcgatgctcaggggtcccccaaagcccgcaggcagagggagtgatgggactggaaggaggccgagtgacttggtgagggattcgggtcccttgcatgccagaggctgctgtgggagcagacagtcgcgagagcagcactgcagctgcatggggagagggtgttgctccagggacgtgggatggaggctgggcgcgggcgggtggcgctggagggcgggggaggggcagggagcaccagctcctagcagccaacgaccatcgggcgtcgatccctgtttgtctggaagccctcccctcccctgcccgctcacccgctgccctgccccacccgggcgcgccccctccgcacaccggctgcaggagcctgacgctgcccgctctctccgcagctggccttctggtccaagcacgtcggtgagtgcgttctagatccccggctggactaccggcgcccgcgcccctcgggatctctggccgctgaccccctaccccgccttgtgtcgcagacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttgggggcgcggcaccagcaccagctgcccgcgccctcccctgcccgcagaggtgagcttcctcaattgctcgctggacaacggcggctgcacgcattactgcctagaggaggtgggctggcggcgctgtagctgtgcgcctggctacaagctgggggacgacctcctgcagtgtcaccccgcaggtgagaagcccccaatacatcgcccaggaatcacgctgggtgcagggtgggcaggccccctgacggggcgcggcgcggggggctcaggagggtttctagggagggagcgaggaacagagttgagccttggggcagcggcagacgcgccccaacaccggggccactgttagcgcaatcagcccgggagctgggcgcgccctccgctttccctgcttcctttcttcctggcgtccccgccttcctccgggcgccccctgcgcacctggggccacctcctggagcgcaagcccagtggtggctccgctccccagtctgagcgtatctggggcgaggcgtgcagcgtcctcctccatgtagcctggctgcgtttttctctgacgttgtccggcgtgcatcgcatttccctctttacccccttgcttccttgaggagagaacagaatcccgattctgccttcttctatattttcctttttatgcattttaatcaaatttatatatgtatgaaactttaaaaatcagagttttacaacttttacatttcagcatgctgttccttggcatgggtccttttttcattcattttcattaaaaggtggacccttttaatgtggaaattcctatcttctgcctctagggacatttatcacttatttcttctacaatctcccctttacttcctctattttctctttctggacctcccattattcagacctctttcctctagttttattgtctcttctatttcccatctctttgactttgtgttttctttcagggaactttcttttttttctttttttttgagatggagtttcactcttgttgtcccaggctggagtgcaatgacgtgatctcagctcaccacaacctccgcctcctggattcaagcgattctcctgccgcagcctcccgagtagctgggattacaggcatgcgccaccacgcccagctaattttgtgtttttagtagagaaggggtttctccgtgttggtcaagctggtcttgaactcctgacctcaggtgatccacctgccttggcctcctaaagtgctgggattacaggcgtgagccaccgcgcccagcctctttcagggaactttctacaactttataattcaattcttctgcagaaaaaaatttttggccaggctcagtagctcagaccaataattccagcactttgagaggctgaggtgggaggattgcttgagcttgggagtttgagactagcctgggcaacacagtgagaccctgtctctatttttaaaaaaagtaaaaaaagatctaaaaatttaactttttattttgaaataattagatatttccaggaagctgcaaagaaatgcctggtgggcctgttggcctgtgggtttcctgcaaggccttgggaaggccctgtcattggcagaaccccagatcgtgagggctttccttttaggctgctttctaagaggactcctccaagctcttggaggatggaagacgctcacccatggtgttcggcccctcagagcagggtggggcaggggagctggtgcctgtgcaggctgtggacatttgcatgactccctgtggtcagctaagagcaccactccttcctgaagcggggcctgaagtccctagtcagagcctctggttcaccttctgcaggcagggagaggggagtcaagtcagtgaggagggctttcgcagtttctcttacaaactctcaacatgccctcccacctgcactgccttcctggaagccccacagcctcctatggttccgtggtccagtccttcagcttctgggcgcccccatcacgggctgagatttttgctttccagtctgccaagtcagttactgtgtccatccatctgctgtcagcttctggaattgttgctgttgtgccctttccattcttttgttatgatgcagctcccctgctgacgacgtcccattgctcttttaagtctagatatctggactgggcattcaaggcccattttgagcagagtcgggccgacctttcagccctcagttctccatggagtatgcgctctcttcttggcagggaggcctcacaaacatgccatgcctattgtaggagctctccaagaatgctcacctccttctccctgtaattcctttcctctgtgaggagctcagcagcatcccattatgagaccttactaatcccagggatcacccccaacagccctggggtacaatgagcttttaagaagtttaaccacctatgtaaggagacacaggcagtgggcgatgctgcctggcctgactcttgccattgggtggtactgtttgttgactgactgactgactgactggagggggtttgtaatttgtatctcagggattacccccaacagccctggggtacaatgagccttcaagaagtttaacaacctatgtaaggacacacagccagtgggtgatgctgcctggtctgactcttaccattcagtggcactgtttgttgactgactgactgactgactggctgactggagggggttcatagctaatattaatggagtggtctaagtatcattggttccttgaaccctgcactgtggcaaagtggcccacaggctggaggaggaccaagacaggagggcagtctcgggaggagtgcctggcaggcccctcaccacctctgcctacctcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtgggaggcgaggcagcaccggctgctcacgtgctgggtccgggatcactgagtccatcctggcagctatgctcagggtgcagaaaccgagagggaagcgctgccattgcgtttgggggatgatgaaggtgggggatgcttcagggaaagatggacgcaacctgaggggagaggagcagccagggtgggtgaggggaggggcatgggggcatggaggggtctgcaggagggagggttacagtttctaaaaagagctggaaagacactgctctgctggcgggattttaggcagaagccctgctgatgggagagggctaggagggagggccgggcctgagtacccctccagcctccacatgggaactgacacttactgggttcccctctctgccaggcatgggggagataggaaccaacaagtgggagtatttgccctggggactcagactctgcaagggtcaggaccccaaagacccggcagcccagtgggaccacagccaggacggcccttcaagataggggctgagggaggcccaaggggaacatccaggcagcctgggggccacaaagtcttcctggaagacacaaggcctggccaagcctctaaggatgagaggagctcgctgggcgatgttgggtgtggctgagggtgactgaaacagtatgaacagtgcaggaacagcatgggcaaaggcaggaagacaccctgggacaggctgacactgtaaaatgggcaaaaatagaaaacgccagaaagggcctaagcctatgcccatatgaccagggaacccaggaaagtgcatatgaaacccaggtgccctggactggaggctgtcaggaggcagccctgtgatgtcatcatcccaccccattccaggtggtcctgctggactcaaagaagaagctggcctgcggggcagtgctcatccacccctcctgggtgctgacagcggcccactgcatggatgagtccaagaagctccttgtcaggcttggtatgggctggagccaggcagaagggggctgccagaggcctgggtagggggaccaggcaggctgttcaggtttgggggaccccgctccccaggtgcttaagcaagaggcttcttgagctccacagaaggtgtttggggggaagaggcctatgtgcccccaccctgcccacccatgtacacccagtattttgcagtagggggttctctggtgccctcttcgaatctgggcacaggtacctgcacacacatgtttgtgaggggctacacagaccttcacctctccactcccactcatgaggagcaggctgtgtgggcctcagcacccttgggtgcagagaccagcaaggcctggcctcagggctgtgcctcccacagactgacagggatggagctgtacagagggagccctagcatctgccaaagccacaagctgcttccctagcaggctgggggcacctatgcattggccccgatctatggcaatttctggagggggggtctggctcaactctttatgccaaaaagaaggcaaagcatattgagaaaggccaaattcacatttcctacagcataatctatggccagtggccccccgtggggcttggcttagaattcccaggtgctcttcccagggaaccatcagtctggactgagaggaccttctctctcaggtgggacccggccctgtcctccctggcagtgccgtgttctgggggtcctcctctctgggtctcactgcccctggggtctctccagctacctttgctccacgttcctttgtggctctggtctgtgtctggggtttccaggggtctcgggcttccctgctgcccattccttctctggtctcacggctccgtgactcctgaaaaccaaccagcatcctacctctttgggattgacacctgttggccactccttctggcaggaaaagtcaccgttgatagggttccacggcatagacaggtggctccgcgccagtgcctgggacgtgtgggtgcacagtctccgggtgaaccttcttcaggccctctgcccaggcctgcaggggcacagcagtgggtgggcctcaggaaagtgccactggggagaggctccccgcagcccactctgactgtgccctctgccctgcaggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaagccactagagccttttccagggctttgggaagagcctgtgcaagccggggatgctgaaggtgaggcttgaccagctttccagctagcccagctatgaggtagacatgtttagctcatatcacagaggaggaaactgaggggtctgaaaggtttacatggtggagccaggattcaaatctaggtctgactccaaaacccaggtgcttttttctgttctccactgtcctggaggacagctgtttcgacggtgctcagtgtggaggccactattagttctgtagggaagcagccagagacccagaaagtgttggttcagcccagaatgagctcacagtgtcgcgggggaagctgtttaagaacaatgttacaccatcatgaacagcagtaagaaagaggctctggcttaacctggcctgataggcctaattgaatgagacagaaataagtcaaggatgctctgatttgaaatcatgaagtacctgatgaaaagaaatggtggtgagataaagctgagaaaattcatctaaagcccaaaattagtctagctctgtgtgtggcctcaggcaagtctttttctcctctctgagtgtgatggttaattttaggtgtcgatttgactggatgaagggatacccagatggctggcgaagcatgatttctgggtgtgtctgtgagatgttctggaggagatgggccactgagtcggtggactatgtggggaagatccgccctcagtgtgggcaggcaccatccaatcagctcgggacccagacagaataaaaaggcagaggacaggtgaattatctgtctctcctagagctgggacacccttctcctgcccttggacatcagttccaggttctcaggcctttggactctgagacttaacaccagtggccctccagattctccagccattagccctgtactgaggatcctgctatcagcttccctggttctgaggccttgagacctggactgagccaggccggcttcccgggctctccagctggcaggtctgccatgggactcctcagcctcaatgatcacagaagccaaatccttaataagccccttctcatctatctgtgtctatatatacatcctattagttctgtctctggagaaccctgactaatccaggggacatcagtaaaatgaagggattggatgagagcagtggttctacaccctggctgcacatttgcatctcccggacagccttttttttttttttttttttttttttttttgaggtggagtctcactttgtctcccaggctggagtgcaatggtgcgatctcagctcactgcaacctccgcctcccgggttcaagtgattctcctgcctcagcctcttgagtagctgggattacaggtgcgtgctagtagagatggggtttcaccatgttggccaggctggtctcgaactcctgacttcatgatcagtctgccttgcctcccaaaatcctgggattacaggtgtgagccaccgtgcccggccccagagagcttttaaaaacactgatgtggccgggcgcggtggctcaagcctgtaatcccagcactttgggaggctgaggtaggtggatcacgaggtcaggagaccaagaccatcctggctaacacggtgaaaccccgtctctactaaaaatacaaaaaattagctgggcgtggtggtgggcacctgtagtcccagctagttgggaggctgaggcaggagaatggcgtgaacctgggaggcggagcttgcagtgagccgagattgtgccactgcactccagcctgggtgacagagtgagactccgtctcaaaaataaataaataaataaaaataaaaataaaataaataaataaaaataaaaacactgatgtccagtcccacccccagagatgctaatttaactgattgtgccaggggagtggggacccagacattgatatttttacaactctccaattcatttcaatgtgttcactggggttgaaagcgactgggctaggccaggtgccatggctcatactggtaatcctggcgctttgggaagctgaggcaggaggattgcttgagcccaggagttcgaggccagcctgggcaacatagggagaacttgtctctatttaaaataataataaataaataaaaataaattaataaaaatggaccaaatggtctttaagggcctttcttctcaggtaaactctagttctaagactctccaggccaacgaggataaagccaattatctgagaaagcacagcacagctcagtccacagtaaaataaaggaggacttgatttgtggccacagctgcggccagaccagagaggacaccaggacccacggagttagttatctgtgtgtggccacaagaaaagagatctgcccgagctggggcctgtgggattctcctccttactgacctgggggaggaataggtggggctgcctggaaatgggagcaaaccgcgcccggggctggaagcacccgccgaatggcacagggccagtgcccaccacagtctcagtggaggtgacggactgaaagaatgacagaggactggaagtcttcgcctctgctgaagatttccgggtgggctgctgtcaggatggtgaccctgcatggcctagagcacctctggcatgacagtgttgggagatccaccgacctgctgcctggggaaaccggggaaaattagaaaagcaaacaaacatttcaagtcctggaaatggccctgagggcaaacaaaacaagaacaaaaatacaacttttaaaccaacagaagaaaacttgatgtgcccaacagaaagcaaaggagaggaatgaaaataagcgagaagcacgtataaatcaactgcatttctctacacgaacatgaacatgtggaaacccaggttaaaagcacaacagcacccctgtcactttaaggaaaaagtacttcgatatacatttagcaaaacatgtaccagatctgtgtgacaaaattcacaaaataccgggaatgtccattctcccaaaattgatctacagatgtcatgtaattcctatcaaaatcccagtatgtctttttgtggtcataaacaaggtactatatgtgtgtgtatgtgcgtaaaggacctcaaatgactagaatgttttggaaaaaagaattagagaaatcgctctacccagcgtcatggcttgttgaatagctacagtcatcagactacgtggtgctcatggaggaagagaaacacggatggagcgaaatggagactgtggagcgagacccacacagctacagccttttgatttttgacaaagataccaaagcaattcagtggaggaaggagaggcttttcaacaaagggtgctggcacagtggggcctcaataggcaaaaaagtgaacctcaacctatatctctcacctcatacaaaaattaactcagcatggaacttaggccgggcgcagtggctcacacccataatcccagcactttgggaagctgaggcgggtggatcccctgaggtcaggagtttcgagaccagcctggccaacatgaagaagccctgtctctactaaaaatacaaaaattagctgggcgtggtggcacatgcctgtaatcccagctacccaggaggctgaggcaggagaattgcttgaacccaggaggcggaggttgcagtgagccaagatggcgccattgcattctagcctgagtgacacagtgggactccatctcaaaaaagaaaaaaaaaaaagagaatggaacttagatgtaatgtaaaactatgaaacaaaacaaaagaaagtacagttgatggaaactgtgaaataagatggaaataataacaataaatgtaattaggttaagcttaccaatttaaaaagataaatctaagaattaaaaaaccaatgagacaatatattgattagagacaacttaaaaagcacccaaagactgaaaataaagaatgctagaaattccatgcaactttgaatgaaaagaaagctaagatagtgattccagtaacgaatacaatggaaattaagaaaaaaataccataaagaacaatgatggacattatatacagaaaaaatcactcacatgtaaagatctaattattataaaacaatatgtgcccctgcaacataacctccaaatactgcatacagtgtgacatttgacagaagggaaaggagaaataaacaacttttacttgtatttggagagttttttaaaaaattatcttataaaccaataaatcaaacagatttttaaaaagtggatatgtagatgatctgaacaataaaattaataagcttgagcgattctttttttgaattgagtctcgctctgtcacccagggtggactacagtggtgcgatcttggctcactgcaatctctgcctcccgggttcaagcaattctcctgtctcagcctcctgagcagctgggactacaggtgcccaccaccatgcctggctagttcttgtatttttattagagatggagtctcgtcatgttggtcaggctggtctcgaactccaacctcaggtaatccacccaccttggcctcccaaagtgctcggattacaggcgtgagccactgtgcccagccgagtgattctttttgagcacactaggaacatttacaaaactatactggaccatgaagaaagcctcaataaattccaagggatcaatataatacagagcatgtcctctagctaaaagacaataaaagtagaaatttctaatgaaaaactttaaaaatgccatatgtctgcaaactaattaacatatcagcaggcaatcataagataaactaagaaattgtaagaattatatgttaatttgtgtttcacagctacagcaacaccaggagggaaattatacctttaaatatacttatccaggctgggcgcggtgtctcatgcctgtaatcccagcactttgggagcccaagatgggtgggtcacctgaggtcaggagttcaagactagcctggccaacatggtgaaattccatctctactaaaaatacaaaaattagctgggcatggtggtgggcgcctataatcccagctacttgggaggctgaggcaggaggatcacttaaacccagggagtggaggttgtggcgagtcaagactgcaccattgcactccagcctgggcaacaagagcgaaactccatctcaaaataaataagtaaatattcttatccagaaacaaaaagttaaaagcaaatacatgttattcagggttctccagggaaatgaaattgaccgaatagagagagagatttatttcaaagaaacagctcacataatcgtgaaggctgataagtctaaaatctgcagcgtgggcctgcaggctggagacttagggaacactcacagtttgagtctgagtgcagtgtgctggcagaattccttctttcttgggtagagtcagcctttattaagaccttcaactgattggatgcagcccacctgcattatggaggataacctgctttactcaaagtccactggtttaagtgttaatctcatccaaaaaaacatctgcccagaaaacattcgaaatgatgtttgaccaaatatctggatactgaggcctagccaagatgacacataaaattaaccatcacgaagggtcacgggttgaattgtgtcctcccaaaattcacacactgaagccccaacctccaaaaactcggaatgtgacctcacttggaaatgggattgctgaggatataattagttaagacaaggtcaatacaaaagttagctgggtgtggtggtgggtgcctgtaatcccagctactcaggaggctgagacaggagaatcgcttgaacccaggagacggaggttgcagtgagctgagatcaagccactgcactccagcctgggcgacagggtgaggctctgtctaaaaaataaataaatacataaatacataaataaaaagacaaggtcattctggaatagggtggacccctaaaatgattggtgttctcataaaaaggagaaattggggcacagacatgaacggagagaagacaacgtgaacacacggggagaacaccacatgaagatgaaggcggaggtcagggccactcatctacaagccaagggctcccaagatggcccgcaacctccagaagctgggagagcagccttgaccagcttcacccttgcagccctcagaaggcagcaaccctgctgacacctcagtcttgaacttctagcgtccaaaactgtgaaacaatggatttctgttatttaggacatccagtctgtggtactttattataacagcccttgcaatctaatacagcaggtgacatgaaatccttacttaagaagctggaaaaacaccagatgcaggatcacgcctgtaatcacagcactttgggaggctgaggagggaggatcacttgagctcaggagttcaagaccagcctgggcaacaaagtgaccttctctctacaaaaaatcaaaaggttagccaggcacggcggcatatacctatggtcccagctactcaggacgctgaggcaggaggatctcttgagcccaggaggttgaggctgcagtgagctgtgagtgtgccattgtactccagctggggcaacagagtgagaccctgtttcaataattaaataaatacatacatacatacatacgaaactgggaagagagcaagtgacataaaaatcttacttaagaagctggaaagtaacacaaacccaaagaaacaagaaggagggaaatataaagataaggaggcagaattgagtgtaagagaggtgcaaatgatgaacacaagaaataacatcaaaagcagagaggcagatctatgaaaaatgcagattagaaagagtgacaggggcgtagcaatgattttactataagctaatacatttgaaagcctaggtgaaatacacacattcctgaacaaatataaaatactaacactggtgcaagaagaaaactgcactgccggtaaaagccattccactccccttcaaaagcttctgtctcatgctgctttgtgtgcgagttctgtcaaagttttaaagaacagttagttcccatcttaaacaagtttcctcccccgaatggaaaaataacaaaacccacccaactcattttatgatattttgtgccatgcagccaggctagaacttctgtacctcctggagggaagcacccacatcccttggctcctgagtgtggaaagctctgccctctggctctgtgaaagcggctgtctccagacagactcgggtgcaggcagctccttgcaaggtcggcagggagagcatgccccatctgcccctgtcttttgaaacatcctttttgccccatattgattgattgattgattaactgattgagacagagtcttactctgtcacccaggctggacggagtgcagtggcacaatctcagctcattgcaacctctgccttccttgttcaagcaattctcctgcctcagcctccccagtagctggggttacaggcacctgccacaaatctcagctaatttttgtatttttagtagagacacagtgtcaccatgttggctaggctggtcgtgaactcctgacctcacgtgatccgcccacctcagcctcctaaagtgctgggattacaggcatgagccaccacgcctggctccccatccttgatttgtacatgttttttgtttttgtagatttaggggtttgagtatagatttcttgcttgcatggattatgcagtgctggagtctgggcttctagtggagccatcgcccagtgagccctgtacccaaataggtgattttcaaccctcaccccttcccttccacctttcgcagtctcccacgtctaggattccactctgtatgtccatgacaacacccagctttagagtgcacggctgagggcacagtcgaggaggagacaccctcccccagggggcacatgctgggccttctggaggcagatgagggagagtctcttgggaggctgcaggcctggcgtgcgtgggggtgtgtcacgaaggaggtgagcagtgtaggggacaggctgggttaagcttatccattgaccatatctatcgagtgccacctctgggcccagagctgagcccagacaggcgcatgggtcagacaaggcccagggacacacaaattgtagaagagaagctttacacaagcttgctttaacagagccttttcattgacaaaaataaaaggacgtgaaaagaaatttaagactcaatgggctgaagagtgatctcttattaccgcaacatttgagagctgatgtcagatggcagcctggctgcagagaaggtacccaggccctgggctcagtggcccttccccagctggtgcccccagccttactgcctggccctcctgcaccttcttttccttgtctaggaactgggctcatccccctctatccccagtggttgtggggatgaaaggaaggccaacccctgcaaggcctggtgcctggagctggccctgggtagacgcctccctccccttcttcctgagcccttcatgcagagcccaggacgcaatggtcacaatggctaaaatctctttggaggagggagagatcagtgcaggctgaagccattggtgagagtggaagaattcagctctccagcggaaggcagcaatatgcagagagccctgtgatggggctgctggagccgaggcctgggggttcagtcccctgagaagcccccaccagcttagcctgggggacgagttatgggaaggacagatgagaaactgctaactaaacaaggccaaaaggaccagggcaagctgggggagaccatggaggctgtggaaggaacaggctgactaagcctcaggagaggccaagagaggctaagcagggagccaggtcctaggaaagaaacagcacccagctctggggccatgccggggaggctgtgggtagagggctagggcaccaggccatattgagaaccttcattgcaggcccatgccaggcacgtgacccacagtgacccggggcttcacagagcaaccaagggaggaactgccgactccattctgatgaagggaaaagagcctctggggggctccctacatcactgctattggaggagtctgggtaggaatgcagcaggctccaaagtccctgctgtgtcccgtgggccatggagccaggtggcgggtcagggagaggagtggtgcatggttgggcagtggcaggacctaggctctgtcaatatttggtgtgggtcaatcattagccagcctcagacttgtccccccacaggttcctcaggtgggttctgggctaggccctgccctgctgggggctccacagggcttggcctagattggacgagtcgggtgggcagcccctggtctctccactcaggagactccccacccacagggctgcagtcctgcctcagggctcagcaagcaaacacgtaagagcactgcacagttgaaaaaatgagttttaaaacaatctgccaagaaaaaagatgtcaaagtagtcatcacgggaaaagtcagaattttggtggacttcactgcacttattctgtggctattaattttaaattatgtatgtgggggaggggagcacaccataatctttctagtgccctgaggctcttaaaccaggctctgttcacctggacctgtgttcatgggcaggaaactgttctaggccctttatatgcattgtttgatttaatcctgtaagtgattttttttttttttttgagacagagtctcactctgtcacccatgctatagtgcagtggtgtgatctcagctcactgcaacctctgcctccccggttcaagtgattctcacgcctcagcctcctgagtagctgggaccacaggcgtgcaccatcatggccggctaatttttgtatttttagtagagatggtatttcgtcatgttggccaggctggtctctaactcctggcctcaagtgatctgcctgc

SEQ ID NO: 544 - DNA, 45215 bp, Homo sapiens
aaaaataaaataataataataattgcattcgtaggccgggtgcagtggctcacacctgtaatctcagcagtttgggaggccaaggtgggtggatgacctgtggtcaggagttcaaaaccagcctgaccaacatggtgaaaccccatctctactaaaaataaaaaattagccgggcatggtagtgcacacctgtaatccctgctacttgggaggctgaggcaggagaattgcttgaacccggaaggcagaggttgcagtgagcagacatcgcgccattgcactacagcctgggcaacaagagcgaaaatccatctcaaaaaaaaaaacgcatttgcttcttagggggtttcagacatttaagagaatcctatgtattaaatgcaagattttttttttttttttaagatggagtcttgctcttgtcacccaggctggagtgcaatggcgcgatttcggctcactgcaacctctgcctcctgggttcaagcgattctgctgcctcagtctcctgagtagctgggattataggcgcttgccaccatgcccagctaatttgtatatttttagtagagacagggtttcaccatgttggtcagcctgttctcgaactcctgacctcaggtgatccacccgcctcggcctcctaaagtgctgggattacaggtatgagccactgtgcccagctaaatgaaagattttaattaaatgcttaaatgagtttaagtctaaaatcaatatttaggccgggcgcagtggctcacgcctgtaatcccagcactttgggaggctgaggtgggtggatcacaaggtcaggagatcgagaccatcctggctaacacggtgaaaccccatctctactaaaaatacagaaaaattagccaagcgtggtggtgggcacctgtagtcccagctactcaggaggctgaggcaggagaatggcgtgaacctgggaggcagaggttgcagtgagccgacatcacgccactgcactccagcctgggtgacagagaagactccgtctcaaaaaaataaataaataaataaataaataaataaataaataaataaaatcaataatgtgttttaatcagtttggattattaaatccataaatgtctatgtattagttgtgtacatagtgtataaatagaagaatatttaatgcttaaatgctatttgtttaataaattcataagagaaacaaaattacattaagtagaaataccttaatgacatttagacactgagagggtgtcccaggaaaagagaggggcacctgaacttgaaggctggtgacagatgtttaaggggccactaacataccagatagattttatcttcctagactcatcatctttgcacctattaatcatgaacagagttagttctcctgaattcatcatatgaaaatgtcacagtggacagagagactcaagagaagtgagttttgactgggtgagtcaagagggattatggtcctgagtagccagggagtgatttaagtacgggattcagagaaaggagggacagaggaagaggtgctaaagaaacaaccctctggccgggcggggtggctcacgcgtgtaatcccagcactttgggaggctgaggcgggcggatcacgaggtcaggagatcagaccatcctggccaacatggggaaaccccgtctctactgaaaaatacaaaaattagctggggatggtggcacatgcctgtaatcccagctactcgggaggctgaggcaggggaatcgcttgaaccagggagtcggaggttgtggtaagcagagatcacgccactgcactccagcctggcaacagagcgagactccgtctcaagaaaaaaaaaaaaaaaaagaaagaaagaaagagaaaaaaaaaacacctgctgcatcagtcacaactgccatcctgaggccaagaagaactaaatggtctcaaaattatttcacaacttgttgctaccacctttccacagtggggcttgtctagccagagaatcaaacattaattcactttaggctggtcatggtggctcatacctgtaatcccagcactttggaaggccgaggcaggaggatcacttgaggccaggagttcaagaccaacctgggcaacaagcgagacccccatctctacaaacaaacaaacaaacaaaagagtaagcacgtcatacacatcatagaattctaagaactgaagtaaccttgtaacatttagttcatggtaaatacataaaggaaactattattattatcacccaacagtgtgtgtgtaagtgaaaaatgtcttttttactgacaaatggctaagtgaatgctgtttgtttgagggatgaaatatttaaatgagaagccaactcaactcttcctcttgatcttagagtcattctctcaagtgtaactcccagtgcaaagcatcacatcaacttatcaatcgactgtgatgtcaactacagcctctgcaccagaccagccctcctctgtgggacgaagaactatcctgtggtcctgccaggactgcctcactgggacaacgcactgcattaggatctatcccttacgatggctcagggttttccagtctctaaggcaccttatcattatcttacctaaacttcctaataatcctgtgagggaggctggacatctgctttcatcccatgttacagatgagaaaacgaaggtccacagaggtcaatgacttgcctaaggtgacctggcacagaaagttgtgtggcagaaggggaacttctgtttcctaacttctggataagcgccctcctaggataggagaaatgaatgactcttgctactccagccaccacttccactaattaaccactaataaaaatgtaaaaatcagtatgccagcagtagtccctgttgcaaacattaggacctttctcatatcacagattactgaagacattccctctctttttgttgtagttgttgttgtttggtttttgggtgttgtttttgttgttgttgttgtttttctgagatggagtttccctcttgtcacctaggctggagtgcaatggtgcaatctcagctcactgcaacctctacctcccaggttcaagcgattctcctacctcagtctcccgagtagctgggattacaggcgcccaccaccacacctggctaactttttatttttagtagagacagggtagcaccatgttggccaggctggtcttgaactcctaatctcaggtgatccaccctccttagcctcccaaagtgctgggattacaggtgtaagccgcctttcttttcttttctttttttttcctttttagtcttgccctgtcacccaggctagagtgcagtggaatgatcatggctcactgcagcctcaacctcccaggctcgggtgatcctcccacctcagcctcccaagtagctggtaccacaggcataacaccatgccaagctaatattttattttttttaaagtttatttttgctcttatgatgatgattttttttttgagacagagtctcactctgttgcccaggctggagtgcagtggcacaatctcagctcactgcaacctccatctcccaagttcaagcaattcttatacctcagccttccctctagctgggattacaggcgtgcaacaccatgcctggctaatttttgtatttttagtagagatggggtttcaccacattggccaggctggtctccacctgccttggcctcccaaagtgttgggattacaggtgtgagccaccatgcccggcctactcttaattttttttttaagtgctcaagctaattttttaattactatttgtagagatgaggtctccctatgttgcccaggctggtctagaattcctgggctcaagtaatcctcctgcctcagctcccaaagtgctgaaattacagacatgagccaccatgcccagttccaccattttttaagcaacaactaacgttaatccaaagaccaccctgaggggactggccacatccccctgggaccctccactgttaaagtccatcttccctgagccatcagcaccaagcatcagatgaacttcactgccctggctcagtgttgcctgtgtgtgagcctcagctccccatcctctctgggcctcagtgtcttccctgtgcagtatgccccgcagtgcccacccaatggggttgttgtgaggatttgctggaagggtgtgtgtgcaagccccttgtccaggacctggcctatatgtaaatataataaaagttcgttgttatttctgttaattgcatattgtacttgaatactccctggacagataatgagaaaaatgaggtttgagtcaccacccctgtcacttgtaaccctgtgtgacttgcttaatccctctaaatctcagttcctccatctgtaaaaatctttttttttttttgagacggagtctcgctctgtcacccaggctggagtgcagtggcgcgatctcggctcactacaacctccaactcccgggttcaagcgattctccagcctcagcctcctaagtagctggcattacaggcaccatgcctggctaatttttgtgtttttagtagagatgaggtttcaccatgttccccatgttggactaggctgtctcgaactcctcaggtgatccgcctgcctcgttctcccaaagtgctgggattacaggtgtgagccaccgtgcctggccgcaaaaatcttataatgccttcctcacagagaataatgaaggttaaatgatgaaacgcacagagcattttaatgctgagaagggcttcatgaggttgttgaaaaatgtcagtgaggctctgggagggctacagccggagtgtagattagactctgggtgtagccgcatggctcaggaattgagtggaagaagagagatgatgagagagggggagggacagagagagaggatcagccattccttcgtgcctgctgagtgcctgccctggtccagaccctgttctttgtgctgggggtgcagcagtgaactaaagagacaaagcccctgtcctcgtggtgcttatgctctagtgagtctgtggaacagagcaggggactgttgacaccaaatttaaatgtgcgaataggaatgactatgcagaagaggccaccaggaagagggacagagagaaatgagactccaggcttgatagaatgaccttgggctggtggaagaggcaggtgctgaaaacaggcatggaaccccttgccctagggcagggagaaaccaagagagtccaagctgggaaaagaatcaggtgaggaggttgaggtgttgacgaagggagtgtgcttggtgatgggaaaggtgggctctgaggaaggtgttccaggaaggacttctcagtgtaggatggagccttatggcagacgctgggaccgggcatcttctccagaaatgcccatctgccactcaggcaggcaggcaggcagctccctaccccttgagttctggtgtttttcctactcctttctcccctcccacaagctgcccaactcccagggacctgactggatggagagtacatacacctggaccactgcaggcatggcacagggaagagagaatccagacccaaatcacctccaacccacacctgctgattcttccgtgcttttgtagcctgacccttcgctgccgtcactccaactcctgtgtgaggatgttgagctcctgggaaaaccgaagggagggcaggagagacaatactgtgaccaaaggctgagactgtgtcatcacttgggaatgaaagcatcaaatgccaccccaggtgggattgttggcttcaaggtttttttctccctttcctttctcccttttctcttttcctttatcgaggtctgctatttactcagcaactcttcaaagtctgtggttctgtgggacacaatgtgctaaatgatgcctgtaagggaggaggtcgatgtacctccacttccaagaagcttgactttccggggaagaaaagacaagtgaagcgtagacattgcgacttttggcttcctgtttctgtgagttgcaaggaatcctgtccacctggccctggagccgccttctgggacctcatccttgccccctgctgcaggtgccatctcaattagtcctgctgtccctcctccccctttcagattccagcacaattctggaacagctctcccacctggccggggtgagactgaggctccaccctcaagcacttgggcactgatcctttgtgaaggatggggatagcaagacagcgtctgcaggggcccctagagggccgtggggatggctagaaaacaggaatgaacagactcacttcagcttatgcccagactcacttcagcttatgcccagaaacaaagaaaccaaggagaagcaaattccataagtgcttttattttattggagatgagcaggggaggcactgaaaagtggggatagtgctggaaacatgctgacagggcctggattgagcccacacagcaaggggcgggagcaggactctaactcccaatgttgggtttccctctatcgtgctctagccccactgcaacctagggcttggaggattagggaagccagctgggatgttccaagaagagccaggagggcggaggactccaggaggaaatgggttattgatacctgggtatagatgaatattcccccagctgcctcctggataccgattaatattcccccagctgcctcctggataccgattaatatttccccagctgcctcctggataccgattaatatttccccagctggtacctgggggttgattattgataccccagattccctcagggtgtggcatgggcctcgttccccaaccagtcccagggcctccacctccccaggacacactgggattcagggtaccccaggggtgatcaggcagaaccctgtggatgagagaccagggagggcgttgggaaaggatttttcccccggctcccagtgaattagaacggggcagtcgtctggactccgagtcctggtggaggagtgaagccttgggtgagaggcctgtggcatcgggagaagactccccaggcaaagggccactgcccggagcgagggccgcagcactggagaggtaagagagttcttcaggcagcgcttcccccaggcggtcctcagccgcagcagccatcatctgccaaggatcctcagggggccaggaatccatggcaggcagcccccacgatggaggccacctctgcactgcagaacctcctgcaggtgggaagccatctgatgcaggcacgctgagcttcagaggaacccttgccaagtcattagacctagggtccagagcgggctgcggatgttcagagttagaggggccagtggaggaaggttgtccgagctgaggcaagttggtccccaagttttgggaaactttctcctccacaacaccgatgctccgggcaaagaggcctgagggaaagggaagataaagcaaccagtggtctccagtccccgagtccccagttccctttgcttcccctatgcctattcttccttttccctcagggacctaaatgtgtaccctcctgcctttacccctttccttaattcctgtttcctgggggacctccagtccctcctgcccaagggcatcacggcctccatacctgggagatgaagacagaccaggagcaggcccagaggagcgcagctccctgccacgcggccctgcatcctgctcagcacccgatctccctcagccccaagacagccagccctttatcctggtagtggggtgggggacagcagaaacaggctgggctagtggttgtgaagacaataaacctccacattccaccctcattcctaatgtggtctgtggcaacaggtgtcacttgaatgaatgtcccagaggaagctgggtgtctcccgccctggctcctttccttgacctccctgccccttcttggcccaggtgtcctggctcacagctcatccctggttgccagcctccccagccctgcttctctatacacaaggacctccaccctggggtcccactctcttaattgcctctctcagcaacagaaacacttgtttctttttgggagctggattgtttcctcccagcacccctttctcatgcatcctcatatctccttcaccttggccccaacctgcaggaggttctggggtgcagaagtggccccatctgaggagctgctcctacatgagaccctggatctagctagggaaatggacctggatgccatccttatgagatactgactaattcctgctgctgcagtgacaaattaccatgaaccgaatggcttacaacaacatggatttattactttacagttttggagatcagaagtctaaaacaggtctcagtggattaaaataaaggtgtcagcagggctgtgattctttctgggggcctcaggggaaaatccctttccctgctttttcaccttctagaggcatcctgtgttctttggctcatggtccccttcctccatctccaaagccaaaatcagccatttcttacactgtatcactcagacttcctcttctgcctcccatgtccacattaagggacctggtgactacactggacccacctgaataatccatgataatctctgtgaagtcagccgaatagcaaccttaatcccatctggaaccttaatttccctttgccatgtaacctaattcctacgttccagggattaggatgtggacatctttgatggtgttggggttgaagacatcattctgcctgctactggtggtcagatgtgccatagagtataagaaaccttgggagaaagtggctatttccaagtaacagtagaggagagcctttaaatgctgctgtcaaatggccaggacttgatccttgttgaagctgggcgatgagaatgtagagattcattaacagtttgttggcttttaaatatgtttgcaaattttattataaaaatgcaatggctttgttctctccatggcttccgggaggccccaggagtaggcttccctggctgcccaaggtctaaacatgagctgttggctgattctactgctgtgtcctccccacctgcccctgctggcttaaccactggaggagtgaagagctcctctccagaactggcagtggatggagcccagaggcctttttggatgacatgcatgagttttacacaagcttttaatttggagcacagcaggagactcgaggaaacaccacatcagagagccttctctccctgcaattcccattcatgaagcatctgaggacctcgattcctgccattggctgcagatcaggggccagatgctggaccaagggtgattcaatccctttctggtcaatgtaatacatttttgctgattccagacttggagtttcaacagttctaaattcaggaccagacagcaccaccctgataggagggaatgggttaagtgctacagtaggggtgaattcctttgcagccaagcagaggctctgagaggtggcctggggtggggggtggggctcctacagggacaagcacaatccactctgccctccttgggatgcgggaacttcgtccgcctcagcctctccctgcctgtctcaggacttaagtcgcatggaccccaccacacactccactttctctctcttctccagtggaagcgactcctctttcccactggggcactctgccttctcagccctcacctgagagccatgttgctcacactctcactctggaccccagcagagcagggagtgtgaagatggagagaccaccggcagctctgttctgccacaggctgggcctcttgatctaggccagtgagtcaccctgcttggctgcactccctgccctgctcccatcctctcagtcctttactctctccacccccagctccaggaacaacgcccaactggcctcctactcagctgacaggaatctggttggagttgttgtgtcccagccttcccaagcttccaggtgtcccagaaacccaggaaatcgagactcatgactcccagagaggatggcatctagaaggtgaggaatgctaatggtggaagaaaaggagtttgggtggggaggggaggggaggggagggagaggaaacactgagggccctaaataaggggaagggggaccccacggtgaatgaggaatgggaagagaatggatttcctggagcaatgagagaggagggaaatggcggaaggatctgggaggccaggcaatctctgctttcagttcaacaaatatttattgtcttcctcctctgtgggagcagctggaaggtagaagagaaacacagcccgcttttgaaggaaaatgaggaacacagagacctctagaggcgtaggaagagcaccacccagactctcagaggagacccaggactccaagaaggcaaaaagtctgcacctagtccccacagtttactgagccatctgtccaggatccagggacagcagggagcctgcttcaacctctgagggtgccccagtgtctccctcacccagggaatcatctgagcactgagggaagtggccacaggaaggggctgagataagggccttgagaggcaatgggtgtgttggggacggtgatctaggagggcgtggtgagctctgtaatggagggtggggtggaattgggagcgagagcccagtggcatattgggtgggttgactagatgtcgaagaaaggtcagtgaaaagtggccactgtttccagatgatggtttgactttgctttatttggtaaaggggaagaggaaggtataacttcttcaggcgtcagaggtgctctgagagcatttcaggggtttcccagttgagaagctgatgggggtgttactcaatggaccatttccacacagtagagggaattgtaaggggtggtgatctggctgaggggcactgtggtggaatgggaatttaaacagtaggagagaatcaagagaggagctttgaatctaccattttgagaagaggaaggaggaaggggtgataagagagagtctgcaaccttggggtagtggagaaagcagaaccactcttttgggaaggagggaaactgagctaaccctatgcctgggcactggacttctcccatatgggatatagtgtatgtgcttgtttgtgcccaaggcatgcacacacacaacagttgacttcttatggactgttgagtaactctccttggggtaggaaaacttcagggtcagctagctggggccccagaggcttcacttgggctaggatatcccggatggagcggcaggggatctttccagcactgctggagccacagggcttggcaccagcggagggatcaggatggggagagccatcggggcccccagtcagtgtcaaggaggagacagacatgcaagggtgaccagaagagctggacttgctgccacaaggctgaaggatgattttgccactggattgggaactggagctgctgctgaaggagccggtgcctggtggggagcaggggctctgggaagcactgccgcagggatggtagggtaaaccggagctgctggaaatgctagaactgctggggactcgagaactggagggagagcagggtcccttggagcccgtggagccgcctccacagagctggaccccaccagtccccactggctggaatgcaatggccgaggaagctgccgactggctggggatgatggggttgctggagaagtatttgccctcagagatggggggcccagctgcaaaggaagggacccctggagagcctttcacagggttctctttggtgaagtagcccacagggtagattttacccttactgtaggtcatgcctggaaccagataactgtcagaggagccacccaccacctcgtagccaccataggatttgtctacagaggtgattgggggacagggcttgcctggaaggccaccattgctacaggggggaccttgaaccactccaggggcaccagaaccgtgctggtccaccaccaccaccacaggcctctgaccccctgacacagagtgggagctggggatgtaggggccggagtgcgagacgatgggccctccactgcagggagagtcggggatgtccgaactacagggacgctggttggagctgacgctttggccactgctggataccccaaaggtctgggaagaggaagagctttgtccaggctgggaagggtttagtattccgcggtaagagttgtcattggttggcagagcagagccattccctacttggaagctgctgctgctgaactgaaagctgctgctgctgctcgaatgagagctgctgcttcccgagtgagagccgctgtttcccgagtgagagctgctgctccccagctgggaggaaccggatgcaccttgtagactagagccagatccggaggagtagctgacctgggaataccccgttcctggcttaaaagatcctgcagaaccaccctgggcaatgctggatccgctggagctaccactggagccaccaccagagcttctggcactggaaatggagctgccagaactgctggagccactgtagctactgaaaccgctggagtcacccttcccagtgaggcaggggtcgttaggggaggtgatacgcgtggggtccttacaagggtctgagaaggtgccaatgctcttagccaaggtccctgtggaggaaagcagtggttagtaagggccaaggaggcttggcttcctccctcacctttctgccttatctcagtcatcggcctctcgggtttctcccaagcagagcgcagggagagtttagggatggagaaaggaggaagaactggctattgtctctaaaggatattgaggtggccgaataaaggcatttctttgtttgggaagggtgggcaaacaccaaccagaaaaatagaaaattaggtgccaaagtgagtggcctcaaaggaatacattgaatataagagggggctgggcacagtggctcacgccggtaatcccagcactttgggaggccgaggtgggaggattgcatgcgccccagagttcaagaccagcctgggcaacatagaccccgtctgtattttgttttttaattaaaattttttttaaaaagaagagggaatggagaaggggcaggaacaagtaggtctaaaagaaaggaccctgaagagacagagaattggggaaactgaggctctgaggagtccaggcgtaaattcttaggggaaaaatcctgggccagacagtgggaccaaagggaagaagacaaaaggcaaaacaatggagggctgagaagtggagacacatatagaaggagacactggaaaaagacaaagctgggggcagaggggctgaaataaaggaaagggcactcgaggactaagatttggtcaccagcttcttcgtgagagcccaggctggggtcaggaatggaaaccctatttcctatctcagcactggccatgccagtaaagctgggtgggggccaggatgtggggtcactacctgttgcttcagaacctgctggtaccagtgtgtcaggacaccgcaccctgagccagccctgctctcgctggcccagcccagggaaccaggacgaaaccccacgaacctccgaggctcctggccacaatcagcttccctctctgagcacacctgcctctgtccagcccctcatctgacttctgctgccttgacttccctcagggatgtggagccacatctttccttatctttcctttcctttgctcaaaaccccaggcccaacttaccccgtggttcctccatgactctttcacctgcgttccttctgccttccctagcccctccaggtcccacgtgttacaaacagagccacatactagcaagttactgaacctctctgagctttagtttatacattcagaggggccaaattttccctgccttcccacagcattactatgaagaaaactaaatgagatcatccacctggaagttttttcttcttcttcttttttttttttttttttgtgagatggagtttcttgttgcccaggctaaagtgcaataacacggtctcagctcactgtaacctctgcctccttggtgcaagcgattctcctgcctcagcctcccaagtagctgggaccacaggtgcccgccaccacacccagctaattttttgtatttttagtagagagggggtttcaccatcttggccaggctggtcttgaactcctaacctcaggcgattcacctgccttggcctcctgaaatgttgggattacaggcacaagctatcatgtgcggccagatgttttagaaagtgtaaagcattatatattatgaattattactgccactcatcctgatccctccaccaacaaccagactgccatcctctgtgatgtccctgttctctcctcagaaagaaattctctgcatgcacctccacgccgaaccccagctgtgccaattcccttcagtcctctgcacgaatccaccatgcattgcctctctctttcgctattccctcagacaccaaccacccactagaccatgggaaggtcgcagaaattcctcaagggctataagtacccggtggtcaacaacacaggtccaggggttgcccggcctggggttgaaatcttggctttgctgccttctaatgcatgatcttgagctactttcctaacttctctgagcctcagtgtcctcatctgtagagtggaaatagcaaatctcctttcataccgttcttgtaatgatcaaaagtgctaatataggccgggtgtggtggctcatgcctgtaatcccagcaccttgggaggctgaggcgagcggatcacttgagtcaggagttcaagaccagcttgaccaaaatggtgaaaccctgtttctactaaaaatacaaaaaaaagaaaattagccaggtgtggtgatgggcacctgtagtcccagctactctagaggctgaggcatgagagtcgcttgaacctgagaggtggaagttgcagtgagccgagattacgccactgcactccagccttggagacagagtgggactccatctcacaaaaaaaaataaaaataaaagttctaatatataatccaaatgtgcttaaaacagagtctagcatataaaaaggctctaaaaatgatattattactattaaatgtccaatcattatcttgtagtgctcccataataaaaatcaccaccaccatttatataaacctctagaatttccaaagtacatatcacatacattatttaatttgagacacacagactagagttaggtgtcattaaccccacttcagagtttcagaaactggggctcaggaagtttaagaaacttacctgaggcgaccatacagtgaggagcaacccccagactcaaaaggcagattccagagcccctgcctgtccccttcgctgggtcctctcccggagtctccctcccgcctccctcctgttcccagggcccccagcctcctacctggcaggaggagaccagccagcagcagtgccatcatcccgtgcccacccacacgccccatccagggtgcccgagacgagcccatctcggactgcacggcctcctgactgatggcagctcaaggacacccgggtcctttatgccagagctggacattccctgggcaggagtcactgtggggagaggaggagaggtggagggggtgggtgccccaggggaagttggtgtggccgggaggagcgtggtaatcagcccggtgcatctgcctactcagcagcagcagtggctgcagtgtggggtacccatggccacggggctctaacgatcctgccacctgacaggcctggccccggctcctcattgcctaacccggaaccaggcgctctgccccacggccacccactctggggcggccactcttgccacgggacccagctgcctggctccttaactctcctgcctaccgtagcttggcctgtctctccatctgccctccactcgcagtcgtgggtgtttcagctttttcttccacacttgggtgcccgctccagccccacccacccaaccccaatgaggtcccattcacagcccctgatctgctccttccttaggaccccatcactccacctccactttcctccttcaaatatgagttctgcccccatcccccaggctccccctcccaccactccccaagtaccaggccagccacatacctattacgtgttccatcacctggggaactttctccttctcagaaatggggcaccacattcccaaaaccaactccctgacctgtcgcttctgggggcctctggggacggcatggtggcgggggtgggggggtgctgggagccagggctcagccaggggaggggcctgggctgatgacctctgtcaaagctgggccttggttactcacagggcactcacagcccctccccatggctggtaacccagacctcaagggtgagcaagaggctaagaaggctaattgggaaggtggtggccccatagcccatctgctggccctgggctggatgagcgagcaggaagcagcagccagctctgggcaggtcgaggagggccaggcaggctcccgggtcctcaaaggatgaaaggaggccaggagaaccggagccctgccatctgctgagagggtggtggcttctcctccattgcgttggcctccctcctgctctggcccctgccccgccccagccaattaattgctcactagtattgcgggagtatcagtatcggagggaggtgcctgggagtccagcaagctgccctctcctcccccaggcctcagacacccctgctcccctcacccaaactcacttcccaaacctcatctcctcacaaaggcagctctgtccctgggccccttggcctggtctctcccattccctctacctcctgaccgccctttaagttcagaccagcaggaggatggaaatgtttcctgtctgtgctgtccgatacggtagccactggccacatggagcaagtttaaccaccaaagatttggagctttaattttaattaattgtaatgatgtggttggccacgtgcagctagtggctgccatctagtcttgctcttgacttgctagtgacactcagaatgggagtgggaggaaagaggggctgagggagctgtggagagaggaagggataggacagggtcccctgaagggggctaatgccttgggaaaaacaaacaaacaaaaaacactggcttcagaatgaagatgacgtgggttcaagtcccagctaacctcttggctttgggcggctcttcaaacctttctgaacttccatctcctcatctgtgaaatgggggtattttaaataacacttatttcacaaggtttttgtgaacatcaaatgggaaattatcaaaaaggttaaatgggacaaggggtgcagtcccccagtaggaagcccagcaaatggagccctgcaggtgctcctgtcttcatccttccactgggggagacaaataggccagcttcacccccacagccccaggctccctttcctgagtctccagcccagccaatgctagcagagtgtcttctgctcccttcctgccttgtatagaggtgcaggcacaaatgtgagacagagataccatttaaagtgatgctgctcggctgggcacggtggctcacgcttgtaatcccagcactatgggaggccgatgcgggcggatcacttgaggccaggagttcgagatcagcctggccaacatggcgaaaccccgtctctaccaaaaatacaaaaaaaattagccaggcgtggtggtgggcgcctgtaatccctgctactcgggaggctgaggcaggagaatcacttgaaccctggaggcagaggttgcagtgagccaagattgcaccattgcactccagcctgggtgacaaaagggaaactccgtctcaaaaaataaagtgatgctgctctttccgaacatcatttcctcctgtgggcctccctagactctcaggcttggctccctggaggacctgggcaaggagggagggggcactggggtaatgaggggagtggcagagggcagggaggagtggactagaaggtgctgggccgtcccagggtgtgaggggagaaggcagcggaacagtggaatctgtggcttcttcttttccaacacaaacttcccctgaccagccagaggtagcaaagtttgtcttgttttctttgtcacattcctcctggctgccgtcagaacttggccaagacagccaggctggaggaggcacagtctctcctggcctcctgccaggtctccagccgcccacgtggactggcggtgcagccacgtccctcctcctggctactctctcctgtccactcctgtccaccccatcctgccaccctgggctgcccagttcctctactgtcctgcccacctgtgggcccttgagctctaatccgccgtgcttttggttttttactgaaaccctgccttctgtgctagattttactctggtgctcaccattaatctttctctcagtgcaggtggtggagacctaaagctaatggggcttaggagggaagaaaagggcatcagctgagtgcccacacaggccagggtcaccttcagtgaagctgccagtttggtgacgtccacagtagtgcaggcagctctgctgtgttctacagcaacagattctggccctgcccctgcccgtgcccgtgcattggaccgggtgagaaagtgtgggtggcgtagacactctacacccgagaaaatcaagctcaaagcacatgccttccataggcaaaaggtggggctcccagccatgtatcatgaagcaggcaggtcactgtcccctctggtcccctccacccctccagcagccctgtgctgctgtgtttgctgtgccagccttggcccccagtgcacgctcctctgctgtgttttggaagttgcactgagaaagaagagaaattgttccttgccctgaggagctgccatccagctggggacacacagcgtaagacagcagcctagagtggagaagcgggtaggcacttggcttcagggaggtggcaggactttccccgggccttgaggaatgatgagagaagcacagagcaggcagccagacgtggggccttgtggtgcttcaggtgtatttagaaccagcggatggcgtgggttggtgtgggacatgcatgtggaggacagtggtgtgggagaagggacaggctgcttggatcaggattgtagatgacctacaacaccaggttaaaagaatttggattctataggaattgcagtaaatgtgagagggtgcagggaaccaaacggctttgaatgatcacaaagggggctgaagcatggcgtgctatagtcccagctacccaggaggtggaggtgggaggaatccgaggccagctggggcaagttgagggactccataaagaggaggcttggggcacgagatccaccatgtactgactgcctgctgcaggcggacacggtgcctgggtatttaacatgagttgtcttgttcaatcttcacaacagccctacagggtaagtgctttttccccctgtttcacagatgagaaaactaagttgaaattatttgtccaaaccagctgctaacaagcaaaaatgtttgaaaaagattcaaacccaggcctgttggacttccaggcccacatagatcctattactctgcagctgacaccatgctataaatgaatggcagaggttcatggacaggcttaagaggctccctaaaccctgtaaggatgtgtgcaaaattccttatgtatatgaatatttctagagagaagatttctgctgtcaaagctggccaggtatggtggctcacgcctgtaatcccagcactctgggaggccaaggcaggtggatcacttgagctcaggaatttgaaaccagcctggccaacatggcaaaaccatctctactaaaaatacaaaaattagccgggtgcgggggcaggcacctgtaatcccagctactcaggaggctgaggcaggagaatcatttgaaccggcgaggcggaggctgcagtgagccgatttcatgccactgcactccagcctgggtgacagagtgagactccgtctcaaaaaaaaaaagtgaagaattcttaagtgaaggttactggctcatgaggtccctcctccacagctttcctcctctgggggcctgagagtcaggacagaagttctagcacaagtgtttcacataggggtccttggtagaccagggcttaggcttggaagaaggaaaatggagtgagcacgaggaagagaaaaagcctggaaaagcagcttattttgtgctgaggagagaaggaaaggggccacccagagctgctctggggctccagggcctgtgggctcctcccctcctttgttcctctctgcttggctccagcgagaggccgtttcctctcctctctctttctccatgacacccacgcttccctgtggactcacctctgcagccacaacaacaccctcctctccttggcgtggaagccagcgctcctggcccactcccagtaggggatgtcctctgagttgtttttcctgtgcggggaggggtggactgagtcatccacactcttcacctggttcctctggtgaccaagaacatagaaggagagggcacatccccaatcaggtgttccgaacatctctgcgaagactgaccctcctcagcccaggtgctcctatgggactggctacacttcttgactcagttttaatctctccttctctgccttcctgttgggaataccccctcacttctgtggcttctttcctgtagtagacgatcaagggtggaatctacagtccgtgagccctgacttcttgccttcgtctcaaatagactctgcagccagccatctatgcagcgccccagtggctttgaaatgcaacagaaaccatcacccccggaccgtgggctccatgccagtgggcaaagcacaggtgcgttcactgagttcccagcacatagctgtggcaggcacttggtgatattttgaaataaaagaatggaagaatgtgtccaggctgtgcttcccctttctaccttactcagggacatggtgccctcctctctggtttcctgccctgtgcccaccccccaccccctgcaagcacagctcttatgtgcaaagcccctgtaggtgctggagggattcactgatggccttggcggaggtggcagtgggcatgtgcacttggctctgacacagccactcatgcaacaccctgtgcaatctcggcctgggcctgtgtgtcctgccctcattcctcacgggtgactgtctcccctgagccactcttctctctattggattagctccttttatttccccctagggatgcaacacatttttatgaacaaacagcagtgttcacatggctgtgatgaggacgtactggggtttcccctggacatggcattcatctgatgccagtggtgggcaggaccgtgctgtatactttaaaaaaaccctagggggttctgttaggtgcccccactgcagcataacgagttgcccctagctgagaagccctgtcctggggcctgtccacaccatcctcttcctgagattattcctggtgtgggcggtgctcggctctacctttccttccttcttccctgcttggctcctggtccaatggctctctcctctatggaatggcctcctggagcttggctgggtcagcccccactttccactcttcccatgcctgtcctcaccctcccagcagccctgccagcctccgacgggcccagggcactgcagccggcacttgggagtgaagactggggccagagccaggctcacctttggccactgaatcctgaaagaggaggaatttggcaagtggggttctgcccaccaagctttcttccccccgctcccctgagtcttttcccttcacccccacttcccaaaagcagcagggagtcagctgtagggcagtcgctccctggccgaagccttcctggctgtttccgtcacaccctgaggccacccctcttatcttgcgaggagggaggcacacagaggctgtgattagctgtcacagtagcaagactgttcccctctctgtcctgcggagtgagtgtgagggaaaagagctctccttgtctgctcattatgtgcacctgttaaatagtcattctttccactagggctattagtggtttttattgttactggtcacccagaattagagtcacagcttcctcgacagggtgaaagagagcgccagggtgcagtctgaacgtgctctcgggagaggagaggccggaaagacttgtaccaggagggacttctaggctgggctggcccttggagcgcctaggaatgggactgtggtggcccatcttccctcctgtgttctgggctgtctgagtgcctctgggtgagagtcctcacaggagggagcttctcctactgcccagtgtctccctggcacctgaggcatcacccagcacacagaggtgaccaggaaacacagactcctgttagagaggcatctcgtgtcccgctctgttctcttgggccctgggactagaacatcttcaccagagaccggcgccgactccttggcagtgtgtaacattcagctcggtgccgaggtctgcccatgcaggactgatctccattctctcaatgaccctaggagacaggaattattattattattattattattattattttgagatggagtttcgctcgtagcccagcctggccaacatgatgaaaccccatctctactaaaaatacaaaaattagccgggtgtggtggtgaacacttgtaatcccagctacccgggaggctgagacaggagaatcacttgaacccgggaggtagaggttgcagtgagctgagatcgcaccactgcactccagcctgggcgacaagagcgaaactctgtctcaaaaaaacacacatacacacacacgtttgggaccatccctatttcctcgctctgcctaagctgcgtcacaccattcatcactaggtgacatcctactacagataccttgtaagcatctgtgtatctctctcctccctcactggaaggcagctccctgagggcagggccctgatccctttgactggctgtggtatcctctcctgtagaccgctggctcatgaaataatcagggagagaatgtgtaaatgatgatcgtgaggtccacttggacaggcagcctgtgcctgaattttcctgagggcttcagagcctgtctcgcctcgcctcacatgcctggctcaccttagaacggtcaccttgacggctaaagggacacctgtgtgccttgatggtggacccagggagtggatgacattagtgagggaaagagcaaaggctctggaggaaaacacctgagaggagtctctaggctgccctctggtggcagttcttggaacaagacctgagagccgctaccttggctctcagcattgcacgggagtttagaggttattaaagaaatccccctaaagtcccatcccaaggtcacatagagaacgaatggctaagtagcgacaagaacccaagtcacagtctgttgatctcactaccatgctatcctgcctgcccccatcacaggagttgagattatactgcaaaaggaaaggtggggatggggtggggactggggaatttggggagggaattgattactgcctctgaggatattagggggaaaaacccacaggaggtgcatttggcttaattcagcaagttttttgagttttgattcagtgccaggcacctggtgggcacttaattaaagattagcaggagaagaaaaatgtacagtaagagagcttaagtttataccaaagcgagtcttgggtctaataattttgaaacatgaaattggcagagaagttaggagtccctcctgggctcctacgtcagggtttgccccctctctaatttaactttttatcaaattttattgtcatgatgtatatgtttgtcctccctaaacacagagccccttgagggcagggaggactgaaactgcttcctgggactgtcaccatcacatagcaccccacagagcagatgctcaatgaatgttgattgtgtgggcaaatggatgaacaaatgaatggtttggagtttccctggccagagagcttcaaagcagggcagacaaccatctcttctgtctagtccaaagacatcattcgctgcccaaggctcagggctgtgcctggtgctttctcaaggtaacttagcttgtataattagattttaccgtgatactagttctaggttctttttttttcattggccaagcatttaataactatctgtcatgtccaaggttctgggctattgttctgtaaatctgtgatcctattctgttatttaattccgtgactctgtgttgacatagacgtgacggtgtccctggggcatttactcctaggtgagcttagccaaggcaggtagagaggaaccagcattgtctaatctgaatggataagccagcacaatgggtttccctctgcaaatacctccataccatccaggcccactcagtctcctccccagctaatgaagacagcctgtttgagtgccaaaatccactgcctattaataggtactaaaatctccaattgcctcatgcctcccccttctctttcccactcacctacctgccatgtcagcctgggaagaattggtttgcagccaggcagtcctccatccagtcttgactttggcacttgtgatatgacttgcacaggtgagttacctctctcagtgttggttcctcttctgtgaaatggggctaatcatttgctttattgagtgccttctaggctgggtactaggagagaaggaagggatacaaagaaagacaaggcacagttgctgtcttcaagaagctcatactttccaaggaaataaaggcatggaaacccacatagtgctgtggaattaaagaaggcagcatgctgtaaagagccccagctttttccctagacaacatcaggggctcagttcctttccctcctttctctcttctttaagaatttctcttagctggacatggtggcacatgcctgtggtcccagctactcaggacgctgtggtaggaggatcccttgagcccaggaggtcaaggctgcagtgagctgtaactgcacctctgcactgtccagcctgggcgacagagcaagaacctgtctcaaaaaataaaaaattaattaattaattaattttttttcctcctaactaattccacgttattggcttgagggtcagtttgaggggtccagacctccttcttcctttctatccttagcttcctgccacagtatacccagagatgtatgtgtttctccccaccctaggcacaattttttttttttttctgagacagctctgtcatccaagctggagtgcagtggtgcaatcatatctcactccagcttcaacctctcatgctcaggtgatcttcctgctgagtagctgggactacaggcatgcactaccatggcctggctaattgtttgttttttttttttgagatggagtctcactctgtcgtccaggctggagtgcagtggtgcgacctcggctcactgcaacgtccgcctcccgggttcacgccattctcctacctcagcctcccgagtagctgggactacaggcgcccgccaccactcccggctaattttttttgtatttttagtagagacagggtttcaccgtggtctcgatctcctgacctcgcgatccgcccacctcggcctcccaaagtgctgggattacaagcgtgagccactgcgcctggcaacctggccaaatgttaaacattttttttgtagaggtgaggtcacactatgttgcccacactggtatcaaactcctgagctcaagcgatcctcctgccttggcctcccaaagtgctaggattacaggtgtgagccactgtgcctggcccttttttaattttaattttttttttttttagagatggggtcttgctgtgttgcccaggctggctttgacctcctgagctcaagcaatcttccacctcagcctctggaatagctgggattacaggtgcgccctaccatgttcagctaacttattttgtttgttcagagacagggtcttgttatgttgcccaggcccaggcacagttctgatagaggagagagactttcagatatgagctcctgcacttggcaccaagatcttccctaattttcccccgacctgtctctccaacatgtctctctcttcttcgggttattttactccaatcattccgatctactctttgttaattgggcccttcattaaataatttagcctttcacaaaacacacattaagtgtgcatgacggcccaggcactgtattctctgtcagggttacacagatgaataaagagctgggatgggccaggcgcggtggcttatgcttgtaatcccagcactttgggaagccaaggctggtggatcacgaggtcgggagttcaagaccagcctggccaacatggtgaaaccccgtgtctactaaaaaaaaactacaaaaattagccaggtatggtggcgggtgcctgtaatcccagccatgtgggaggctgaggcaggagaattgctttaacccaggaggcggaggttgcagtgagccaagatcgtgccattgcactctagcctgggtgaaaagagcaagactccgtctcaaaaaaaaaaaaaaaaaaaaaaagagctgggatgatgtagtggttaaaatcagtgttgttagcatagcacagacctaaattgaaatcccagttctgccatttgtcccctgtgtgaccttgcatgggtcactgtacctctctaggcctgtttctgtcttctgtgaaatgatcatgatagcattgttatgcaaattaaacgagagcttaagctgtagagcatttaccaacagtgccctatggcacatgcgcagtagaaagtagttgcaatagtgtgtagcaaatactttgcatcctaggttggattccccagaagcaggccctgagacaaagattcaagtaaaagagatttatttaaaactaatgagaagttgggcagggtggctcacgcctataatcccaacactttgagaggcggaggcaggagggtttcttgagctcaggagtttgagaccaggttgggcaatatagtaagacccaatctctacaaaaaaaattagccagacgtggtggcatgcgcctgtgatccagctacttgggaggcttaggtgggaggatcgcttgggtccaggcttcagtgagctgtgatcgtgccactgtactccagcctgggcaacagagtgagaactgtctcaaaaataaataggccaggcacagtggctcatgcctgtaatctcgacactttgggaggccaaggcgggcagatcacctgaggtcaggagtttgagaccagcctggccaacatggtgaaaccctgtttctactaaaaatacaaaaattagctgggcatagtggcgcatgcctgtaatcccagctactcaggaagcagaggcaggagaatcgcttgaactcaggaggcggagattgcagtgggctgagatcacaccactgcattccagtctgggcaacgagagggagactccgtctcaaaaattgaataaataaataaataaataaataaaagtaatgaggggactgggcatgatggctcacacctgtaatcccagtgctttgggaggccaaggcaggaagattgcttgagtccaggagttccagaccagcctgggcaacatggcaagacatcatttctgcaagaaattaaaaaattagcccagtgagtggagtgcatctatagtaccagctactcagaaggctgaggcaggaggaccacttgagcccaggaggttgagactgcaatgagttatgattgtgccactgcactttagcctgggtgacagagtgagaccctgtcttaaaaaaaaaaaaaagtaatgagggtggggaggagtggaaagggagtgggaaagtgggacccaagcacatgagtggaaccaagctaagtctcatggagggctggggtactgacaccttcatatttgtccaccgttggttaaggtctgggggcgggctgggggagtgggagggtggtggcatgtgaggatgtgggagagaaaaatttccaagtgcttccagctctctgcccctggaaaaggtcccggcagaggcataggcggggctgttgggagtgatttagcactctgggagtccgtaggcacaaaaatggtaaaggggttcaagaagaaatgcgtagaacacagtccctgccccacaaggttcatggcctgggaagggaagacagacatgaataaatcattgccatagggtgactggggtgaagggcgttgggggtcgggtggggtgcgggaaggagtggtgtaggcagaggcatccctgaggagaaatgcagctggtttgggagaggacggccattccagacatagggaacagcacacacgaaggctgatgcacatacgcgcaagggctggtccctagagctggtggttctggccacgagagctcatcacctgggggcagcttttgtacctgcaccctgtatgaggctccgggtctgcccttcctggtccatcctccagacacactgcctgttcttctctcaggtcccgctccgggccctcctcccagaagcctcccctgactagtccagctcaccgtgactcttctgaactcacggcgtttactgccaaggctattacgttggcgctcgctcatgtcattattaggaaatatgcatttttactgtctttgatgttatttaaacttgcctgtaaattctgtctctctcaattttaagttctgagtagaaactacatatttttattatttatattcttatattctcccatggcacccggcattcgtggacacattgaggaagtaagataatgaatgaatgaatgggtgaatccagtccagcttggggcctatttaattctactaggctcaacctacaattcttatgtgttctcagattattcctaaaccctaagcttagttttgtttcattcggaccacatgtagtttttttttgttttttgttttctgagatggggtcttgctctgtcgcccaggctgcagtgcagtggcacgatcttggctcaccgcaacctctgcctcccaggttcaatggattctcctgcctcagcctcctgagaagctgggattacaggcgcccgccaccatgcccagctaatttttttgtatttttagtagagacagggattcaccatgttggtgaggctggtctcgaactcctgacctcaggtaatccacccgcctcagcctcccaaagtgctaggattacaggtgtgagccaccacgcctgatctcatgtgtagttttttggttttttatttgtttgtttttttgagatggagtctcgctctgtcgcccaggctggagtgcagtggcacgatctcggctcactgcaagctccacctcccaggttcacgccattctcctgtctcagcctcccgagtagctgggactacaggcgccggccaccatgcccggctaattttttttgtattttttagtagagactgggtttcaccatgttagccaggatggtctcgatctcctgacctcgtgattcgcccgccttggcctcccgaagtgctgggattacaggcgtgagccaccgcgcctggcctctcatatgtagtttttaatgagagttaccacataagcaaactgggttctaagtggtgaaatttaaggttatgcaacctcagtttcttttaacccctcttcatccctaaccctggtcggatacttgattgacagtagaccattgggatctctgagctcctgtccttctaacctgattgcctctttaaaggattttgaaaaactatgtcccttgcacatttgtattgttttgagacacggtctcactctgttgcccagactggagtgcagtggtgccatcttggctcactatagcctcaacctcccagggtcaagcaatcttcccacctcagcctcctgagtagctgggactacaggtgcgggccaccacatctggctaatttcttaaattttctgtagaaacagttttgccatgttgcctaggctggtctcaaactcctggccacaagcaatccacccgattcggcctcccgaagtgctggtattacaggcatgagccaccttgcccagccccttgcacatttttaagtcaacatttaacatttgtaataatttaatagcattccaaagggtatgcttttcaaggaattgcaaatacatgttaaaaatcacatcactatttatgtatttatttatttatttattatttttgagatggagtctcactctgtctcccaggctggagtgcagtggtgcgatctcggctcactgcaacctctgcctcccaggttcaagcaattctcatgccctagcttcccgagtagctgggatgcccagctaagttttttgtatttttagtagagacagagtttcaccattgtccaggctggtcttgaattgctgacctcaagtgatctgcctacctcagcctcccaaatgctgggattacaggcgtgagccaccatgcctggccatgtcagtttttaaaattaaaaacaatttgttgtgctcagtctgtcggagactgcacgtcactctaagtgtagcaaattgaatataatgccatagaactttcatatctgttagcatccttttaaaaaatacgtgaacaagcccttgaacaagtgttagaaacagttattctatttgtattgcaattattgcagttaaccaaaactaggaatattcacaaggattaaacataaaaagttggtcaggcgcggtggctcgtgcctgtaatctcagcactttgggaggccaagatgggccgatcacttgagctccggagtttgagacaagcccgggcaacacggtaaaaccccatctctaaaaacaaaacaaaactaaactaaacaaatacaaaaaattagtcaggggtggtgcacctgtagtctcagctacgccagaggctgagataggaggattgcttgagcccaggaggttgaagctatacgagccatgatcgtgccactgcactccagcctggatgacagatggagaccctgtctcaaacaaacacacaaaaagacatgaaaagtaacttattgaaaatgcatctcttggccaggcgtggtggtttacacctgtaatcctagcactttgggaggccagggcaagcagatcccatgagatcaggaattcgagaccagcctggccaacatggcaaaatcccatctctactaaaaatagaaaacttatctgggtgtggtggcacacacctgtaatcccagctactcgggaggttgaggcaggagaatcacttgaatccaggaggcgaaggttgcagtgagctgatatctgtcgtgccactgcactccagcctgggcgacagagagataatacgtctcaaaaaaaaaaaaaaagaaaagaaagaaaatgaatctcttaatgagatgggaaaggttgatttgtttcctattgacctttggcggctctgggaagggcactctggtcaggcccaggacaagcaggagattcattctagcggggggcacatattaatctggaaactgattcccttaaaactggtcctgccgacacacccctgggaaggtttgcatataccactaggggtatccaagccataggccattaaacagagatgaaacttgccttcccattctttaatatagtgttctcagaaagggagaaatgtgggcctgaatgttattgtgacttgcatagtgacatttccaaccctcctcctgctaagccccagagccttacatgctggacatgggcaagataggaactcaagttacttccaggtctccgtaagtttaggactgtgaagagggcatcctaatagtcaaaaacataagtgttggccgggcacggtggctcacgcctgtaatcccagccctttgggaggccgaggtgggcagatcacgatgtcaggagttcgagaccagcctggccaacatggtgaaaccccatctctactaaaatacaaaaattagccgggcatggtggtgcgcacctgtaatcccagctactcagaaggctgaggcaggagaatggcttgaacccgggaggcggaggttgcagtgagccgagatcgtgccattgcactccagcctgggcatagagtgagactccgtctaaaaaaaaaagaaagaaaaagaagaaagaggccgggcgctgtggctcacgcgtgtaatcccagcactttgggaggcccaggcgggcagatcacgaggtcaggagatcgagaccactctggctaacacggtgaaaccccgcctctactaaaaaatacaaaaaattagcctggcgtggtggcgggcgcctgtagtcccagctactcgggaggctgaggcagaatagcgtgaacccgggaggcggagcttgcagtgagccgagatcgtgccactgtactccagcctgggcgacagagcgagacttcgtctcaaaaaaagaaaaaaacaaataaataaaaataaataaaaaagaccctaagtgttagttaaagcagcagcctagattcagaattaagaaaacatgatttttatttttccgtttcatggaagcagcagctgtctactgatagttcctgccgccggccaccaggtggcagaagggaacacagtaccatagccctgccccagcgatcgcgcgggcaggaagaccgggtgggaggtaggtgcggccgaggcctggaggcgaggtaggagagtaggcttaggctgtcagaggaaaaaacgggcgatgtgaggactaagtatggatctcaggaggggacaggaaatattgagaacaccaccttacgggttcagaataaaaccgagggaatgaggaagaggtttaaggagacaggctaaattgggaagaattcacggggaatcagagggtggagagggcgtgggtgcctggagatgcctgggaacagaacggctgaggggactccattatctgtactcttcccggggtgggtctaggtctggctcctcctgaggtcggttgtccacctcaggggcaggaggccaggggttttctgggggctggggtcctgccggccaagggtcgtcaggccggggaggttgaggaggatccgttctaggcggttcagggagccagactccagtttcaggcaggtctctccagggacgactggggcgggtaggcggaggatcttcaaagagagggggtgcccctggccaagggtcaccggggactggggggccctgaggcaatgttggggagcctgcctcctctcggtcctctgcgggtgggtgagaggggtggccctcgctgcctgagatgcctgtaaaggaggaaggagaaaggtaagaggtggtgagggcttctctccccagccccacccagccccagccccaggaggaggagcctgtctggatggacgcagcctgaactgacccacaaacagaccaaaaaagtcactctcaaagagctctcggtaggtttgtaaatacttaactgatggtaaaatgtcatgaacccctacccccgatggatctgaaccgttcacttgacccactttaaactgaccagacttctccaaataagctccatccacccctggttggggtaccccactagctttgtcctcaggccaacctgcaacccaaagtgggttacaccttggcccccaggcacacagaccccagctttacaaggaccccagctccttaacacagatcccagctccgaggaaactcgtcccccccacgttaatcctgaccgactttgccacatggagccagcaaaccatttctggtgagagccaaatgcaccttctgcaccatgtcccccacccaatgtgtccagaaagccatttctggtgagccagatgcaccttctgcgtcccctgaattcctgtccccaaccccatgcgtccagttcacctccgccatcttgagtatccctcatcaccccaaactgcagtccctgcctctgttcccacctcacctctggtgtgcaggcaaaggaccaggatccccaggagcttccagttgaggatcatggctatgtactggcccccaaagctggggtgggctgagtctgggtgcctgggaaccccaagaggctttataggggaggagtggaggagggaccagcccagtggcacaggaataccatcagaacagaactggtcaaacccgttgggaaggcctgggctgatgtgtcacccctgaaggtggcgtcccttattttagtcctccagcccaggacccagctgcctgctctccctatcatgacccagagcctgcgtcaccccaccctggttttcacaccctccatccacatcctggagcagtcaatacccacttggcatctccgtaatcacagagatgtccaccttcatcccttgcaactattggaagccaaagaatgggagcaaaccacgcgatgggcgttgggaagcaccgtaattacagggttgggaggcaggatgcctgcgctgagggaggaggtgcttttcaaacctgggatgcagctgggacagtgtcagctactaccccagcctccccactcacccccgcactgaaagctccccctggggcttcgtgctttcctgggcacttcccttcccccatgggatccaggcatcctgctctccaccatgtccttcttcaggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctcccaggttgttccctgcctggtccgctaccccacagtaaggaacaccttattatgcaatggcgtgatctcatctgttccctccagggctcacccagaaaccttcgttacactcctccaccatccacctgcaagcccctccacaccctgtccaaacccagcccatcatcctgagccaccatctcccctgagcctccccaacacccttctaattggcccccttgctcccactgtttatccctccccctcacacaaagcctgtcctccaccagcaaaagaggtcttaaaatatacatcacgcgggcctggtgtggtggctcgcgcctgtaatcccagcactttgggaggccgaagcgggcggatcacctgaggtcgggagttcaagaccagcctgaccaacatggagaaaccccgtctctactaaaaatacaaaaatattagccggacatggtggcacatgcctgtaatcccagctactcaagaggctgaggcaggagaatcgcttgaacccaggaggcagaggttgtggtgagctgagatcacaccattgcactccagcctgggcaacgagtgaaattccgtctcaaaaaaaaaaaacatatatatatatatatatatatcaggccaggcgtagtggctcatgccagcactttgggaagctgacacaggaggaccgcttgagctcaggagttgtgtgcgctgcttcacctgcagcaagactgtgggcaacacgtgggaggcctacctggggctgctgcagtccaagtacgctgatggggacgccctgggcctgaagcgccacagccgctgcctgccgcatgctgctggcccacgtggacctgatgcggaaactgctcaattatgccctcctggggaagtgacctggttagacccacccatctgctgcgctgggtgccgggagcaatcgctgaccacagtgcgtggatatgtgtacctcactctggaagggaccatccagtaagtccctcaggaaaaaaaatgtacaccaaatcatgttgcgtcttccctttgtttggggagtgaggacaggttctcgctctcttaggctggggtgcagtggtgcgatcacagctcattgcagcctcaacctcttgggctcaaacaatcctcccaactcagcctctggagtaactaggaccatgggtgcacgccaccatgccctccaatgttttttatttttattttttatatagatggagtctccctatgttggctggtctcaaactcctgggctcaagcgatccgctcacctcggcctcccaaaaaagtgctgggattcagctactccggaggctgaggcaggagaattgcttgaacctgggaggtggaggttgcagtgagctgagattgtgccactgcactccagcctggcaacaagagcaaaactgtctcaaaaaaaaaaagtgctgggattacaggcaggagccacaacaccgggcccccttccctgtttttttttttttttttttaattcttcttctttttttgaggctgagtctcgctctgtcacccaggctggagtgcagtggcatgatcacggctcactgcaacctccacctcccgtgtccaagcaattctcctgtgtcagcctcctgagtagctgggactacaggctcacaccaccacacctggctaattttttgtattttagtagagacgaagtttcaccatgttgcccaggctggtctcaaactcctgagctcaggtgatccgcgtgcctcagcctcccaaagtgtcaggattacaggcgtgagccaccacacctggctttcttccccgtttttaaagaagtactccaatggctttctattgacttacagtaaaatccaaacttggccacatctcggcctcgcagcagcatccttgagcattctctacagagacctcctggcctccacaggagcccacttcaggcaggcctctgcacaaggtcccctgctcagaggcctctccccagagtcagtttctatcatatcatcgtactgtactttctcttcaagcacttatttgaaacgatctcgttcatctgtttaggtcccatctgctcgctcgctctcccactaggatgtaggctctcagggtccaagtggcccccaggctaatacagtgcctagctctgacattcctgttgaacgagtgaatgtttcatcttccccactcctagcatttatcatcttccagaagaaaagagttttaaaacaaaagttgagaataaagaaaagcaggagcttcccaaacatttccaaagctgcctagaaaaaggatttgaaaaggtgccacccatagagagagctatgggtgggaccacttctcacaatctccaagagagatggctgcagggagaattcccacagattcccagaaataacatttccaaacaatggctccttctgtagtcgtctttatttagagcagaattcagactcagctggtatcccccagggcaaccccaggatggggaagggctggtctgtccccacccacttctccaggatcctcccagcccccaggctggctttccctccaactgtcagctgcttagctgctcatctggggattggagctggagcatctgtcaaggttgtctccttgacaaacagcttcctctttggaaatggcttcactcaggtcctgcaggtcatcgagcaggacagagagggaccctgggaaggaagacagcagatgagcaccagacaagggaaggtgctcgtggttacagaggaaacagggctggcacaggaaatgaggaatgggagagaggaggctctttggtccaagctgggcatcgctaaaagaggctaagggcctcgaaggaccgcagagaacaacactcatcatgcgagagtctgaagaggagattcctgaagtgcgcgcatttgtcccttgtccctttgtgcttggcccaagaccttttatggactccctggtgggcactgctgctgctacaggtgcagatgctgaacactctggaggcctggggctggacaccacagatttcttcttatccagtagggaaggaagaactgtcaacagtcgctgctgcttgtaacgggagaggagaccttcctgctgcaaggtggcctgggaaggagagggttaaacctagcccggatagagcctccctcaccatcctctttccacacctctagcccaggaaccagcccaggatgggccctagtgtctgcctgtctgccctcctgtctcctaccagcatgaggttcttatccctctctagctcctgcaagcgccgggccagtcgctgcccctcctccttccgggcctcctcctgcagacgcctgagttcctggctccgctccttttcctgggcggctctgcgctgaatctggcgtaaggagaccactacagagaggccaaggcacagaggaggcaggtgtgagtcaggccagaggcagccaggcaccatgaagacaggaacaaacgctgggtcaccaactctgtggcttggggaggctgttctgctctgtggatctgtctcttctgtacagttggaggggtgggctgatgctctaggagcctgggaatctgaacctaagtatcttcctcatccctgaaccatcctggagttcctcaggggaaatctgaacatgaactgggttagattttgtgcaattagtgttcactgtcttaaagtgtgatgattgcagctatataggagaatttactggctttgggagatgcggctgaacaacttatgtttacaacttacttaggcgtggtggctcacgcctataatcccagcactttgggatgccaaggcgggcggatcacgaggttaggagctcgagaccatcctggccaacatggtgtaatcccgtctctactgcaaatacaaaaactagctgggcatggtggtgggcgcctgtaatcccagctacttgggaggctgagccaggagaatggcttgaacccgggaggcagaggtcacagtgagccaagatcatgccactgcactccagctggtgacagaggaagactctgtctcaaacaacaacaacaacaaaacattaaatgattacaacttaaagtgattcaaaagatgtacaaatatgtgtgtatatagataagagaccaaatgtggcaaatgttaactgctatatttagttagagaagatacattcattacacaattctttttttgacacatggtctttctctatcacccaggcttgagtgcagtggcacaatcttggctcactgcagcctcgacctcccgggttcatgtagtcttcccacatcagcctcacaagtaagcttggggtacaggtgcccaccaccaggcctagctaatttttgtatttttagtcgagacagggtttcgccatgttgtccaggctggcctcaaactcctgacctcaggtgatacacccacctcggcctcccaaagtgcttggattacaggcataagccaccgcgaccggccatatgctgtttcttaatctggtgctggctacatgggtgtgttcacgatgtgataattcatctgtgctactcctggataccttcattacttcctgtaatgaagctttgaacacactttgaggggaaaataataaccttatgtcttaacacttccttcttcctggaaggccctatccaccctggcaaggctcaccggccttggcatgctccctccgagcctcgttcagcctcctctctgtgtctgagagttgctcccgcagccgagtttccacttcagccaccttttcttgcagggctggggtgaaagtgcagacggggcatatcagcaggagctttgattcgcagttcccaccccaccctccaagggaagcacccatttccctctcgacaccttgcccgtagagttcctgctgctgggtcagctcctgccgcagactggcagcctcctctgtgctctcctgctggccctggcgtgctacctccagctgcagccccaagctagccagggactcctgggtctgctgcagctcctgctccagctgctgggccaccttgctcagctgctgccgctctgcctcccctaaaaggagggggtgctgggtcaggcctctcccagcaccctagacaccgggtttttcctcatcctctccaccccctggcaaccaggtgtaccttgctcccgagcccggcccacctcctgctggatgaggcgggcactcagctgcagttctgcatccaggcggttccgttcttcccgcaactgctgcaactcaaggctcacgtctgtgaccggtggtggtaggggacagctgggacggggaagagaaagagtcagaagaaatcacccagctgcctgatcccaaagcccccatcccacctcagtcctcatggttttgggggtcccagcagccaatgccctaaagccccatccacctcaaagtgcccaaacttcacctctcctggcgcagctgagcaagggcaagctttcgagcaatcaggcctggaggggaaaaagcagggagaaaaagagatgaagtttgcatgggagaaagtggggacagggagtaagggaaaaagagatgcaaggactggtgaaaggaggaaggtgaatggatgtgggatcagagagagctgggtcaggaagaagaaagtccgagctggtggggtgggggcaggacgtggctcgcagttgtcctacgcaccccgaatggtgtggaccttgcggacagcatagctgagtcggttgttgaggctgggaagctgggcggcagccccttccaccttagccatggtggtctcgagccagatctgagagctggagagggcacaagtcactgatcctccatgcctcccctcattcccaaaggacttgctgtgccttgtatagacaactccctctaatcctgtcccattatacaagtacagaacgcacagcttccgtcaattatctaaaggacccttgccccaagaatgcattaaatgactatctttttaagcaacctgttaagcttatttctcacaactgtgttttgctcactatcgtgtatcaaagagtaaagttatcctctctgatcaggggcagtggctcctgcctgtaatcccagcactttgggaggccgaggcgggcggatcacctgaagtcaggaattggagactagcctggccaacatggtgaaactctctctacttaaaaacacaaaaattagccgggcatggtggctcatgcctgtaatcccagctactccagaagctgaggcacgagaatcacttgaacctaggaggtggaggttccagtgagccaagatcgcacccctgccctcaagactgggtgacagagcgagactccatctcaaaaaaacaaaagaaaacaaagttatcctctccaagcccaggagtgtcgatctagcaccaatgacgggcaggtccacatgctttaccagctggctgtgccagaagtaggaccaacctggctcatgaaaactgagcagcttaaacaggccccaggaggaggccaaggagtgtctggggccgggctggggtttcctcaggagagtccaggtctgcacccacagaaaaacacatgatgatgaaggcttgcagctgcatccccagcagcacagcaaagttcactttgatctggaaattgttccagtagatgcttccaacacctaccacagcccttattaaagtctccaattacctagagacaatctaataaacccagcaacaatcagagtttggactgctttaagcctggaggactttcggcaaatgcatcattacacagaccatttctgtgatcgcctggtaccaaagtcaaaccctgtccacagtgcatctttctgttctcctggaggtagggggcacccgcgatggattgaacctgggtggtaggtcattataactagtttaattccgtgcaagtttgaaatttttcataatttttaaagctaaattagtccctaaggtacaaatccaagagaaggaagtgatgggcaaggactcatcctgcatcttaatttcgctaaaccaaaaattatctttatctaaattaacccatcaagaagagcctcacgataacaataaacatttacaagccagagactgtgctaagaactacctgccggccaggcacggtggctcaagcctgtaatcccagcactttgggaggccgaggcgggcggatcacgaggtcagaagtttgagaccagcctggccaacacagtgaaaccctgtctctactaaaaatacaaaaaagtagccgggtgtggtggtgtgcacctgtaatcccagctactcaggaggctgaggcaggaaaatcgtgtgaacccgggaggcagaggttgcagtgagctgagatcgtgccattgcactccagcctgggtgacagtgcgagactctgtctcaaaaaaaaaaaaaaaaaaaaaaagaactacctgccttgggtacctcagtgtctaaggctgaggggaagtcatcaccagcacaaagaagctttgctgttttcttagaggtttttctgaaggtcatacaacaattgtaggtaatgaaacaactaggaagttggtaggagagacaaaggctggcaattgatttagaaggaaactaactggcttacattttagatggaatagtaagcaagttaagtatataataagcaagtaagtatatagctttaaataaatagactaggccaggtgcagtggctcacacctataattccagcactttgggaggctgaggtgggtggatcacctgaggtcaggagttcaagaccagcctggccaacatggtgaaaccccgtccctactaaaaatgcaaaaattagccgggtgtagtggaggacactggtggaggatgcctgtaatccagctactcgggaggctgaggcaggagaatcacttgaaccagggaggtgaggttgcagtgagccaagattgcgccattgcactccagcctgggtgacagagcgagactttgtctcaaaataaataaataaatagactaaatttttctccagtgaaacggattgcccgtaaaattttagaaaaaaaaaggaagatgaagtgtctacactctccatccttgaacaatactgcaagtaaagatcctcccgggtgctctatttagctcaagccattactagactgaactgcaggaggaagcaaggcctcacctccagccaaacatgcaacgggaaattcataacaagcaatcaggtatgaatgcagaaggggcttccccaggaaaagaaacgaacacaggaacattgatagagctaaatctgcccagccctgtagcctccagtggccactttccagcccctcttgcctgaggatcctcagcaacaaggtgcccaggaacctgaggtggcagaaacactactccacccacccctccatccctgatacctgctgacagcattgaccacaagcctcagctgctcctcggctgaggctgtctgctgctgccaccgacgcctggcctcctgagcacggctcagctccaactgcaggccctggggaggatgcagcaaaggacagggtccctccctaagtcctggctgcagccccggaacaggggctcccttgccctccccgagtctctagtaggctgacaccaaccttggcacccatacgctccacctccacctctgcggctttgtcctgcagggatcgctgcaggatggcctgctcctggctctgggatgtcactttttcctggagtgaggccacctgggggaggagagagagctaggcagggccctctagagctaaaagatgaggggggcactggaagcaaagtggcaggtgcagagatctctgtaagaatgccatgcaggggctggggggagggggggcgggcgacgggggtgggttgcagcacggtggctcacacctgtaatcccagcactttgggaggccgaggcagatggatcacttgaggtcaggggttcaagatcagcctgaccaacatggtgaaagcctgtctctactaaaaatacaaaaattagctgagcgtgatggcatgtgcctgtaatcccagctactcgggaggctgaggcaggagaatcacttgaacctgggaggcggaggttgcagtgagctgagatcaggccactgcactccagcctggtgacaagaacaagactccttctcaaaaaaaaaaaaaaaaaaaaaagaaaagaaaaagaatgaatgccacgcagggagacagaagcttaggttctgaggatggaatctgagcccagtgttccatgttccacattccatgtgcccactcaaagatgggaatagcccttgacccaccccacaagacccaccaactgaccatgccactctcctcagatgctgtcacctcctcagagaggctgtctctgagcatcctacctgaggctgactcaccccacagtctctccgtcacattatcttttgaatttttcttactactttctttttttttgagaaaagatctcgctttgtcacccaggctagagtgcagtgatgggatcacagttcactgtggcctcgcctcgacctcccagcctcaggtgatcctcccacctcatcctccagagtagctgggactacaggaatgagccactatgaccggctaattttttgtatttttagtagagacgggatttcacatgttgcccaggctggtctcgaactcctgacctccagtgatccacctgcctcggtctcccaaactgttggcattacttgactgggcacggtggctcacacctgtaatcccatcactttgggaggctgaggcaggtgaatcacctgaggtcaggagttcaagaccaaagtgatcgcattataggtgtgagccactgcacctggcttcaatctttctatcgcacatataattacccaacattatctgtttacttgcgtgttctgtgtctctgttctagaatgcaagctccacattttagttttgttcagggctgtgtgcccagcatgtggcaaccactcaataaacactggttgaatggatgccaccttcatggaaggagcaaggtgctgggagggaataccgggagaaaagagagtgca

SEQ ID NO: 545 - DNA, 77898 bp, Homo sapiens
ataataggccaggtacagtgcctcatgcctgtaatcccagcactttgggagactgaggcaggaagactgctagagtccaggaattcaagaccagcctgagcaacacagcaggaccccatttttacaaaaaaaaaaaaaaaaaaaaagttagctgggcttggcggtgcatgcctgtagtcctagctgcaggagtgagctaggcttagctacaggctgaggtgggaggatcgcttgagcccaggagttcgaggttacagtgagctataatcacttcactacactccagcctgggcaaccccgtctcagaaaaaaaaaaaagttattaattctagagtctatctcacagagttattttaagaattaaatgagacaatgactataaggccctcatcacaatatgtgacacacaataagtctcttatcatcttgattatcaagagaaacacataagaaagatctctgaaagaggaaagaaaacgtatttgccaaatgtctaatagggaccatatatgttattttattttaatcctcaaaccaatgaagtacggagaaagaaacagcctgaaacaagatatgtaatttatattaggtcacaaagctagtacacaacagccaagattcaaacttctcacctatctgactccaaaacaaattcttctaacatactgcaccctacactctcttcctttccgcctccactatcagacatctccctgcaacactcccattagatgatcaactaagattatctggttacaattaatggacctgaggtagcttggaataaagggagtattacttcaacaaatatcttacttagtgccatttcaaaagttttcgtgcccttaaaggtgtttttgcctctctcagggtgagcagggaaaaatattagtccctacagttgttgttctgataaataagattgtttatttcaattcccttataatcccaataattctccattgctaacatcaaaaagaagtgtttctggacttaaaatccctgctttttgacatgagagaaaatttccattaaacatctggctcaggaacacttacactcggtgatagcagttaggcaactggtcaagagtaaaaaaaaaaaaaaaaatgagataagaaagatgactcacaagagcatacatatgagcaatccggtcatgtaatgacattggagaagacagcctatgggggctgtccttcctttctttcctttttaacaacatattaaaatcatgaatttactaagaataattaaaaagaagcattacttcttttcatggatttttaaggaagtatgtttgtcctatttttttttttgaaacggagtctgactctgtcgaccaggctggaatgcaagtggcgcaatctcagctcagtgcaacctccgccttccaggttcaagtgattctcctgcctcagcctcccaagtagcccagctaattttttgtatttttcgtagagacagggtttcaccatgttgactaggctggtgtcaaactcccgacctcgtgatttgcccaccttggtctgggaatacaggcatgagccaccgcgcccggcctgtcctatgtttttatgagcaataagagggagagaaaaaaattaagatttcaaaacacataggtaacctccagtttagttacactcaagcttattccctataagaaataaaaacagcatttaaatatctctgttaaataatcaaccccagtgtgcatagcagaaagagaggtcaactgggccatgagggaaaaaaattgagttctgtattcagctctatcaccaactaaaaaattttaagcatttcacttcatctctctgaaaatcacttctttctgttttaaagatgaacaagtttaccctagcatttacagattaaatttttgtttcaactgtttatgaacaactccaaatgtctgagattgtaataatttgtaattagtctccacatgaattcagattaaatactgttgaactgctgtgcaggaaggaacatgtctcttaagtgaactcaagggtggcaaacttctctaaagagccgaacagcaggctttgcaggtcttatggtctctgtctcaattactgtattctgctactgtagtgcaaaaactaccatagacaatatatatgaatgaacagagctatattccaataaagctttatttctggacacagtttaaatttcgtatgatttccatgcgctacaaggtcgttccaactattttaaattgtaaaaaccattgttaggccaggcacagtggctcatgcctgtaatcccagcacttgtgggaggcacatcacctgaggtcaggagtttgagaccagtctggccaacatggtgaaaccccatctctactaaaaatacaaaattagctgggtgtggtggtgggcgcctgtaatcccagctactcaggaggctgaggcataagattcccatgaacccaggaggtggaggttgcactgagctgagatcacaccactgcactccagcctggcacagagcgagactctgtctcaaaaaaaaaaaaaaaatcattgttacattacaggttgtactgatttttgaaaaaagtgcaaaagcaattcaatggaagattaatcttttcaacaaaaggtgctagagcaactggatatccttaggcaagaagaaaaaaaatggcgacctaaacctcacacctgtacaaaattaactcaaatggatgacagattaaaatacaaaagttaaaattataaaacttttagaagaaaacaaaggagaaaatctttgggatctaggacttggtatgttagatatgatgccaaaaacatgatccattaaagaaaaaaaaaaacttagtaaattggatatcaacaaaatttaaaatttttgctctgtgaagtatcccactgagaaggtagaaaggaccaggcacagtggctcctgtctgtaatcccaacactttggtaggccaaggcgggaggatcacttaagcccaggagtttgagaccagcctggacaacacagagagaccctgcctctatcaaaaaaaaaaaaaaaaaaaaaaacattagccaggtgtggtggtgcacacgtgtggtctcagctactcaggaggttgaggtgggaggatcacttgagccccagaggttgaggctagagtgagccatgatcacatcactgtgctgcagcctgggtaactgagtgagaccctccccaaaaaaacaaaaacaaacaggctgggcgtggtggctcatgcctgtaatcccagcactttgggagaccaaggcgggcggatcacctgaggtcaggagttcaagaccagcctgaccaatatggcgaaaccccgtctctactgaaaaacacaaaaattagccgggcatggtggcagatgcctgtaatcacagctactcgggaggctgacataggagaatcgcctgaacccaagaggtggaggttgcagtgagccaggatcgtgctactacactccagcctgggtgacaaagtgagaatccatctcaaaaaaaaaaaaaaacaaccaaaataaaaacaagcaaacaaacaaaaaggatggaaagacaagcaacagattgggagaaaatatgtgcaaaccatacaaagaagctgcacctgtgatctacaaaaaattatcaaaacccagtaataaaaaatatacaattcaagggccgggcgcagtggctcacgcctgaaatcccagcactttgggaggctgaggcgggtggatcacctgaggtcaggagttcgagaacagcctggccaacacagtgaaaccccgtctctactaaaaatataaaaaagtagctgggtgtggtggcaggcacctgtaatcccagcgattcgggaggctgaggcaggagaatcgcttgaacccgggaggcagaggttgcagtgagccgagattgcaccattgctctccagcctgggcaacaagagtgaaattctgtctcaaaaaaaaaaattatatatatatatatatgtatatgtatacacacacacacacacacacacacacaaaattcaattagaaaataggcaaaaggtataaagagacattttactgaccaggatatatagacagcaaatgatgatatgaaaagatgtgtattatcactagccatttgggaaatgcaaattaagatcatgatgatgtatcaccacacgtctattaaaattgctaaaataaaaatagtgacaataccagatactggcaagaatgtggagaaaatggatttctcttacaccgctgacaggaatgtaaaatggtaccgacactccagaaaatactttggcagtatcttaaaaaacaaacaaacaaaataaatatatatagtcatccttggtatccatggaggattggttccagagcctcccagggcaacaaaatccaagatgatcaagtccttcatataaaatggcataataattgcttataacctatgcacatcctcccctatattttaaatcatctccagattatttatacctaatacaatgtacatgctatataaataattgttatactgtattgtttagggaacagtgacaagaaaaaaaaagtctgcacaagtccagtacagacaatgtttttttgaaaatattttcaatcccaggttggctgaatccattgatgtggaacccatggatacagagggctaattgtatttaccatacgaccaaagaaatgaaaagttacatgcacacaaaaacctgaacaccaattttcatagaagctctatctataatagccaaaaactagaaataatcaaaatgtcctttcttatacgggaatgattcaataggtgaaccatggtacatccataccatggaacactattcggcaatgaaaaagagggatggatctcagggacatcacactgagtgaaaaagggcaatctccaaagatcacatactgtatgattcaacttatataatagtctcaaaatgacaaaacaggttagtggctgccagaggacagggacagtagagagacagagggagtgcctaaggctgtaaagggtttgtggtggtggaacagttctgtatcttgattgtagtggtggttacactaatctacatatgataaaatagcatataactacatatacattgtaccaatgtcaatttcctggtgttgatattatacaatagttatgtaagatgtagccactgagggaaactggtaaaaggtaaggacttgactatgtttgcaatttcctgtgaatcattaattatctaaaaaaaaaaaacagttaaaatagtttccaaaaatctgaggataagcgaaggaaggacatagctttgtaagtaacaagaatctgcccactctccttattaatcttagagttgttttagggaccatgcataataaaataataaaggccggttttaagtaagtgcctacaatgagccaggcactgctgtaagtactttcacacaatgccctatttaatccacacaagttccttataaatgaaataccacaaccccattttatagacaggaaaagtgcagttgagagagggtaaagcaatttgttcaggctcacacagtaagtgttagagccatgatttaaactcagattaataccagaggcatgcctcctgcataccactgtaacaataaagatgttcagaggacaaaaaagatatcagtcaaactatgtgcaaaagcctggattaaacaaagttaaaccagtttattttctgtagggttttcaaaacttttaaaatgccagtttgccaattcatgttacatatgtagaaggctacagtacacagtttttctcaaatgtatttgaccaaaaaattctttttcacccaaaatatagtttgggtatataatccaacaatctctcagccaaaagttaaaatgtttaaatgggcttatcttaacccacttctcttcttcacatgttggcaaactacagatatttagagtggtgttgtccagtgtggtagccactagccatatgtgactaattataaattaattagaattaaataaaatcaaaatttcagttcctcaatcatgccacatttcaagtctgttcaggaaccacatacggctaccatattggtcagcacaaatacagaaaatttccatcatctgagaaagttctatcagtcagcattaggtcagaagtgtgttttttaaagaacatggggcctgtgcaatcttcagagaaagattgtaaattattacacatgttattgccactatcccccataaaacggggccaggtcagagatcctcgatgatataaagccactgtaatgtcaaagcacagggaaaaggtaaacaaaggagtggaaaaaatgaatagcaggaagagaaagcaacatcatgaagcctggagatgaagcttgaagcaggattcaggagcctgggttctactgcctgttatgccaatattcacctttttaaaaaatatttaatttttttgcacttcatgcgaattaactgtgatttgattgaacaggcctctttactactttgggcctcagtttccttttctacaatacaaatttaagccagaggatcactaattccctctagttctgtacagttaaaacacacacacacacacacacacacacacacaagaaatgagaaagtagggaataaaagtaaaaataaaaagagagcaagatcattgcatattggtggtgaaaactggcagtcctgtcatcttgccacaagttctactcccaagatttggatgccaccaaatgaataaaaatttaatgctattcaataaatacttattgagcaattatttgcaacgaactacagtattcggaaatagcaccaccaaaaaaaatgattagccttaagactcaatacgtggaaagaatgcaagactcacaaaactttaggttgaaagattgtctcattaacatgtaataacctaactggtccagtactaagaaacaagtatttcaaatattcctgaggaaaaacaactagtaaattatataaaataatatataaagtacaaacatacggcataatcaaaagcatcacatttcttccacaaagaatataaataaatgctacaggtacttgggaacaggaagacatcagttctggccaatctaatttttctagaatccacatttaattggatactctgacattttctagtaaaatattcttgagggctattggaattaacagatccacaaagtgtgctagacagaatcaaatgcaactgaaattccggcctctactatctactgcacaaattcccacttttcagaggcactgttggtcctatttcctagtatcaaagggtagagaaaaccttccacatgcctattctaagaatttaaatagctaatatgaaaactttaaaatgatttttacctctagattaaaaagaaccaagataaactgcgtctgatattttaccttgcagaagctaagtcaaccagtgagtcgtgtaacctttatatgaattccctcctgaaagactggaaccatacccctgactattctggagcaagggagagcagataactaaagctctccagcaagcaaaacaaggagaagggattttaggaacatgccttttctttggaaaggcattttttagtaccccacctactaatctaacgcggcgcggaaaccttgcagaatttgaaaacaaatgctgagaggctccgggggaccggtaaagggattagcaactgacagctcggcctcggagcgagaagcctcaagtagttagatcaaaccgtgtcaacgatctgaaatccagggtccaccccagtgagcttagagaagtacagcagcagaaggtaagcaggggtttggcgtctttcagtcctaaagatgcgggatatcggaactgagagagacctagaacccaagccgggcagtttgcctgctctcacctctcttgggggctttgatcagaggcacccctccagtcctctcgccgttttcctgcttgtccttgtgcttgagatcggttccgcaggagctgggatcaccatcggggccgcggtggtgatggtgcttgtgccgctccttgtggcccttatgcttgggcccggccgcgctcaccgtcagaggcgagaaggtgaagagggccgaggtgcttggggccgggagaggggcagcgacagcgggcccggcgggtgccagcgaaggtggcggcggaggcggcaggagaagaggctcaacagggcctgggacagttggggctgcattcgttggcggcagcggcccaggatgttggcggctgcgacgccgccggtgagggggagcgagagggggctcctggctcggccgcccccgcttctcctgagaccccccactgctagatcggcgctgccgtttaactccccgcggggagaccccagcatgaggtttctccttcccctctttgtccggctcctcctgcgccgccaccgcccgtactacgcgcaccgctccgacctgcgcagccatttcacccacaaacacacatttaaatggcccgaccgcccccccgtccgcgcatcgcgcaagcgccgcccgcgcactgcccgctgggcattggagtctctcctccgccctccacttgtcggccgttcttcgtccagagatgaacatgccggaagcggccgttcccagcttttctccgcaggcctctccaaccgagcttctattgtaaagcaccctatgccgcgcaaagcgtcatgggagctgtagttccgccgcgcccccgccgcgtccccggctctgagtggaggagtggaaagggagcgtgcgcgaagtcacgcttctggctgcgacgcaaccgccgctgggcggtgagttgccgccaaccgccctaacggccgaaacaatgttaatggctttcagagtctggcggcgcgttcccattatcatcttcctgtgacccttcctcattttacacggaggaggtggtctccacagtgattttaaatttaatatttctctcataacctttgtgagataaaagaatcttcatccttttaactttgacgagggatgaaatgaaggtgaaaagaggatttagtaatatgtaaaataagggtggttttgctgtaaaaatatgatagggccgcaattcagaaatgttttcaagcatctggggcattgctatggttacaactacaggcctacgaagtcaggtgcgagaactgcttggagtcctggtgaggacggcccctcctcgccatccggccacatcccctctaatgcctggaaatgtccagcatttattttgaatatatccctacagttgcgaaaaattgtagatggaaaaccacgtttaagattttttataagtttttttttttcaaatcttaaggataagattgcataaatttgaaaagtgtgcctaccggagaacacaccaaaaatcatcactgctcactacggatagttgttgctcagaaattcatttagaatttcatcctcgctttagcttttacctggggttcttttaagtatttatttagagacgggcggggcggggctcggtgtctcaggccggtaatcccagagctttgggaggccgaggcgggaggattgcatgaggccaggagttccagatcagcgttggtaacatagtgagcctctgtccctacaaaagtattttttaaattatctgggtgtcgtgacacgcgcctgtagtcccaggtactcgtgaggctaaggtgggaggagtggtcgcaccactgcactctggcctgggtgacagatctagaccctgactcttaaaaaaaagagacaaggtctcgctctgttgaccaggctggcctccaactcctgggctcaaggaatgagtagctgggtctacagatgcactcatggtgccctaagtaactcatggttacctagaattcttttagtatatttgtttattgataaagacatttggaagtaattgattacaatgatatatactcagcagataaaattactgtggtttgatttcactagtttctggagaagtattacctaaacactactgcaatgaagtcagtttaacaaccaaaaagtttattgagtgtctgttggatacattgtactacaagagacagataataatacttcattcaatttgccctattggacttccaaatgaaaaatactgaagaacaaatgatgtttaaacaatactacatgtttctaaaagttataaataaagttatttaaataaaaatatttttaatgcattaggggaagtcaggtggattctttgtaaaaacaattacctgccaatttatttactacataaaattagagttgaactagattttcttatggcagatccatattcatatagaaattcattttaaactagtatttctgattggttagataaaaattgcacatgatctgaaagatcctgtataaacatatacaatttatatcttttgctaccaaaagatagctattatatttcattgattacttttctagaattggtaatttaatgactttggttaaaacttatcaggatttcagttgaattccttgttacattcaaataattgtcattatttgcacattttattctaataaatataatttctcattttcttaatattccagttttccacaacatttgggaagatttacaaggtatactccatttaggcaaaaataactgtcagggaatagtcattgtcaagagcagtttgtattgcaacccacaaagtaagttttttttttaactttttatagtatattctggcaatgtagaaattagttgagatccaaatcttacaaaccttttgaagtttatgtttatgtagaaaagtaaaagaaaataaaaataactggcaaaaatgaaaaataaatccattctaaaagtgtttctcatatagcattctgtacataagctcaagtgacaaacttttatttgcagttttcaactcaatgcaaatgatatgaaaatgcaaaactggcacttattggcattttgcttttcttttaaaagctattaacacattagcatatcttcatatttgatattatgcatatagagcacttattttaactagcagtattctagtagttttatttgcaggtgtacttgcagcccatattattataaatctggagttttattaaatattccaagttggtggtggattccttggtcctttgggttttgaaaaacggtttgcaaaacctgggaacaaaaataaagttgaatgaaaagaaagatgttttaagtatagaaatgaatacttggattttagagtatattataatatatgcaaatacatggtctttttttaaatgttaggcagcatcttgaccagtttagtaatagattataaagggattgtagtaatctaaagcttaaatgataacagaatactaataacactttaaatttgaagagcacttacaaatttaataatggtaataatagaatgtaggaccctggttatatataggctttgataatttagtatataatatcatttgtctatgactttttgtcatccactccatcccattaaatgaagtcaggaaattttaatttcacaaaaatatagcaccgttacttataacattattgtattacatctagttatacctctatgtcggtccagaaatccttcaatttaccaagagattatgtttgaaaatcttagaaaaaataaacaatcctgaaaaactaagtaggtaagtaaacattattatttatctttcttcttcaaacttgttccccctaccccaccccaaagaaggaggatgagaaaatttttcacaactaatgaaggctatttctggatgctttcaaaagatgtgcatgttgatgatgttggttctttatcatttcagcaacatgtgactttatgacttttctttttgatggtagtgtctttttgtttgtttgttttttgtctgagacagagtcttgctctgtcgcccaggctggagtgcagtggcgcgatctcggcccactgcaacctccgcctcccgggttcaagcgattctcctgcctcagcctcctgagtagctgggattacaggcgccagccaacatgcctgggtaatttttgtatttttagtagagatggggtttcaccctgttggccaggctggtctcaaactcctgacctcaagtgatccacccaccttggccttccaaagtctggggattacaggtgtgagccactgagccaggcctaatggcagtgtatttttaagttatcttacacttagcaactttagggacttaaagtaagaaatgaaatgtttgaagtataggggaataataaaatgaaaaactcaaagatatacctaaacctttaatttcatcatcatacaaattgtattatctaccttaaaaaactgatgtaaggatcaaatgagatatttgtgtaaaaagcgaatggggcagggtgcagtggctcatgcctttgaataatcccacactttgggaggccaaggcaggtggatcgcttgagccgaggagttcaagaccagcctgggcaacatagtgaaaccttgtctctacaaaaaaacacaaaaaaattagccgggcatggtggcttgcacctctggtcccagatactcaggaggctgaggtgggcaaatcatttgagcccagggaggtcaaggctgcagaggggaaaaaaaaaaagaattgaaaaaaaaaaacagcatccagcacaatgcctggcacatagtaagtactcaaatgttcctcaggccagtcatggtggctcaaacctataatccgagcacttttggaggtgagtatggaggatagcttggggccaggaattcaagcctatggtaactactcaaatgttgcttaaatttcaacccagaagccaggcgtggtggctcacacctgtaatcccagtactttgggaggctgaggtgagtggatcacctgaggtcaggagttcaagaccagcctggccaacatgatgaaaccctgtctctactaaaaatacaaaaattagctgggcatggtggcgggtgcctgtaatgccagctacaggggaggctgaggcaggagaatcgcttgaacccaggaggctgaggttacagtgagctgagatcgtgccactgcactccagcctgggtgacagagcaagactccatctcaatttaaaaaagaaaaaattaccaacctagaaaactatgccagaactggaagagaaggagagtagggaaggggaaagaagattcaagaaaaaaaagcacattcaaatttgttaatggtgatgataaaaaaaaattggtggaggggacacacagcctagttgatgtacattttactcttccgagtggcaagaaagaagatggaaggaatacttttggttaaatagtttcacacacaatagtcagaatcatcctgtcagtacagatcacttgattgtaacccaagtggactaggaatagagataaggacatatgttagtattgagtacctaaaattttaggaatgcatatatttgatctctttcactggtcaattctcagtagcttaaaacagtttcgagctacctttttttgcatgtgggccaattcagggaaaataaacctgaatcataaattttttcattcagatttaagtacttttttgagtaacatgcacttaaattgatattgccttaaaaaagtaagtgctgatttttgggtttttttttccaagacagagtcttgtactgtcgcccaggctagagtgcagtggcatgatcacggctcactgcagcctcaacctcctgggctcaagtgatcctcccacctcagcctcctgagtagctgggactacaggcacatgccaccatgcctggctagttctaaaaaaaaaacatttttttgtagagacagagtctcactgtgttgcttaggctggtctcaaacttctggccccaagtaatcctccctcctcagcctcccaaagtgctggaattacaggcatgaaaatgctgctttttaagtaggaaaaatgttcaaatctaggcatatttgagaggaagcaacatggaggcagctctctaatattttatcctcatattagattatgtagactgttgttaagctaggtaggcctagagtactcaagttgtatcactgatttagagtaaagaaggaagcagagaacatttatgttccaggtaaagttgggagcttttttctttttcttttttccttttttttttttaaatgagatggtcttgctatgttgcccagactggtcttcaactcctgggctcaagggaccctcccacctcaacctcccaaagtgctgggattataggcatgaaccacctggcttgcttttttcatagtttttacaatattctgtgtgaatgttttagctaaatgatttcatataaatcataacttattttttaaattataacttttttttttgagatggagtctcgctctgttgccgggatggagtgcagtggcgcaatctcagctcactgcaacctccgactccctggttcaagcgattctcctgcctctgcctcctgagtagctgggattagaggcatgtaccaccatgcccagctaatttttgtatttttagtagagacagggtttcaccatgttggccaagatggtctcgatctcttgacctcatgatccgcccgcctcagcctccaaaagtgctgggattacagatgtgagccacccctcccagcctaaattataactttttaaacctcagagttaatgaaatccaaacaaaattttatggcaaaaaagacagatccagaaattttagttaaacattttgtgaagatgacacagggactcttaacttaggcgtggcagagattgctccccatccaccaatatcttctttgcttcttcctcaaatagaattgtgtgtaggcaattttgtctgtctgcccagcaatattacatttcccagtctcttttgcaatttagttatagcacatgtctaagttctcttcaagggaatatgagctgatatgatctggccatttccaggccagtgcctttgaagaccagaagagtaagaagaggaggccacacctccactttttcctcttttcttgccacctacagtctgcatgtggcggcaacctaattttgattgtgtaagtaaggacaataccattaagtggcagttctcaaagtgtgattcagggactcctggaggcctcacactctttcaaggggattggttaataataatttttagtagtaatagcctaccactaattgctattcttacaaaaaattatacctgatactactttaaatagtacataaatatgtatcacataggacaatagaatgcttagaagaatataaaattattgttttaagtttatagcttatacttaggagcaattgggtaagcaaaccttaaaaccgtcagaattgtgcttcatttcctactattgaattagttatataagattaaatagtggcaactgctgttctttttatcatacttctatgttttttataaatttgctttagatatgaaccagaatatcacagcatctcaatttctccatttggatagtcatatttatttactacatgccaacacaataatttggttacctagctttattttccacatatactagataatttagttctgtgtgagatgttaagaggtagttaaggttaaaaataaaaagataaattgcatggaaaagaatataaacataaggacctatacatgcaacctaaaatcatatttaaagttgaatcagttatactgtaaatgagtaatttaggtaatttttttaactcttcagtaaaataacacacataccaaaattcagaaatgagctggagttatttgactgaacagattctgcaggcttgtttggtgggcaagaattacagatacctagaatcaaaagaaaaaaatataagggaaagactaaagacagactcagatgactgttgatcagatcacatataattgttaagagtaattaataatcccaaataaacatatcactgtcaaatgttaacaaaatgtaggtgcttacaaatgggttgacactataatattctcatttgtatttttggtttttttcttaaaaggtttcttttctttgcaaacagattgtatagtaaagcccaacactaaagaaaattgctaaggaaataagatccaatatatcatgaatcagcatttttttgtttttttttttgaaattcacattttggctttggacttcatattactttttcctctggccactcttagtacatttttacatcatttcttctccacaataattcatccatgacaagtcttttatttgtattatataatcctctaccctggaatctctttttttattccactttccagcctgatttttttctaattataagtgattctaatttaggcccataaccgggcacggtgactcacgcctgtaatcccagtactttgggaggctgaggcaggcagataacttgaggccaggagtacgagaccagcctgtccaacatggtgaaaccccgtctctactaaaaatacaaaaaaaaattagcgaggcatggtgttgcaaatctctaatcccagctacttgggaggctgaggcacaaaaattgatccaacctgggaggcagagggatgaggtgagcccagattgcgccactgcactccatccagactgggtgacagagcaagaccctgtctcaaaaaaacataataattattattatttaggccaataatctcccaaaagcattgttatgctgctttgttttgctattttagttacttataggtataagttaacttataagttactcataggtcatatatgtacattgatatattcatgtatcagtttctgcagttttgaaaacagtcccttaaaaactttgtccacattttgcacattctctgtcttggcaatggaaaaagataatttcaggtttgtataaactttctaacaaattgcatataaatgggaagatattaagtgtttttgtgttgttttcaacattttcagaatgcactgtgtgaactgcatatgcatattaggtatgcatatttgcacatgcatacgtaatactaggattctagaaacaccttccttttcgaggaggtacctgagtatgaatcactagactacatactgaatttcaatcagatctaattaagatacatatttattttgtacttactatattactatagtaagtataattattatacttaatatattaaaatacttaatataaagtataagtataaaatactattcatatttaaatacttactatgtgctaagcattgctgtaggcactgaagatagagacattaatagaaagtagtaaaggtgaggaagttcaggagatatcagtaatctgtatactgcataggagctgaaagttatatacatccttcagaaagaaaacaaaattgtctcaaaggagaatattgttttttttacaaaggaggcacagattccacacatatatatcagaggaaactgctattttgttattttggctcatcatggatttttttgttttgttttgttttgtttgtttgttttggggttttttttgagacagtctcactctgtcgcccaggctggagtgcaatggcacaatctcggctcaccacaaccaccgcctcccaggttcaagcgattctcctgcctcagcctcccgaggacctgggactacaggtgcatgccaacacgcctgggtaaattttttgtatttttagtagagatggggtttcaccatgttggccaggctggtctcaaactcctgacctcgtgatctgcctgccttggcctcccaaagcgctgggaatacaggcatgagccactgcacctggcctatcatggatatatttatgctgcctgcctaaacttcattccctcttctgataatagaacttgaattttcctttaggaaactacccctccccagttttcagttcccgtgcttccattagagctgattgtacctttagattaaggaaatgacctataactagggctgattttcagttggtatattggcatggtcacaccagatgtataggtctgacctcattcctgattggacagtgtccacatgtaataagtgttaaatattagggcatgacactatcctgcctaatcagaacattgactataattggttcagggatgggcaaatgaaccaagtcaagacaatcagacccagttggcactagtcatcacagtgtggcttgaaaaccaataaagagttattttttttccatcataagcctgaactcacatgataaaaacctgcctatgaatgagttaacacagagtgagactaacctgagagacatgaaatgagaatttaggttctgattacatcatttggaccattgttacaagccagtaaattccccttttctgctgaagtcagcttaagttaggttttctgtcacttgtaactaaaggatttctgagcaattaaagtttcccaccaacagttgacagcttccactcttgtcactctataattcattctgtatgtagcagccagtgtgatcgttttatacttttctgtgaagcatgtttaaaaataaataggaaacagagcatgtaacatctctgcctaaaacccttttatggattcccattacacttagaataaactaaactacttaccatgcatgacccataaaaatctaactgctcctccctgatctttccagcttcgccttactcctgtctcctctttacttactaccctgcatctaagatggcttccctttgagtttctacaatacaccaaaatctcctacctcagagattttgttccctctatctgaaatactcttctctggaccctttggctggctggctgctccttcatgttttgggttcagttgtcacttccttaaaaagggtttcttgggccgggcacagtggctcacagctgtaatcccagcactttgggaggccgaggtgggtggatcataaggtcaggagatcaagaccatcctggccaacacggtgaaaccttgtctctactaaaaatacaaaaattagctgggcatagtggtgtgcgcctgtcatcccagcacttgggaggctgaggcaggagaatcacttgaacctgggagggggaggttgcagtgagccgagatcgcatcatttcactccagcctgggcgacagagctagactccgtctcaaaaaaagcgggggctttcttggactactcattctaaagtggatcccctttgttatcctctcatagttacccttttgttttccttcatagcatttatcatgtgttattaagtatatatttgtgaatatggtcaaccaaattttgtttaatgttgtttgtttaatgttggaacccctcaccaaacttacattccacaaaggcagagcccatatctgttctgttcaccatcatataccaagtgccttacagaatgcctggaacatagtagacactcaacaaatattcattgaatgaatgaatgaatgacactaggcttagatactagcttaaaataacagaagaagaatcctaatttcattaaaagtaggaccagctttacagaccagtgggagatccaggctacagggagaacacatggaattccagaatcatgaaccatctggaaggggctgaggacacatatgaagtacagtctaaagcttcaggatcaattttgggagccagatgttcttcatttaacggcaaaagaccagaggatcaaggtaactgaaaaatacagcacagcccagatccagagaatgaactgggagctcttacttagaaataagactcaatctctgaaagttccactataccttcaaagctgtgccaacctaaatctacctgaagtttctgtttctttatttgatattctaggcagagttagagctagagaaagaaaactgttttctgagttaggtggatcaaaccaatctttggttaaccatttaagtcactcatttctttgcacttggctgttttatttcccctgtttcctaccataatttccatttgaaatgtttaaattctcttttgactctttttaggagaaaaggtatgttttccaactatacttcagccatcatgagttggtgtcagagatcagctataatggcagtgatagcaaactagctcaagaacctggagcttttgggtagggagatagaatgaaaacccaaaaggaaaccttctttcttagactatacctacatcagattttctcagtgctttttgtctctccctatagtaccagtttaatgtcaaataactgctctttcactgattaaccaaatgtatcaaaaatttttttaagattgtcaccatggttctttttttttttttgagacggagtctcgctctgttgcccagactggagtgcagtggcgcaatcttggctcaccgcaacctccgcatcccgagttcaagcaatcctcctgccccagccttccgagtagctgggactacaggtgcatgccaccacacccggctaatttttgtatttttagtagagacggggttacactatgttagccaggctggtctcaaactgctgaccttgtgatccacctgcctcggcctcccaaagtgctgggattataggcatgagccaccacacccggccatcaccatggtttttatattttttatttgtaaataagatttctaagataattttccacagtttcaggactcaatggattttattttcattacaacgtagcaaaaatagtaagcaacagacttttattgctaataatacttagtaaaaatggaaatgtgtcaatgctttgcttatttcatgaagtcaacacatttgttcacaatatgctttgctgtgactattttcaaagaaaatacatctgaggttagactgctggaaattttaaataatccaattgtatgacagcatcttaggatgggtagaaagtaccaaacattggccgggtgcagtggcttatgcctgtaatcccagcactttgggaggccaaggcaggaggatcacttgagcccaggagttcgagaccaacctgggcaatatggtgaaaccccatctctgctattaaaataaattttaaaaataaatttaaaatttttttaatgccattgtactaattattattcttgtgtattaaacagaagacttctcatcgcctactccctgcccaatattagtattgtgaagcctagcaaaaaaaaaaaaaaaaaaaaaaggaggcctatgggtgattgttctgattcataggaccctatggaggctctgtttaggaataatattgttaatcttttcacaatattggttggttatataaataaaaattacaaaattgagaaaacgatatttttaaacataagtaccaacttactctttttcatgtttcgcaaaattttcaaactctacaaaagaaaggaaaaatgttagttttttttcctgtgaaacttgaaatactttaatcaaatagaaatatagacttaagtgaaaagaatttaatttccttaaaaatagccatgaaaatgtacaaagttgtttttccatcttgccatttttaattcagtgcaaaacctctacttgattttatcttgctatttatatcacccatgcaagtatcacactacatattttgaaataatagtatcagaggctgagcacagtggctcacacctgtaatcccggcactttgagaggccaaggcaggaggattgtttgagctcaggagttcaggaccatcttaggcaacatagcaagacccctgtccctacaaaaagtaaaaaaaatattagctgaatgtggtagcagctactagggaggctgaggcgggaggtctgcttgatcccaggagttcaaggctacagtgagctctgatcccaccactgcattccagcctgggcgacagagtgagaacatgtcttttaaaaaagattaataaatgttgttgttgttgttgttgttgttgttgagatggagtctcgctgtgtcgcccaggctagagtgcagtggcgtgatctcagctcactgcaacctctgcctcccgggttcaagcgatccttctgcctcagcctcctgagtagctgggactacaggcacctgctaccatgcctggctaattttttgtatttttagtagagacagggtttcaccatattggccaggctggtctcaaactcctgaccttgtgacctacctgccttggccttccaaagtgctgggattacaggcgtgagccaccgtggccagccaataaatttttttttaattatgctatcagaatattgacggggagcagtggagtgctggcaaggtggctcatgcctgtaattccagcactttgggaggctcaagtgggaggttcccttgaggccagggagttcaagaccagactgggcaacatggtgagaccccatccctaccaaaaattttaaaaagccaggcatggtggtgcagacctgtgttcccagccactcgaaaggctgatgcaggaggatcacttgagtccaggaggtcaaggctgcagtcagccatatttatgccactgcactctagcatgggcaacagagcaagaccctgtctaaaaaagaaagaaagagaaagagagagacagaggaagggaagtgaagggagaaggggaagggaagggaagggaagggaagggaagggaagggaagggaagggactcagaggggtagaggggatgaaattcccacttccctcctttattaggaccatttcagaatccacaatggcttctgaatatatccatgatacacagccatttccattctagccaagaatttttgccagtcatattctgtattcaatttactaaggccaccttccaaactgttagccatacttccttcctctacttttatggtggagtctctaattttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggcctcgatctcctgacctcgtgatccgcccgcctcggcctcccaaagtgctgggattacaggcgtgagccaccgcgcccggcctggagtctctaatttatctcttcaaggaacctacccaaatttcttctttactccacatttcttcagcatgtatgtttttaatctgcttcaggcattttattcttcttgataattttcatgtttctcaaaggtgttctgttccaacagattaactatactattttcaagggcaaatagttatcctttatgacatttctgttttcctaacacctaacagaaatgtgctcttccatggaatagatatttaatacattatttatttgtaacatttttagttattttttaaaaaatagatgatttatttacaagtcaggaaatcctagtaaaaatgctcccatccttgtcttcaatctactactcagtttctaatgctcctcctgtagataaccactgttagttttttatcctctgttgttagtatccttccagtgttacttatgaatatataagtaaatacacatatgtatcatattcctttttttaagtaaaagttaataaattatatataaatatattgagaaagtcctaattcttttttagctgcacagtattccatttgtatggatataacatgatttatgatttatttaatcagttcccctaacaattaacactattaattatgttgtttccagtaatctgctcttacagataatgctgcaatgaatacttggtatacatgtcatttcatgtgtatgcaagcatatttgtaggataaatttcacttctagtggctcacacctgtaatcccagcactttgggaggccaaggcaggaggatcgcttgagtctagaagttggcaacatagggagaccccatcctagacaacatagcaagaccccatctctaatttaaaaaaaaaattgtaaaaagaagttgtaccacttgacattctcaccaacaacattgagtgtgcttatttccccatagcctccctaacagagagtgtaatcaaacttttggaatttaccattctgatggatgaaaagcaatatgtcactgtggttttaatttgtaattttttcattatgaatgaaattgaacatatcaaatatataaagggcataccatgctcatttattttcttcaaaccatctgatcacctatttttgcccatttttatttgggggttattattttctatgaatttctaacagttctttatctattagagtaataacccctttggctgtggtgccagttgcagattttttttcctccaatttgttctttgtcttttgatttttaaggtgattgttttaccatgcatacattttctcttttatttagctgaatttatctatctcttttcttatggcctccggattttgagtaagttataaaggtcattcacactcccaggttgtaaaagactctttccaagtttctttaggtcttctatggattgaggtttttgtttttgtttttttaacattttaatcatttagccacttagaatttatcctagtatagatgtaaggaatagaccctgctttttttcaggtggttatttgatccaacaacagttattaaaccatccatctttatcccctgattttgagataccaccttcattgtatactaaatttctacatatatttggatctatttcagaactttcccttttactctgctcgtatatgtttctttttatacactaatatgccattttatatttatatttaaatttttgagatgacgtctcactctgtcacccaggctggagtacagtggcataatctctgcagtctccaccttccaggctcgaccaatcctcccacctcagcctcctgagtagctgggactgcaggcacacagcaccatgcccggctaattttttgtatttttggtagagacggggttttgccatgttgcccaggctggtctcgaatcctgagctcaagtgatctgcccgccttggcctcccaaaggctgggattacaggcatgagccaccatgctgggcctatcatgccattttaattgaggctttgccatattcgaatatctgctaaggtgactctctttcattgcttttctttttatttatttttatttttaaaaattattttagaaagacatttatctaaactatttttatttattatttatttgcaggtttctgactagtcctgcttccccctactcccatgtgaactttgaattcagtttatctagttccagaaataaacaagttggtagtttccttgggcatcttttacatttataaatcaaccttagggagaagtggattttttttttcttcatttatttttatttttattttttaatttttattttaggttcaggggtatgtgtgccagtttgttatgtaggtaaactgtgtgtcacaagggtttgctgtacagataattttgtcacccaggtaataagcatagtacccaataggtattttttctggtcctctccctctgacaaatgcctctttaagttgtattttttcttctttttcgtttccttctattaattttgactgttataatatcaacaattagttttaataaagatatttaatctaattttccatcttaatgctggggagggggaaactttcagtaagggaaagtttccggcatgtttcccaaaactcttatcttctttaccttactccttgtgaaactttttccaggagtcttcagtgtctgttttgaagatgttgaattttccatggtgtcaggatagctagtagaatatgtttctatagattgggcctgcataccttaaaaaaaaaaaaggagaaaaacatgttccattgcataccttcttaagccttcatgttacatataataaattgttagcttggcttttttaggcattattttgactatatattaggggcttttaaaatgtattcttttgtgtaatcatttttgtacctttccatttaggtcctactttattgttaatcttttaacattttcatttttatgatttttttgagagaaagtgctaccacttacaatcttcatcggcaagaaagaaggactctagagttctttctgggagaggaggtgggggagaagaacgatcttgatgtagttctgtgataagaaagtatacaataaaccagagaaatccatcaattaaaagtcataagtcaacacccttttctctttgtataattttttaatcaatcaatcttagccgacaatcaccaaataaaatattatctgaaaaatgactggagcctcaagaactttgtttttctacctcgttagcctatgagcctatgattcatcaaaaatgtatagctcacttcagaagtattctcccaaagacactgaaaccgaatataatcaagcttctagatctaacacccattttgcatgaaatattgggcatagaggatgttaaataaaaccattgtgatacaattagccaaatctagaagactaagcagtcttttaagacaaatgacccactctcttcaacaaataaatgatgtgaaaagtatagaaaggagaacggttatatatttaaaaagaaaatattaaaaaaagaagggagaactgttacagatttcaaaagacagatttaagaagacaaacatacaaatcaaatgaaatgcttagattttgtttgaatccagatttgaataaaccaactgtaaaaagacatttttgagacaattgaaaactgaacagtctggatattagttactattaaggaattattattaattttattggtgtgataaggtaggttttaaatgtgtgtttgaaattttccatgatgaagattttcagtaatggacatattttcccatgatgtaaatttctgaagatacagatggtattctactgacataagcatttaattatatggtgctgagtattactattatattaattccttttgaaaatgaaaatgcagtaaagtacaagaggttcacatgtcattggtcattgggtttgtttagtccttagaatttgtcttatcaataaattgtcttatttcttacatgctaggtaatacacacaagtgtagtacttatttctagcacctaataaaataactggcatacagtaggcatttaataaatacttaataactactctgaagtagttcatcatcttccagtttgctgttagggaatattctgaaaactaaagttgttcgttaacagtattctagtaattatttccctaaaattccatttcatcttaatactcccctaacaaagaacccataatgcctgttacttactacattaaatctaaattcctctgcctaactttgggtgtaaattcctctgcctaactttgggtagtaaaatacacataagatttgccattagtgacatttagcacattcacagtattgtacaaccatcaccacaatttagttccagaatactttttatcaccctagaaggaaactctgcacccattaagtcatcactccttattttcctctttcccccagcccctggcaatcactaatctgcttctatctttatggatctgtctattctggatatttcatgtgactagcttttttaagtccttcagaatcttgccccacatcttatttacccaaatttattttctgtatttcacaaactagaatatctattgcaaaaaaaaaatagcctactcaccatttctccatacacatcatgctcatttctacctttgagtcattggtaggctgatccctgctgctggaattccctccttttttctctctgtctatacaaattatttaaagttctttcttccactcagcgaaacctttcctaaccactccagtaatgccatcctgttttcccagactcctggtgattacagtcagtgccacacagattatcacttagtggttccacgtgagtattaattttatctactctatttgaatataagcattaagtagtactctttctcatacatcctgcctattctaaccctgtgtaaggtgcacagaagttgcttagtaaaatgcttatttaatgattaataaaaattataatcgataatatttaatgaggacttatttgacaagtactacgctaaaagctttacgacattattgtatttaatcctcataaaaattatctaagggattctattcttttataaatgagaaaaatagaaggagaaagtatgtaatttaaccaagtttatgcatgttgataattcttcatagaccagggatttgacttaaagcctatctgactctaaagcccttgtttttgttgtcatgttttgttttgtttttgagatggagtctcgctctgtcacccaggctggtgtgcagtggcgcaatctcagctcactgcaacctccacctcccaggttcaagcgattctcctgcctcagcctccccagtagctgggactacaggcacccgccaccacgcccagctaatttttagtagagacagggtttcaccatgttggccaggatggtctcgatctcttgacctcgtgatccgccagctttggcctcccaaagtgctgggattacaggtgtgagccactgcgcctggcctgttgtcatgttttttagagacagcatcttgctctgtcatacaggctgggtgcagtggtgccattatagctcactgcagcctcaaattcctggcaaagcccatgttttttaacctttatattatctgtatatgtatttgaataatatgacagtatgaataaatatgttaagggcaactaccacttgtgataatgtaaacaaagtacctggaagtgcccaataaatgttagtttttgttcttcaatgcatgaaacaggcaaagctcagacaagtactggagaggcaacagcaaattaaagaattaagtggccagaaataattttttgaatcacactgttaacagtgggaaaatctctatagtggaaaagctgcaaagttttaaaagattctctctgaaatagtttttatatattatttcagagaggttatatattaaggagcagaattctaaaatcctgtcttcaccttgctctttacaaaatttctagtctgggaaagccagaaataaatcaatgaatactggaagctattatgggaaccaagtaacttcctgaagtgaattactctaaacttaacgaaccattcttccaatcttagggctaaatgtcatctaaagccaagagaaatttttacctgatttaggacttcggagttttacactctaaaagaaaaaaagaaaggaaaagtgaaagaagaatatgtatacaaattatacaaactcaaagcaaaaaatggcatttttgaacttatatgtaatatagctgtagagataattatgaaatgtagaccctatttttcctaatttgtaagtgtgctgaattatgaaatggcatctttcactcttacactgatttttatatcccatggcaattagtcctaaattgatccccttctgacttatttctgtcccacctgaaacatttccctgaaaatttaattagaggtaagttgcggaaattgaagttacttcataacattggaagagtgactgttctttcctctgggagttgttaaagtaaatatatgtgcctattattaatgacaataataattactagtacattagaattataatttaaaaggcagagaatatttgcctatcagcattgcaattgtaggtactttaaaatgtttaattatttttctgatctctcaaattttaagagaattggttcacagactatacagaaatgcataacatttttagatacacttctatttttcctccagaagcaggacacacctactttcaataattattttctatttaatccacaaacccctcccacccccatctctgactttaccatcaaccacactattccaaaaggtttatcttaagtaatatgcacacctgtcattctctataacatattatcacagcaaacatgatatagcctaccaaatgactacagtgaacaagcttcctacttaagtatgaaacatttatttttgccttaactatccttcaagaatcagctcaaatgtttcctctttcactaaatcttccttgatcacttccaacctggaggcatctcctacacttgaaattctttatctttcatatgacattgatcacatttgctttgttataataaatataggcaaaaataaagatttgtacacatcctatatctctactactagacaagaagcttcttacaggcaagaattgtgtcttatacatcctttttatcccaacatcctctagcacattgttctatatttagtatgtgcttaggatttattgaatgatgggtgttaaaaatacaaggagtagaactgtagtctattgaatctaaatgagtagagtcattaaaaaattattgaccttgcttggtctaagtatcacagagtcatcaaatttctttggttcagatgttccaccccattccagtgatgttccaatttttaccttcacagctgaggataaggatttgggaacatttggtgagaattctcctggaagaaagtgaatatagttcggttcttaagaatagtattcttttagacatcaaatgttgctcagcaaataatacataaaacattgaaaggacctgagaagtaatctagttaattcacacttcattttattttttgagacagggtcttgctctgtcacccagactggagtgcagtggcacaatcatggcttactgcagcccccaactcctgggctcaagtgatcctctcacctccaccatccaaatagttgggactacacatgcatgctgctattgctctgctaaattaaaaaaaaaaaattagagatgaggtctcactatgttgcgcaggctagtcttgaactcctggcctcaatgaactcctcaaactcaaggctcacacatcagcttcccaaagtgctggaattaaaggcatgagccaccatgcccatcccacactttattttatacttactgaactgtactcaccagcttcctcaaccacaataaatgattcaggtgtccatacaggaagtggaggggggatttcatcatctatccttggagcagttgctatccaaaatgtcaaaaatattgtaacaattgttaattagaacaatccaaaggaaattcttatattctaatattaaatataaatttaccataatttatatttaaattccgttgaagcaacattatcagtaaagttgacacttgttcattcaaggaaaaagcaaaataaattctcttaaggtacaaacccaggaggtttttgcttattctttaacatttattgttttaaaagctcaaaagtagggctgggcgcggtggctcacgcctgtaatcccagcactttcggaggccgaggcgggcagatcacaaggtcaggagatcgaaaccatcctggctaacgtggtgaaaccgtgtctctactaaaaacacaaaacattagccgggcgtggtggcgggcccctgtagtcccagctactcgggaggctgaggtgggagaatggcgtgaacccggaaggcagagcttgcagtgagccgagattgcaccactgcattccagcctgggtggcagcaggacactccgtctcaaaaaataataataataataaataaataaaagctcaaaaacattttgattgagtcacggtgtatcagttaacataaaatattatattaattttggaagctttgaattaacttttacataactccttttgttttacatagactatataataaaacattataaagtgctttgacgtgtaaaaggttcagttatacattaggtaaaatcataaagatttcagtatctcttcattctatacaaaattcaagaatatgggtatttttccattttacaaaacaacagtataggatagtcttctgtatttctatacaaacattcagtttttattaaacattttaaatggtattacaagaaactgccaccagatggcacatgacgatattgttacaatccctgaaaataagggtatgtttttattaattaatttttttttgagacggagtctcgctctgttttttaatgatgcagatgctcagagaagtttaaggtataagaaaagaaaatacatttaaatgtttaaaaatgtataaaataatctaatcacagaaggaacatcttagatccagataagatatttttgcaacaaagctacaaatgatctacacaactatttattaagaaactctacaataaataatgttatagagcaaaagttttctccacctcctatctatgtagaatgtgctttacaaattatttgatgatatacctaagggagttaaacttgttcattgctttccctcatcatcttccacatcaaattattgtcatcatctctaacagggtgctcatttctactttcaaactaatcagtaaaacagaacaatatgcattatatgcaaaaatacagaattataaaagagacaaaacatgaaagtaaaggtatacatatgataaaatttttacacaaaatactaaacatgtattgtcatctacgagattactacaaaagagcaagaaatcaggttctccccttccaaatcctgcaggaagataattcaatttttagcaatatgttcaactcattttagccacataattgtgcaacaaaaaatctgggtgctattgatcaaatttttttctgctcttcctttggaagctgcttctatatgttaagagtaaattctgaagctaggtgtggtggcttgcacctgtaatcccagcactttgggaggccaaggtgggaggattgcttgaggccagattttcaagaccaggctgggcaacatagcaagaccccatttctaaaaaaaaaaaaaattagccaggcatggtggcgtgtccctgtggtcccagctacttgggaggctgaggtgggaggattggttgagcccaggacatcaaggctgcaatgagcaatgtccacaccactgcactccagcatgggcaacatagtgagattctgtttcaaaaaatatttttaaaaaacagtatattgtgagcctttgatatacatttctagaaatgaggcgtgccttctttagaagcactcctgctggtacagatcctgtaccagatcttgattgcctccattgttgcctgtttcatggaatattatgtttgatgttgctattttcaacttattacagcattaaaacactcctggaatgtatttatttgaggagtagcaggaagaagaaagagaaggaagcaggctaggcgtggtggctcatgcctgtaatctcagcactttgggaggccgaggcaggcagatcacgaagtcaagagatcaagaccatcctggccaacatggtgaaactccatctctgctaaaaatacaaaaattagccgggcgtggtggcgcgcgcctgtaatcccagctactcaggaggctgaggcaggagaattgcttgaactctggaggcggaagttgcattgagccaagattgcaccactgcactccagcctgggtgacagagcgagactccatctcaaaaaaaaaaaagaaaaaaaagagaaaaaagaaagaaagagaagaagcagaggagaagagggaagaggagaagaaaccaactattctatagaaacaaaatgaaatctaaaattctatgcaaactttaaaaaataacttacctagtacagctgactcctggttcaatagtgaggaaatattggttggagaattcagtgataaagaatcatgtgaattgtaataagagaagagggatgtagaggatgttggcaacagagaagaaggaaaaacagttccatcttgcttctcaggtaaatcaagagacatcttagaactggtaccacttggaggccatgatgaaaaataaggattttccactaaaggtatgtaagaatatacaccaagagcactagagtcatggtgctttacattagaggcattacgtatttggtgtttagagtcatatggcagtgaataattcagttctgctgaagaaacatgcattactttttgagcctgcatctctacaaaacaagaatcatgtggttgagattccaaataagaaaagttttccttgctgtccacctccttggtttctctctgctgtatcaattcaaaaggagttgatttggtccgtgttattggcacctttgaattaaaatatcttcctgctgcatttacaggtttagaattagaacatccctcaaacaaaagagagcccaaatccaaactttgatgcttctgaagaggctccccaactattggaaatgcctttgtctgccatttcatggttgtgtcagcatttttgtcaaaactgtaatttagctccagaaagtcaaaagaagtgcttgatttagcagggtgcaaaactagctcttcttttgcacttatttcagaagtcctaaagtcaaaggaagaagattctttgatttccatttttgtcctttgttggttcatcatttttgctgcttttgtggtactaaaacaaaaagaaagcgtaatgatgacaccataccccaaacaggccgcttcctagcatcacaatgatgtataagcatgagattcatctcccagacacaattagtcaacatttagatatataaaattgtactcacctttttggtaaattaggagaataagagtctgcttggagagtgtgatttttctcaggaatacaatgctttgcttgactctttaaaagaaataagtcagaggctggttttcagtgaagcaatgtcaataagatattttaatatttagaaggctgaaaagtaatttttcaggaaataaaaagatttaaaataattcatgaaagagttagattagcttccaaaatattgaactcagcaagaactcgttcatatactgagatggccagaataaaggattaatagtattatagaaactagaaaggatttgtgtatatcatcatcttttcaaatgtgggagttttaaaaatgttctttggtgggtaactttagtctcaaaaacactctgcctttagaaatttcagcatctcagccctttacaggtacttattaggtctctggacctatttcatcttgttctactcttttcctcctcactatgctctaggtatactggttttcttgccattactttagcatgccaaacttatttccaagtcaaggcttttacacttactattccccctgattaatatatttttgctccaaattttgcatggctggctccttctaagtaattagatctctgcttaactgtcatctgcataaggaaaccttccctgaccacccaacctaaaatcacatttcttcccctgtccagccatgctcaatcttcttcttttttaagagacagggcctcgctgtattgcccagtctggcctcaaacttctgggctcaagcagtcctcctacctcagcctcccaagtagctgggacactacaggtgtgtaccacagtgcctggcctcaatctttttttttttttttgaattaagttagggtcttattctgttacccaggctggagtgcagtggcacaaacatggctcactgcggtgttgacctcctgggttcaagtcctcctctcacctcagcttcccaatccttattttttatagcaattatcatattatgaaatatgttattgtggttcatagaatcttaaaatataattgattataaaatatatcttcatttcagagatgttaaaatccattttgaacatctcagttgatgcagaaaaagcgtttgacaaaattcatgttaaaatcacttaacaaaataggaatataaggaaatgttctcaacatgatagaggccatatatgaaaacccataactaacatcatattcatacatgaaagacttaaactttcccctaagatcaaaaacaagacaagaatgccaacttttaccacttctattcaacatagtactaaagttctagccaaagtaatttttttaattaattttgttcttaggcaagaaaaaaaaaagcattcaaattggaaaaaaaggctgcgcacagtggctcacgcctgtaatcccagcactttgggaggccaaggtgagtggatcccttgaggtcaggagtttgaaaccagcctggccaacatggtgaaagcccgtctctattaaaaatataaaaattagccgggcatgtggtgcacacctgtaatcccacctattcgggaggctgaagcaggagacttgcttgagcccaggaggcggaggttgaagtgagccgagatcgtaccactgcattccagcctgggcgacagaataagaccctaacttaattccatctcaaaaaaaaaaaaaaaattggaaaaaaaggaagtaaaattatctctagtctcagatgacatgattttatatatgggattccacaaaaaatctgctagagctaataaacaaattcaaagttgcaggatgtaaaatgaacacataaaacgagttgcatttctatacattagcaatgaacaatctgaaaagaacattaaggaaacagttatatttataatggcatcaaaaagaataaaatacttaggaatagatttaaccaaggaggcaaaagacttgtatactgaaaactacaaagctttgctgaaagaaattaaataagatataaataaatagacattcaaagtgatctacaagtgcaatgcaattcttatcaaaaacccaatggcatttttacataatttgtttaaaaaacagactaaaattcatggaatttcaaggggcactgaacagtcaaaacaatcttgaaaaagaagagcaaagttgaatgacacactacctgatttcaaaaattgcaacagagctacagtaattaaaacagtgtggtactgacatagtatagactaaagaccaatggaatagaagagctttgaaaaaaacatttacatatggtgggcaattgatttttgacaaaagtgccaagaaaattcaatggagaaaggagagtgttttcaataaatgattctgggaaaaactgaatatacacatgcaaaagaatgaagttgaggctgggtgcggtggctcatgcctgtaatcccagcactttgggaggctgaggcgggtggatcacctgaggtcaggagtttgagaccagcctgaccaacatggagaaaccccgtctctactaaaaatacaaaattagccaggcatggtggcgcatgcctgtaatcccagctactcaagaggctgaggccggagaatcacttgaaccagggaggtggaggttccagtgagccaagatcacgccattgcactccaccctgggcagcaagaacgaaactccatctcaaaggaaaaaaaaaaagagagagaatgaagttggacccttatcttatgatacagaaattaactcaaaaattgatcaaatacctaaacataagaagtaaaatgtaaaactcttataagaaaatgggcaagcttcatgacattggatttggcaacgatttcttggataggacaccaaaggcacaaacaacaaaagaataataggaaaattggacttcattgagattaagacttttacacaccaaaggacacaaaggcaaaaaggcaacccattgactgaatggaagacggtatttgcaaatcacatatctgataagggatcaatatccagaatacatagagaactcctaaaactcaacaacatgtaaacaactcttttttttttttttttggtggagggggacagagtcttactctgtcacccaggctagagtgcagtggtgcgatctcggctcactgcagcctctgcctcctggggtccagcaattctcctgcattagcctcccaagtacctgggattacaggcacacgccaccacacccggctaatttttgtctttgtaggagagacgggatttcaccatgttggccaggctgatctcaaactcctgacctcaagtgatctgcccgcctcggcctcccaaagtgctgggattacaggcgtgagccaccgcatacagcctcaattaaaaaatgagcaaaatctgggcaccatggctcatgcttttagtctcagctactggggagtttgagatgggaggactccttgaggccaggagttcaagactagcctgggcaacataatgagaccctgtctctaaaaaaaaaattaaaaaaaaattagcttggtgtggtagtgcatacctatagtttcagctactcaggagctgaggtgggaggatcacttaaggcccaagagtttgaggcttcagtgagccatgatggtgccactggactccagcctgaatgacagagcaagaccctgactaaaaaaaaagtaggggtgggtgggagaaggcaaaggacttgaagagacatttttccaaagaggatatacaaatggccaataagaccacagaaaggtgtctaatcattaggaaaatataaatcaaaatcacaatgagataccacttcacacctaattaggatggctgccatcaaaaaaacaaaataggccaggcgtggtggctcacgcctgtaatcccagcactttgggaggccgaggccggcggatcacgaagtcaagagattgagaccatcctggctaacatggtgaaaccccatctctactaaaaatacaaaaattatctgggcgtggtggcatgtgcctgtaatcccagctacttgggaggctgaggcaggagaatcgcttgaacccgggaggcagaggttgcattgagccaagattgcgccactgcactccagcctggcaacagagcgagactgtgctcaaaagacaaacaaataaacaaaaaacagaaaataaaaagtgttggccaggatgtagagaaattggaatccttgtgtactgttggtgggaatgtaaaatggcacagctgctatggaaaagagtatggctgttctaaaagaaaactaaacggccgggcgcggtggctcacgcctgtaatcccagcactttgggaggccgaggcgggcggatcacgaggtcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaaaaaagaaaactaaacatagaattaccacatgtaattccacttctgggttatacccaaagtaattaaaagcagggatacaaatatatatttgtatacccatggtcatcacagcattacagcagccaaaaagtggaaggaactcaagtatccattgatggatgaatggataaacaaaatgtgtgtgtgtgtgtgtgtgtggtgtgtgtgtgtataaacatatacaatggaatattattcagccttaatgagtaagaaaattgtgacacgttacaacatggatgaaccttgaggacattacgctaagtgaaataagccagacacaaaaggacaaatactatatgattccacccatatcaggtacctacagtagtcaaattcatagagacagaaagtagaaggatggttgccaggggccagtgggaggggagaatagggagttattgtttaatggatacagagggtctgtttagaataatgaaagttccagaaatagtgatagtcactcaacattgtgaatatacttaatgacactacattgtacacttaaaaatggctaaaatagtaaattaaaatgatatattataccacaataaaaatattaattggaaagtatctcttccttttctatttcctagtatagactgtataaaattggtgttaattcttccttaaccatttgatagaattctctagtgaaactatgtgggcctgagatttcttttttgggagttttaaaattacaaattcaatttttctaatcactaaggggctactcaaattatctatgtcatgctgagtaaattgtggtagattgtgtttgagaaaataatccattctgggccgggtgtggtgactcacgcctgtaatcctagcactttggggggccaaggcaggaaaatcccttgagcccaggagttcaagaccagcctggacaacatagctcctatttcattcctgatattggtaattttcattttctccctttttatctgtgtcagtttttaaaaaggtttgtcaatttcattgatcttgttaaagaacgatttttttttatcttttaaaaaaaccaggctggatgccttggctcacgcctgtaatcccagcactttgggaggccgaggcaagcagatagtcaggagttcaagaccagcctggccaacatggcaaaaccccatctctacaaaaatagaaaaattagctggccatggtggcacatacctgtagtcccagctatttgggaggctaaggcaggagaatcgcttgaacctgggaggtggaagttgcagtgagccaagatcatgccactgcactccagcctgggtgatagagtgaaactctgtctcaaaaaaacaaaaacaaacaaaaaaccaattctgatttttctctattattgtttccaatttcattgatttctgctctttatttctttttctatattcttggagtgacagcttagattattgagacctatactgttttctaatggatgcacttagtgctataaagttccctctcagtactgctattgcttctgtctcataaattttggtatgttgtattttcatttttgtttaattcagtgtgtttctttatttcctttgagactttctctttgacccaatagattatttagaaaagtgtggtttgatttccaaggatttggatacttttccgttacctttctgttactgatttttttctttttttaattagttaattaatttttgagacagggtcttgctctgtcacccaggttggagtgcagtggcacaatcacagttgactgcagccttgacctcccaggctcaagcaatcctcccacctcagccccctgagtagctgggactacaggcacatgccatcacacctggctgagtttttaatttttgtagagacgggggtccccctgtgttacccaggatcattttgaactcctggcctcaaggaatcctcccaccttggcctctcaaagtgctaggattacaggcaagagccaccatgcccggtctctgttactgatttctaatttgattctattgtggttagaaaatatattctgtataattttggttgttttgtttttgtttttgttttttttttttttgagacagagtctcgctttgttggccaggctggagtgcagtgatgctatctcagctcactgcaacctccgcctaccaggttcgggttcaagtgattctccttcctcagcctcccacgtaactgggattacaggtgcccaccaccacacctggctaatttttgtatatttagtagagatggggtttggccaggctgaccaggctggtctcaaattcctgacctcatgtgatccgtctgtcttggcctcccaaagtgctgggattacaggtgtgagccactgctcccaggctaatttcaatttaaaaaaatttttcaaatttttcagatttttatggctcaggatatactctatcttgatatatattttccataagcactttaaaagaatgtgtattcttattaggtagagtgttctgtaagtgtcaactagattttgtcagttagtggtgttgagttcacctatatccttgctggttttctgtctagttctatcaaaattgttgaaagaagaatattgaagtctctggctatgactgtgaatcatctgtttctctcctttaagttctatgagtttttcttcacatattttgcaatttcattgtttggtctatatacatttaggactattatgtcttactggcagattgacccttttatcattatctccctatctctgataattgtctttgctctgaagtctactttatctgatattaacatagccactcctgctttcctttgattcatgtttactgatataacttttttccattcctttgtttttagccctcttatatatttgaagtgagtttctcatagacaacatatagttgaattgttttttaattctctatgccagtctggcaattcactctaccaccagtaaatattggtgtatttaggcttatatgtttaatgtaattattaatatggtcaagtttcattctgctattttattttttgttttctctttattctttctgtttctcattgctcttttctttttcctgatgctttctctttcctgcattttttagaattccattttgatttacctatagtgtgttttattatatctctttgtatagcctttttttagtcatggctctagatatagatacagatatatggtatcacactctactggtgttatcattttaccagttcaagtgtggaagccttaccttcctttatgtttcttaccatcctcctgttataatcatttaaaatatttcctttaatacatttagaacaacatcagtcagtgttatatttttgcttcaattgtaaaacataatttataaaactcaagaggagaaggaaagtttattatatttacccacttttgtttattatgttctttcttccttctttcatcattccctttcggtttagaaagtttcctttgccatttttttagggtaggtctactggtaacagattatcttagtttttcttcatctgagaatgtcttgatttccccttcagccctgaaggatgttttcactgggtgtaaaactctggattgacagttattttctttcagcacttggaaaatattgtgccacttccttctgacctctatgattcctaatgcaaaatctgctgtcattctaattgttttcctcctacagttaaggtgtcatctttttctggctgatttctaaaacttttttgtcgttttttgttttcagaaatttaattatgatgtatcttccagtactttttcagccctgccctttctattttctttctggattttgatgacccaatgctagattttttttttttttttttttggtcccttagttccctgcagctctgtttatttttttttcagtctattttatcactgttgctcagactgggcaatttctattgttctacttttcaattcattaattcttttttccgtaccctctattctgctgttgaacccatctattttgcttcagttactgtatttttaagttctaaaatttccatttggttctctttatatcttgtttctttgctgagactcttttttttttttttttgatgaggctttgtattttttaatttgatttaagcatgtttttaccttttttatttttttatattttcattctttttattgttttgttgttgttgttttaactatgtttttaattgctcattgaagcatttttatcttggctgctttaaaatccttgtcagataattctgacatctgtatcatctcggtgttgtcacctattgtccttatttaaattcagtttgagatcttcctggttcttggtataataagtgattttcaactgaaatctgggtattttcacattgttatgagactctgaatcttagttaagccttctctttttgctggggcttttttttttttttaacagagtgttgctctgtcacctaggctggagtgcagtggtgcaatctcagatcactgcaacctccgcctcctgggttcaaatgattctcatgcctcagcctcctgagtagctgggattacaggtgcgcatcaccatgcccagttaatttttgtatttttagtagagatggggtttcaccatgttggccaggctggtcttgaactcctgatcccaggtcaagaccagcctggtcaatatggcaaaaccccaccttggcctcccaaagtgctgggattacaggagtgaaccactgcacccggccatttggaaaaatttttttgtagagacaattgctatgttgctgaggctgctctcaaactcctaggcttgaacaatccttccaccttggccttccaaagtgctgggattacaggcatgaaccaccttgcccagccaagagattatttttaaatttttatttctctttgagacagggtctcactttgttgcccaggctggagtgctgtggtgccatttcagctcactgcgacctccacctcccaggttcaagcaatcctcctgcctcagcctctggagtagctgggactacaggtatgccccaccactcctggctaaatttttttttttttggagatggggttcaccatgttggccaggctggtcttgaactcctgacctcaggtgatctgcctgcctcgagctcccaaaatgctgggattacaggtgtgagccaccggacttagtgagattaattttttaagttaaattacatcaaattaatttgtcattttccacaggaaattttcagtgcagccctatgcacacctgacgctctcaatttagttgtgacaatagataaatcctgcaacaaatctgacatcccttgaccaaaagcaagtatgaaaatttttttgacataatatctagtttaaattttacctctgttccagaatgtttatctctgataacatccatctgtctcttaaatagttctaatacagcattgtagaccagttcatattgttcctgaagagcatcacaacccagaacaaatgaaaacaaaaacaaaaaaattggtgaacgacaggaccagattttaggaatatgaacaccaatcaaatcctaatatagcagacccaaaaggacgatcggcatgttattaaacttactaacaatgccttatgcttacgtagttcacttcagatttcaaagcacttttatgctgctgaaaatagctaaatatttgatacacctctaactaatgtacaggaatcttatgacttgtttcttttatgttctaaacctagtttcttatctttctctccaccatcatttctctaattctgtttcccttgctcacattaaaaaaaaaaatatttcattctagatggattttttgtaagcaaccttcatcttttctggaaaaagagatagtggttggtatatagatagataacttcaatgtctatgctttaatttggtcctcacaattgctctataaagtagataagctatttatacctatttacaaacagtttatcccaggtcattcagaaggaatttccagggcttggcttagaaacttaatttccacactcttagttcagtgcatttagataaagttgctaaaattttgtcctaataaagataccaaaaaaaagtaaaccactaaataaggttttgaaatttgtggttacaaaaggatttcaccatagagaaatgagacctctattattacaaggtttatgagttattactactctgtttttgcctgtactttctcaagcacttaattttgaacctactttttatctgaaagggcctaatcagggttttacctgaaagggcctattcagggttttccctgacactttacacatttctgtacaaataaagaacaattttttttcaaagataattttagcaggaaacaatgcagagtctatatcattcaacacagccattagtatgctctttatttatttatttatttatttttttttttgagacacggtctcaccgtgttgcccaggctggagtgcagtgatgcaatctcggcttactgcagcctcgacctcccaggctcaagtgatgctcccacctcagtctcccaagtaagtcgggactgcaggcacctgccactacaccctgataatttttgtattttttgtagagacagggtctcactatgttgcccaggctggttttgaactcctgagctcaagtgatccacctgcctcagcctcccaaagtgcggagattataggggtgagccaccacatctggctaatttctttaagaaagaaaaatcagggctgggcatggtggctcacgcctgtaatcccagcactttgggaggccgaggcaggcagatcacgaaatcaggagttcaagaccagcctggccagcatggtgaaaccccatctccactaaaaatacaaaaaaaattagctgggcatggtgatgcgtgcctggagtcccacctactcgggaggctgaggcagaagacttgcttgaacccggcaggcagaagttgcagtgagccaagatcgcaccattgcactccagcctgagtgacagtgtgaaactccatctcaaaagaaggaaggaaggaaggaaggaaggaaggaaggaaggaaggaaggaaggaaggaaggaaggaaggaaggaaggaaagaaaggaagaaaaagaaaaatcagacaggaagctctcatctggttacagtgccatttcctggttacagtagtgtcagaaaaaacagctacaactgtcaagttcagttagttgtttgataatgccaaaatgtgaaggctttttcagcgtcttccaactcttaaaagtaggcctgaaatgaaattcgtttttgaaatggggtatagttttattaaattagtattgctatttatataactaggttccatacttctggaatctttatgcatttacatggatcagccttctttcaagtctgacagcattaaaccagctaatgctttcatttcacataagctttctccctcacaggttgaatatagaaaacacctacactcagcacacatgaaagttatttttttccaccagctattagtggaaaatctgtgcaggccaaacagttttatattataatagctctttattttatccctttaattcacaacttctagactaaatatctgaattgccattgtcagttgttttatctctaaaactatttgcatcttcatttgtaagtgttttaaacactttaaggtcttgctatttaagtagttaaaagtagttctaacaaattacacaaaagtgcctgttaataaacatcaatacacgtttcatgaatgaatgggtcaattctaaattctatattaaaaatggagaccacttagaaaactaaaactattgggtaaaactattcgtgtagaaatatgggtgaaattaatattgtaggcagtgagagatttgggctaggagaagggaagagcattcctaatggagtgaacaagtatgggtattctggggtaggttaaaagattgtgatacataaatagagtgtgattgtaattttttttttttttgagacagagtctcactctgttacccaggctggagtgcagtcgtgtgatctcggccctctgcaacctccacctcgcaggctcaagcaattctcccgcctcagcctcccaagtagctgggattagcaggtgcctgccaccatatccagctaatttttttatttttagtagagacagggtttcagcatattggtcaggctggtctcaaactcctgacctcaggtgatccacccaccttggcctcccaaagtgctgggattacaggtgtcagccaccgcgcccggcccaattatgttttttcttttttaagtatgcatgcaataagaatcaggagaaactatagaaaaatagtaatagtggctatctgtaggtaataggaatatggtttttatttttatttttcagtgtttcctaaaacgagcacatagactgaattctccatattctgttaccacatcctgggtagaaattacaaatccctgattttctatgctttcagagatgaattttatcactacaaaatttcaaattaacatgacctagctatttcaagtccacaagtcagtttgttgaatacttttacaacatcctttgtaaggaagtaagtaatattacattggtatcttaatattttctgaacagacagtaaaataaggaatgaaaggaatttgacccaggacaagggatacaggaaaaatattgggatattcagagttagagaaaatggcaatggactctagagcacgtaatggtaaattggtgttatatctgagcagtcagctgtttttggatgcctcaccattaaacagatggagcaagactcagacacatgttctgatccattcactatagttcatacctgcgtttgaactaatgaaggcctctgtgtccgcatttcccggatcaaactgaaaacactgaagttctcaggaattatctatcaaattaaaggggaaaatattcctttcaatattttgttaataaattattgctactttttcatagtcttgtacttccatggcatctgctcttctaacatggggtaatatcagaaaaatgatgcatttttaaaacaaatgaggtttcttatcacttgcaacatgatttagagcctggtattttccctagaaaagactaaagaaactcttcagaatgatttcacacggtataaccaaatgtctaaaactatagatataacgagggacaggattcagtagatgcacaagtatgagagttgcataaaataaaagaggttggtaggtaggtctaaaggccatattttaaacttcccatttcctattagacattaaaaaatgatttatagattggaacgcaaagtatgattgcagtaagttgagtccatctattaaagcatctttggataaaggaagggtaactatataatttaggacagtggtcctcaaacttcatcatgcatcacaatcacctggacagcttgctgggcccccatctctagagacatgattcaattcaatggggtggggcccagtaatttgccttcaccttaggttaggtgcacctaacccccttggggttcaacccctacactattggaatctccaaagattggaaaacaaacattaaaggacatataaattacagacttcctgggagtctgacaaagtagaaatagaaatatttgacctattttcagtatttcacaagaactaacagaaatcatatgtctactaaaacagctgcacaagctaagtgaaatatctagtttccttgggttttgatttttgctttttgttttgttttgtttttgaaacggactttcactcttgctgcccaggctggagtgcaacagcgcgatctcggctcactgcagcctctgtctcccgggttcaagcgattctcctgcctcagcctcctgagtagctgggataacaggcatgtgccaccaggcccggctaattttgtatttttagttgagacagggtttctccatgttggtcaggctggtcttgaactcccgacctcaggtgatctgcccacctcagcctcccaaagtgctgagattacaggcatgagccactgcaaccagccaagtttgcttggttttgattagaattgtcaactcagaatggcaacagtagaacagtgatatccagtaaaatataatgtgagccacatatgtgattttaaattttctttttctttcttttttttttttttttttgaggactttcacttttgttgcccaagctggagtacaatggcatgatcttggctcactgcaacctccacctcccaggttcaagtgattctcctgtctcagcctcccgagtagctggtattacaggcatgcgccaccacacctggctaattttgtatttttagtagagacagggtttcaccatgttggtcaggctggtctcgaactcccaactttaggtgatcagcctgcctcggcctcccaaagtgctgggattaccgtgtgagccaccatgcccggccaaaaatttctttcttttcctttatgtattttatttttatttttatttttttgagacggagtctctctctgtcacccaggctggagtacagtggctcaatctcagctcactgcaacctccgcctcccgggttcaagcaattctcctgcctcagcctcctgagtagctgggattacaggcacatgccaccatgcctggctaatttttttttgcttttttttttttttttttttttttgagacagagtctcgctctgtcacctaagctggagtgcagtggcgcgatcttggctcactgcaagctccacctcctcagttcaagccattctcccgcctcagcctcctgagtagtggggactacaggcgtccaccaccatgcccggctaatttttttgtatttttagtagagacagggtttcaccatgttagccaagatggtctcgatctcctgacctcgtgatccacctccctcggcctcccaaagtgctgggattacaggcgtgagccactgtgcccggcctaaattttcaaatagacacattcaaaaccgaaaagaggtgaaattaattttaataacatatcttagcccaatatatattgcatttctaacaagttctcaggtgatgctgatgcttcttgtctggggaccaccctttaagacccacctacctgggaactaatttaatcgtctgacagagtgggtctacaagtacattttctagaaaagatgaatcatgaagatagatgttttgaaaaaccaaacaattactaagtatgaaagcagtagactaagcaaatgggaagtgcctgctgagagaaactcaccccatcttttagcaacatccatgtataatcaatagcacaaataacaccagtccttccacagccagcactgaaatgaaagatcacagtagcatgtatgcatgtatacctagagagaatggaccattgacagtagctggaaaatttcaccagcagatttgaggaagaagatacctggggacaattaaactttccaaaccccaccatttcccagagcccatttgtcatgcaagaggtcctaggcaacatctcagagcaagagtctctagaactgtactactcacaagtaacttatcagaaaaacatgaatttaatgcttaggttgaatttattatcgtttgtttttgctattaaccttttcccctttcaattacacagtcctggccagactctgacatttggttcattttgggtagaaggtttatatatagtgtcatacctgcagtgaatgcatatgggaacactgtcatcctcttggtaacaacgtacatcccagatgagctcaagaatagggtctatagatgaaggtacatcatggtctggccaattcttgtaatgaaactggtagatagttcgagtttcctataaaaagtagccagatgggaggggaagaggggcaagggctgaaaaaccacctattgggtattatgctcactacctgggtgatgggattattcagtggcatgcatgcaacaaacctgcacatttacgcccttgtgtcttatattcataagattaaagttgaggctgggtgtggtggcttacgcctgtaatcctagcactttgggaggccgaagcaggcagattacttgaggtcaggagttcaagaccaacctggccaacatggggaaaccctgtctctactaaaaatacaaaagttagccaggcaaggtggtgagcacctgtagtcccagctactggggaggccacggcacaagagttgcttggacccaggaggctcaggttgcagtaagccaagattgcaccactgcacactccacactccagactgggtgacagagcgagactctgtctcaaaaaaaaaaaaaaaaaaaaaaaagttgaaattattttaaaaatagccaggataataagacaacttgtggttagaactccacctcattataccaagacaacagtccggcatactaagttgtatctatatcctttttgaaatttattccggtttcttctctatagatctcaggtgaccagatgctttctgaaaaccattaaaagtgatttcaggtcacttactattggtttgtccccatctgccccattcacaagaggaaatagctagatatgaaaatagttcaaaccagtgtttcccaactggtatgcctccaatgtgtcacaatcatgctgatatattaaatctttttgccttagagaagctgggcagggcctagggcagcctaagctctcaaactggtccccagtctctatgcactgttcagcttctgttcaccctacaaatattatcattttatatgtgtgccatggtatagaatagattgaagacatattataacaatggtctcttctttttttcttcttctttgagacacagtcttgctctgtcacccaggctgcagtacagtggcaccatctcggttcactgcaacctccacctccagggcttaaatgatttctcctgcctaagcctcttgactagctggaaccacaggcatgcaccaccacgcccagctaattttttgtgtgtttttagtagagacaggtttttgccatgtcggccaggctcaaagttctcttgaatatgaagactcattcatgacatcaaagaccctaccacttcccattgtcttatgcccagcctgagctacacacatctatatttacttgcctgatctctataggcttttgagtttatcattcttattttatacttacactattgaacttaacttttagagtcctgattatataatcagatttccttttttcagcttcctaaaaagaaaaagaagactcaagtattagtgattgcaaagacaagctctctataaggtagaccctggaggctttactcagacatgagaacagacattacacttacacaggatacagagaaagggccaaattccagctgcatctctcctggctcagcccagtagcgctcacactttttctgttgcacaaagcagaatacagtgatttccctccatatattctagtcttttccactctctcatttggaagcaaattcagctctatgtccttcaccttaggttaggtgcgtctaacccctttgggcttcaacccctacattattggaatctccaaagatgggaaaacaaacattaaaggatatataaattacagacttcctgggagtctgaaaaagtagaaatagaaatctttgacctatttttagtatttcacaagaactaacagaaatcatatgtctactaaaacagctgcacaagctaagtgaaatacctagttcccttgcttttgattagaattgtcaactcagaatggcaacagtagaacagtgatatccagtaaaaatataatgtgaaccacaaatgtaattttaaattttcaaacagacatattaaaaaatgaaaagaggtgaaattaattttaataacatatcttagcccaatatatcaaaacattctgacatgtaaccaatataaaataattatcagatatttggcattttttactaagtcttcaaaatccagtgtatattttatatttatagctaatctcaattaggatgccaaattttggaaatattttatttccatttagatttaataaaacttacatttgaaaaattttcacatactcaaacagctttctgataactgaattgcatgtcagtttttaagtttaaatcaattaaaataattgagttccccagtcacattagccatattttaaatgctcaatagctgtatgtggctggtggatgcaatattggacggcacaggattaaaagctctggctggcagttaaagatatctaattaatagaaatgggcaagtgatttgttaatcttaaaagcataccttgtttttaactgtaaaacatagggtctactgagaaaacaaacaaataggattcttaggagaaaaaaaaaatcctctgagaatcacgtggcattcccaaactgaaaactatgaagatgacataagttttatctaggtacactcaggtaagttctgctgccaatttccctctcctttttcttctttcctttgttttaaggtcagcaggtactagaaagtaacttacctttcccatttcatactccatgcatgccataacaatgatctgggggatgaaatagatagaaacttaaacattcatatatagttagaaagagcagttaatacatggatcccagactcagaaagtattaaccgttcttttttctgttttgtcgtttttttttaaccaaaaaataaatcctggtgacttataaaatattgctgctactcttccttcattctgacaatacttcccctttctctgttcagaccagtaatcttgttaccaaatgagcctgtcaaggtaagaactttctcatttttaaatttatttttattattttttaaaacttatttatttttgagacagggtctcattctgtcacccaggctggagtgctgtggcacaatctcagcttactgcagtctcaacctcatgggctcaagcgattctcccatatcagcttccccagtagctgggactacaggcacacaccaccactcccagctaatttttgtattttttgtagagacagggttttgcaatgttgcccaggctggtctagaacccctaggctcaagctatccacccctcttggcctcccagagtacacctggctgagaactttcatttccttggacaagaatggcattgtgattctgactaaaagatgcctgaaccctgaagttccactgaccaattttttaaaagcactgtttttaataaagtagagaataaagtaacaaaagcaacaccatacttacaaggacactatattcccaaatcatcctccagaagtccaggagggttgtagataaaggaccctgggtggcaatataagccttgggtccataaactccctaaaggggaacagaaattacacggggtgactacaaataataccctgttctcacctagtcctccgcttccttttttttttttttttgagatggtctcactgtgttacccaggctggagtgcagtggcataatcacagctcactgcagccttgacctcctggcttcaggcaatcccctttcctcagcctctccagtagctgggactacaagcgcatgccaccacacctggctaattttttaactttttgttgagatggggtctcatatgttgcccaggctggtctgaaattcttgcgttcaagtgatctttccgcctcagcctcccaaagtgctgggattacaggcatgagccactgagtccagccagccctcccctttttttgggtatctagagaaatatggaatgcttttattttctttcactgtaccttaatgaagttggcattgatgtagctggaatcctcatcagaggttatcagggatagttctacccggctataatcatctataatacaaaagacagacatagtacaattaagagggcttagtcagcagatttaaatcagggcctaacactgtgaatagtgtatgctcatgagtgaacaagtgagtgaatgaatgaatgaatgaatgaatattcttttgcagtcataaatagtacaaactaagttgtcaatgccatgttccaagatcaggatcagtaagcaatgggtacaaagagatagtaatgattgaatttgggagaaagtatgagtttatagagagaaatggaacttacagggcaaaatatccttatatctgtttttcttgatattcttgggcttctcagccacagttgtaggataggttttgtctgccttgtacttggtagattgccttttcagcttctgtaataagattccaagaaaaattaatcttcctagagaaatgaggtaagaagctatctctaaagagctttccttttccactggcaaaacattctacctcaacccttttattatcttctggttctgactccgttcaggacagagctgcagagcataaggagacctgagttcagtgacatttggggaagtgaaaagatcacacttactgcagctgagccatagatagcgtgaacttaaaagtgaaacttgtgaatattttaagaaccaaatatcttctggaagcaagctatatgctccacccaatgggcagatattaaaagcttaatttactttctttataactgctttttagttaaatggtcaactggaaaataattaagttctattagtctttttacttcagatcgcttttttttctaagtggaagtggagcttaagctgaataaaatttctctatatctagcaaaatttcaaagatttcagttccaaaagcagtcacttttttttttttttttttttgagataaagtttcactctgtcacccaggctggagtgcagtggcttgaccacagctcaatgcagcctcaactttctgggctcaggtgattcttccacctcagcctcacctcccacctcagccttacctcctgaaagctgggaccacaggcacaagcatcacacctggatagttctcatattttcagtagagaagggatttcaccatgttgcccaggctggtctcaaactcctgggctcaagcaatgcaccttccttggcctcacataacttttattactgtagattatcataattgttctattgtattactagctattattgctaatctcttattgtgcctaatttataaattgaccttaattatagatatgtatgtataggtaaaaacaacatagtgtacgtaagatttggtactatctgcagtttcaggcatctactataggtcttcaaacacatcctccgtatataaagagagcctactgtagtttgaattcctctggattttcagaactggatttgagaggagagatactgaactgatatctttttgtttgtttgtttgtttaactttgaaccccaagaagctactgaactatctttatagcatatttttacttcaagatggatatggatacaagtggactaatttgggaatttaaggacacatgaaagactaggctgaatttcagctgaagttacaccaatttttcaaatctccctgctcttaagcaacttcagaatgatcattttcaggttgctgttgatcccagggctgctgaaaagatctcaagtcccagaacagtttcttctaggagtctccagaactaagctcagtgcatactccttgttatactgtttttatttatttttgttttattttgcttgtggaacgctttctagggagaatgctatacacaaagccctttgcgtaagatatccttcaattaatttggcaaaatgttacagataaaggtgatgggtgtgtgtgtgtatgtgtgtcctatatttgtttagctgccttcactgctaccttcaacaataaggcagaatggctttcatttttcctactcctttcctccccctcgagtaatctagctggatgacaaaagcagacactcttagcaaaacatcacacaggaaatgcctacagaattattcatttgtaatgtatgaaagatttgatttttttccctcaaacatcttatcttaaggtcataccactgtgaagtcttcctttttctttctgtttttttgtttgtttgtttttgtttttgtttttgagacaaagtcttgctctatcgcccaggctggagtgcagtggcatgatctcggttcactgcaacctctgccacccaggttcaagcaattctcatgcctcagcttccaaagtagctggggttacaggcgcccgccaccatgcctggccaattttttgtatttttggtagagacggggtttcaccatgttggccaggatggtctggaactcctgacctcgtgatctgcccgccttggcctcccgaagtggtgggattacagtcgtgagccaccgcgcccggccaatttttttttgtatttttagtagagacagggtttcgccatgttggccaggctggtcttgaactcctgacctcaagtgatccccccacctcggcctcccaaagtgctgggattataggcatgagccaccgcgcccggcaggcttcatttttctcttccacctctcttcctgccagactcccgggctccaatatcccaagaaagaacaaattagggcaaaattagggcagaaaaagtaataaactacaccagaaaaggaggaaccctgaaagtagaaagcaaaagggtataaaagaggaagcagggtcatggggatgggtttaagtttgtgaagaaaagatatgagatctaaagggtgaaggtatttctttgccaactacaaggtaggggtgtgagttccctagaggaagtaccatcaagagaagtcaggggaatagttgccaagaggataaagtgaagagactgggtgcggtggctcacacctgtaatcccagcactttgggatgccgaggcaggcagatcactaggtcaggagttcgagaccagcctggccagcatagtgaaaccccgtctctaccaaaaatacaaaaaaaattagctgggcatggtggcagacccctgtaatcccagctattcaggaggctaaggcaaggagaatcgcttgaacctggaaggcagagattgcagtaagctgagatcacaccactgcactccagcctgggtgacagtgtgagactccgcctcaaaaaaaataaaaataaaaataaaaaagagaataaagtgaagagagagctcaacatccctcgtgggccctgaaatagggtggaatgtgtgagaaaccagattctgtgtgtgcttgataagctaatagtaagttcatttggtttgtagatgatactacccctttcgtttcaagaaaggagaggagaatggggatcctggccagtataacaaggagtattagattctagaaattcggattgagtcatttgcatgttattctcacagactagtaaataaaataaagtcactcccaaaaaagaacagaaagtaaaagaaagcacaagaccacgatatctttgccttgaaggactacattactggatagaagacgtagcattttagatacattttagggagaggaaaattaaacttggccctcctgtgctaggtgggagaacacaaagtttggctgtctcgagaactctgcaaggtagttcctcagtgccttgcaaatataggtcagtattataccaagcctccatcaggacagaagaagtacaagtggtaaggaatggcattaggagctcaggcttctaaatccagtaatcaggagaactaccagtaggaatggaggacaagactgaattgtacgagcgtgcaatgcaatcatcttcaacaagactgacaaacttatcgaggttagtttccagtgcaatagtggggcaaatgggtaggtgggtaggcaatagctaaattggggtgagtaaaccaagaggttcaactttagatacataaaatgtgagaaaatggcaagaaatgtgtgtgttgttggttggttggttggtttttgagacagaatcttgccttgtcacccagcagagagttcagtggcgcaatcttggctcactgcaacctctgcctcccaggttcaagtgatcctcccacctcagcctcctgagtagctgggattacaggcacctgccaccatgcccagctaacttttgtatttttattagagacagggttttaccacgttggccaggctggtcttgaactcttgacctcaagtgatccgcctgcctcagcctcccaaagtgtggggattacaggcgtgagccgctgcgctcagccaagaaatgtgttttaagtgtcctgtgagtaaatgaaaatgtaggactagatggtccctagtgagaggctggagatggtgttagagaaatcagcttcagaggtgatgtgatacatttattctggtggtggcatttttaaaaattgcaccttaatgtgcacaaaggtcaagaaatgctgataaatatgttcaagtgataggctgattcacaggaatgagtagtgtcaattcatagatgtttgtgcacttgctctgtaggaagtaccttgttgataactgtttggttagtatcattactataatatacacagaaccaggatgtatctatgtctcctttatagaaccaagatgtagccagatctttgatatgtctctggtcttctaatgaatctccagaagttgcaatagtaccagtctgatttctagtatagtttaaactgttagcacctaaacctggccttcagaactaggtatcttctttctgttaggattcaatgaatcctttatatttaataaatatatatatatatatatatatttttttttgacatgggatctcactctgtcatccaggctagagtgcagtggcgcgatctcggctcactgcaactttgcctgcaatcccagctactcgggaggctgagataggagagtcacttgcggtgagccaagatcgcaccattgcactctggtctgggcaaaaagagcaaaactccatctcaaaacagacaaacaaacaaacaaacaaaaaactgaaattgtggtaagtgctatgaaaaataacaaatggtgctaataagaacttacaatagaagatttgatctattcaaagaggtccagaaagctttctctggccaggtgtggtggctcatggttgtaatctcagcactttgggaggctgaggctggaggatcacttgagtccaggaagtcaagtctgcagtgagctatgatcaagccacggcactccagcctgggtgacagagcaagaccctgtctccagaaaaaaaaaaaaagaaagaaaagaagaaaagaaaagaaagctttctttgaagaattgaccaccaaattgagatctaaagaattattagtcgggcatggtggctcacacctgtaatctcaacactttgggaggctgagatgggaaccctagaggttgaggctgcagtaagccatgatcacactactgcactccagcctagatgaccaagtgaggccctgtctcaaaaaaaaaaaaaaaaaaaggccaggcatggtggctcacgcctataatcactttgggaggccaaggtgggcagatcacgaggtcgggagatcgagagaccatcctggctaacacagtgaaaccttgtctctactaaaaacacaaaaaattagccgggcatggtgacacacacctgtagtcccagctattcaggaggctgaggcaggagaataacttgaacccaggaggcagaggttgcagtgagcagagatcgtgccactgcactccagcctgggtgacagagcgagactccgtctcaaaaaaaaaaaaaaaaaattaccaaatgttatctaggtaaagaggagtgtgaggaatgttcaaggcggaggtaacaacatgtgtgcaaggccctatggcagaggaagcatggcaaggacaagaaaatgagcatgctataagaagctggagagacaccatgtaggacattgatagccattttaaaaggttctttgggaggtaaatgaagttctatttgtgaagcacttttagcacagagtctggaacacagttctatggattagctgttgttactgtggaaagtagatgaacagaaaacgtatataaggaaatgcagatttaaaataatcatggaacattttaaggctcagaaatccaatgaatgaaattaacataataaagtactattttatgctagttatatcagaaaaaaagtcatgatttttacctgatacagtttaagtacagaggttaagaggctttgaaaaaaaacagactggtttcaaatccgggcttttccatttcatgggtaaaaatgaacataatattttcctcttggggtagttgtaacgattaaacgagatcacgtacggcaaagcacttagcagattgcctagtacatagtaagtaggcaaaatgttttcatcttttattctcttttatatttattaagtctagcaaggtggtagagaagatgataaattcatatattgcaaattagaaaaactcctttggaaatacatttggtaatacttaaccaattagatgctaatagtctttgacccagtaataacatttttggggatctagcctaaggattaatccaaaagaagggaaaaaccacatggaaaaatatattcatattagtgttatcaataatcatgaaaaactagaaataactgtttaacaatggagaaataaattatttgggtattactatgtctcaggaagtttatatacttattatcttcacagcagttcttcaaagtgaatattattcccacattttactgacttaatccaaggtcacatagctaatcatgggcataacttaaattcaaaccaagatttatatgactccaaagtttttatgacttcagatgacaaagcaagactacctgaaattgaaattcagttccaccacttactagctatgtgaccctgagcaagttaattgacctctctgtttgtttcctcacctataaaatggaaatgaaaacagtaccttcctcaatggagcaaatgagtttatatatgagtgtttagaacagtgtctgtaagaggtatagaagcattctctattatgattattattctttcattataaaaccagatggacaggctgggcgcggtggctcacacctgtaatcccagtactttgggaggccaaggcaggcagatcatgaggtcaagggatcgagaccatcctggccaacatgatgaaaccccatctctactaaaaatacaaaaattagctgggtgtggtggcacactcctgtagtcccagctactggggaggctgagccaggagaatagcttgaacccgggaggtggtggttgcagtgagccgagatcatgccactgcattccagcctggtgacagagtgagactccatctcaaaacaacaacaacaacaacaacaacaacaaaacccacatagacaaatatatgtccatgtgatgatgctgcatcatcaactattaaaaatcatatacattttaatcagcctgataattttggtataatggtaagtgaaaatatgagaacacaaaattgtatctatgctataattacaataatattaaaaatttacataaatggacaagaactagaagatccacaaaaaaagctattgttggttttcatgtgtgtgtatgacagggtcccactctgtctccctggctggtgtgcagtggtgcaatctcagctcactacaccctccaccccctggggtcaagtgatcctcccacttcagcctcccaggtagctgggattacaggcatgtgccaccacttctggctaattttttatttttagtggagacggggtttcatcatgttgcccaggcttgtcttgaactcctggactcaagccatctgctcgtctcagcctctcaaagtgctgggattacaggcgcgagccacctcacctggccaagatccacaaaaaaagttttgatttgttagaatgttggtattatggtgagtttactttcttttaactttcaataatattgttttataacaataataaggaacgtttgaaaatacctttagaaatttcaacagtatagttgcatcctgctgtttctgctgtgtagaaactatactaactatgtccttaccctaaaacttaccctaaaactaggtcctttgagagactcagtgtcattggatgaagtagaacactattggataaggattaatgttacagctctgtaataagacagatctgagttaaatttcatctctatggctgaacagctgagtgagcttaggccaattatttaacttctcagagcttcagtttcctcatttgtaagtcagaaatgacatttgtagctatttcacagggttttcttaaggagtagtaaataagaaaatgaatgttgatgtttccttgaccacctcacccagactatcacaattatattaaatatttaatatagcaattagttgtttaatgtctgcctctctaagacatatctattgccttataacataagctccactaaagcatggagcattgcattgcattcctagcatctagggcattactttgcacacaataagcactcaatgaatgtttatatgaatgtataaaaaccttagatgggtggtcagtggtagtttcaactacagaaaagttactgaatttagtcctggcacagggaaaagacataagcagcatggcactggcttcagctgccattaacaggactgccacatccaattatgaatacagtcctctcacagtatctgtgggggactggttccaggaccacccccttcaattaccaaaatctgtggatgctcaagtccctcatataaaatggcatagtatttacacatactatacatgacctcttgtatattttaaatcatctctacattacttataatacctaatacaatgtaaatgctagataaattgttgttatgctttatattttttattttttgttgttgtgttatttttggtatttttttcaaatatttttgatccatagttggttgaatccaaggatgtagaacttggggatacagacagccatctgtattgttctctgtacaaagatgtatggccaagaaggaagtggagactgaaatctgaaccatggacctggggagagggtaaaggggttaggatgctcagggaatctacctggaaatagagatgccttttgataattcccttaaagttaccaccagttaagtgaacagtggccttgtgtcacagaatgagtcctcaaacctcggaaacataaaatcctgggagaatacattaagggcttaagatgggacacagaacatgaccagatggaaagccctctgatttagtggcagtatttaccttgtccaagcaagcagtctagcctcattcactactcctctactcccccaaagctctctatctggtgtctcatctgaaacctttagatggagctgagaggaagactctatttttccactggaggacatgagtcagtgaacagtgaggttacacttaatcactacccaaaaacaaggtccttaaaatcaggagctagaaaagcaaggaagtgattaatataaaagtcaggatagtgattatcccttggccagggtaggacaggacaggggcagatgggtgtaggggacctgatggggcatgggtcttcgggggtctgacagtttcttgacttgggtagtggttgcactgctaatggttgctttataattatacttaaatgttttatgtacttttctaaatgtgtattatattgcacaatattaagcagctaaaaaaaactataacaagtttttaagcagggaaaaaatgaccagatttggctgggcgtggtggctcatgcctataatcctagtactttgggaggctgaggcgagtggattacctggttggacagaccagcctggccaacatggtggaaccttgtctctactaaaaatacaaaattagccaggcgtggtggctcatgcctgtaatcccagctacttgggaggctgaggcaggaaaatcgcttgaaccagggaggtggaggctgcagtgagccgagatggtgtcattgcattccagcctgggtgacaagagcaaaactttgtcgcccccaaaaaaaagaccagatttgtatgattaaaagatcacttgggtgttgaactgaaaattgactgaaggtggggcaaggctagaggcagagaagccagttaggaggtagctgctatattttggtgagaaattataatgactttagctgagaaaaggtaaaatattagggatatagtctacatttttttttttttgagacagaagttcgctcttgttgtccaggctggagtgcaacagctctatctcagttcactgcaacctctgcctcccgagtttaagcgattctcctgtgtcaacctcttgagtagctaggattacaggtgcctgccaccacgcccagctaatttttgtatttttagtagaaatggggtttcattatgttggccaggatggtctcaaactcctgacctcaggtgatccacccgcctcggcctcccaaagtgctgggtttacaggtgtgagccactgcccccggccagtctacattattttaaaaaacacaaccaaaataaaacagaggccggcactgcccctcagctcactttttacatctatgccttgggttaccttggcttaggaattatagtccaggggcagggacatgtatacacatgtgctagaacttcctacttatctcctttcaggtaactctaccagaggggctcagactgatcagccagtggcagtgagagcacatttttcatagtaccacaagattatccatgttgagctgacatcggagttcctatcataatatctaatcactcaataatatctaattactcaagactttcagagtgttttcacatctgctatccggtaccagagtgttagctccaggaggcaaaggttttggttctttttgttcaccgctgtatttttagtgcttagaactgaacttggtacatactaagtgctcaataaatggtactcaataaatgaccacatttaatgattgttattgatatttaatcatcacaacaatcctgtgaggataggtaggacatgtattattatccccattttataagttagaaaacagagagatttaagaacatgtcaaatacttcataatttggtgaaaaaaaatcatgatttaatttcaggtttgtacttcagttcccctctttccacccatttcttcacaactgaagagctaaggtttaaaattcttatatctctgaaacgccagctgtaagcattctaaaatacatgataggtactattagacaccctatgttatctgatatctcagcttgtagggtgaatgaggcctacccagctgccattgcatcaataatcacagttctctcaaaggagattcactgttcttctgggtaatctaatccacccaacctgaagctaccttgtactcatgtttctctccttgacctacacttgtctctactctccatcctagccattccacttctccaagcaaaagaagttaaggaagccctgttattgaaaaaacacatgttataatatatttttcatatgaaaaagaaaagaaaaatgatggccagacatagtggttcatgcctgtaatcccagcactttgggaggcaagatgggaggattgcttgaagccaggagttcgagacaagcctgggcaaaaaagcaaggctcgtatctacaaaaaagaaaaaaacaatttttttttaaattagccaggcatggcgatacacacctgtggccccagctactcaggaggctgaggcaagagaatcacttgaggccaggagttcaaggctacagtgagctgtggttgcactgctgcactccagcctgggtgacagagtaagattctgaatcttaaaaaaacaaacaacaacaacaaaaaaaactgtggcagtgggtagttttggtgctcttcaaaaacctttgtcaaccaaatagaatcccagaggggaggctaaaaatgtaatattgcatgaaaagttaacattggtctctttcttcttaatattaattaaaattagtaatataaagcataaaccacaacttagatacctggggaaatctggatgttcaattaatattagtgtttttacatctggagttgtatatgtcttctgtaggattcctaaccaaactccaaagaactagcaaacaaaatattaaaaccagtaattttgagagaatacctgaaatacatgcaaaccactcagagaagtcaaacttttttttttctgtcttccccgccaaggtctcatatttactttatcccaagagcaatttggtctcggaaaattggacccccatagtcagttaaatagtgtatgtaactaccctgagagggtcacatacaggactcaccagaaattcattggcaaactcctctttagtaattttcttgctttgggcctcatccaggaacttctgcagaatttctctttggtccatgctgcagagcaagaaaaatagtctataagtaggttgagggagggcatgtcaaatgtgtgtcatggccgagacacctccaaaaagccactgctgccgcctgagcagagcatgctgaaggctgtggtttactgacttcatcacaagccctagaggaaattagtacgtaaccaccttctgtggtcacataacacagccatcatctcactccagggccctagtgccttccttctcagcaaaggaacctggttacaattcaaatttttaacaaacaagaggctaactagaacgtaaagtgtggtctgcttaactgagattattccattccatcacccatatgcaaaactcacctttcttcttgcctcccagagaaagaacagaattacaggtctcctgaatgagttctgtctctccccattttcccagtgagcacaagggccaagttgacaccttctgtttccttatgtcccaaatgaactctgcaaagttcagttaggcccaggaaagaagacagacactgtttagagtgagtgacatgtcttctacccggactgttcatcgaaaggtttcttgtcagtgtgatcaatgagaaacttctgttcatcacagaaggtatttttattcataacttttaagtctgctatatatacctcaaactcccttttgaatgaagcaaagtcagatgcttctgacagtctgtgtctctcccaggactggggaagtgctgacctccattaagggaagtgttgatttcagcacctcttcaaccctcccagtaacctttgaagcttcacttgggttctggatataaagactaagagtgttggtctatataggatctagagcaagtggcccccacaaggagcacctgaccagacagttagctcaataccctgcatatgtaatgctggtaaactgtgatggaacaaaaagaaagtaaaatcaaccaccttgctgacaacattgtaacttttagggcagaaagcctgaagaactgtttctaaagaacacatttctactctgcaaccaatgtcttaggaaataaatttgtttcaggaagttatgctgtgcctgtggcattttggccctgaaaggcaggctcttctagaaaaactttccacatttgagcttgcataacctctcaatgggtacaagtctacccaagtgcctaattcagtgtgagaacatccaaaaatcagtatatcatctttattgaaggcagaagttcaacaaatgttaacaaaattagtcttgatcctgaagaaaactgggaaatgtgttgttaggacttcctctatttaagatattagcaatcctttctgttttgcaacattattcaaacttccttcaggatatcatgattctgaacactgcttaatctgaacattaaagatactgcatgctctttactaagtactgcaaaaaaaaaagaaagatcatcgagatatcttggttatagacaacttaaagacaatatttcaaattaagaaactcaatcccagtatacataaattaaaataaaccctcattcttcagcaatatttgttaggaatagtatatttcttaaattatccccatctagaattaagagagaatttcttgctgctctaagtaacgtgatgtttactttggctattttaaaacataaaatatgggaaatctttgatttataaaaatacaaaatttcaagtttgtaataactaaaaccatgtaaaagtgtgtacatagttaaagactaaaagaagcaaaaaagaatcaattgtgtaagtttgctttctaaaattatcataattttagaattatgataaagtttgctttctaaaattatcataccgtttttaaaattagaaataaacatttaaaaatccattaagttgttcaacaaatttattgagtacccactaaattctaaacattgtcttaggagattggcatacaacactgagaaagccagaatatggtaaaaacaaaacaaaacaaaacaaaaacatccttagccagttaataaagcaactcagaactaaagatacagacatgattactgataaaaattaaaacactccttaggtaactttgggaaagaaaataaaaataaaaacattccaaactaacttgcttaattgcagagtagcaaagcataatcctaaaaggaaaatgattttctatgtttggacaaagaagataatatagttttataatttctctgtacccttagaatgtcctcaattacacaaaactagaactttattaatttttattaattgatgaggcaaacctgcctaataaaatttaaatctatttttctcaagcctatatttcagcacaatctcttactaactttcttgtttcttcttaatgagggagaagacagaaataaataggagataacaaaaaaaattttgcttagatgcctccatagtccctttcctcaaaatctaagaatctgtaaatagtgtcttggcagaacttcacacttttttaaaaaagcaagcagcaatctattctactgtaaacccaaaaggtatagagacattgtgaaataaccaaacccccaaaacccacttagctacaaggccatttcctgagcagaccactcaagcaagcaaaaaacaaactgaagaagaaaacaaaaaactttaattattttttttgttttgggtttttttgtttgtttgtttgttttgttttgagacagggtcttgctatgttacccagactagtctggaactcctgggctcaagtgatccttccacttcagacttccaagtagctggagctattattttttttttaaaaaaataagctactacttaatttatcacacttccttctacagagcacaatgctttttgatgaagattgtgttgactcatttgtatcttgcgggaagataaagagctggggaggggaaacaagacatgcagtaaaggttggcaaatacctaaaagagtttcagaatttatgatgaatcatttaaaccagtctggcataaaacctaagtgaacacaattccatgcaataaaaaaagactcacaaacattttgccagaaccatcaagtaaattgtgggaagtaaattgtggataagcacctgaagaggagtgacaaggccacatctcactgctgcctcatgtggctgtagtgcttggtcagaaggaagaacacaacagagaagagtgctggtcaccatgtcacctgttccaagaagaggggagtatgctagtttaaggggaaatatcagtatcacagaggtcaggaattagattacaataaacattaattgaggagaatttcagggaagactacaagggtaagataaactattcaataggaaaaacattcaggattctcagaacatccttctgtcttttagatgagggggagacatgttttaccctggagaagatacttacccaaccttagctttagtttcactactcttgcctttccctacattccagggtcattgatttgatatgggatatatatactgtctgtgaaacattcagtcctttgtaagcattcttttgatcaccaaggcctattggaaatttctcctcaatgtcttttagattcaacctgtcttttccattcccacttagccccattcccactttcacacccggattcctatagcaataaacttagagtatcttcctatctatatgtttccattctagtatctcctgttaaccaaggctggatgaaagttcttaaaactgcactttaatgctaaagaatcagaatagttattgatgatctacgggaacaagtccagattccttagcttgtcaccaagcccctccctgtcaactatccccacccaacctatccaagcacatcacctacagacctcgttcgttctactaccacttttttctacttctcacctttacccctaagtttcaccacaatgaaaataaaaccataaagctcaatttttcttcaaaaatcttgcccctaactctgtttcgccatgatcttcccttagtctgaatctcttcaatataaatctgtatattcagctatagaagttttcatttattcaatttccttgtctcctataagtttatttaagagtttattcaaaagatgtcccctgtattttcagatttatcaaaggcaatgatagtgtattctatgcgtttgtataacccacagtgcttaacatggtcttgagtatacctaaaaataagtctgttgtgataaagtagctaatgtggttacgctttggtgagggatctactctcacttggttactcattatatcaattactccaagtctcttgtctggcacagtctgtgcttcttgtctctagctaggcactttcattatgccaggagcagatgggccttcctacatggaggcacaggaacctggcaaagggtactttcctgaatgctgctgcccaagcagcagggctattattatgaaaggaatggtgtcaatactgagcttcagagtccatctctgaagaactgcaatggccagaaataaatgacctcctttatctctagagtaggcttgtttttccttttataaatgaacacagaagaggcttataaaatacctttaacgaagcttgtttgattttctcatgttttcacatcatcccgggtaggaaaagtccccctacccatctttcaatctactgcttgtcactacagcattctgagacttcactaagtccttcagttcacctgctgcagacttcatagtcaacctcccactacacagggaagcatactctgcctttggtttcaaaatcctcaagaagcaaaggtcaaccaataacttgcaattgaagttttttttttttttttggagacagagttttgctgttgtcacccaggctggtgtgcaatggtgctatctcggctcactgcaacctccgcctcctgggttcaagcaattcttctgcgtcagcctcctgagtggctgggatgacaggcatgtgccaccacgcccagctaatttttgtattattagtagagatggggtttcaccatgttggccaagctggtcttgaactcctgacctcaggtgatccacccgccttggcctcccaaaagtgctgagattacaggcgtgagccaccgagcccagcctgaagcattttttttttaaaataaagagcatcaggactcttaaagcttagcatccttttcaaatataatcaaacttgaagtctcatctgagtcaatcagctattcattcatttaatgaatatttttaatatcgatgtacatgccagataatgaagaggaggggtgttacagaagtatacaacaaattgtatcattcagcaatcctttatcctagtggggaagatgactatacagataattacaacttaaggccattttttggataagaaacataaaagtggtacaaacaaaagttcaaggaggcaaagaccacttcttattctggttatatggatagccttcatggagaaggcttcatgacagttgggttgggtcttgaagatgtctacaggtagagcctcagaaaaaggaatatgaaacatagggaacagtaggaggagggcagctttagtgactggctcggttatactagagcattgggattgtagaggagaatcatgattgattaaggctatatagggcagttagggccagatactgggggaatttgaatatcagactgttatttgatgaacagtagggagcagctgaaggttttttttttttttttaaaaaaaacaaccttattaaggtagtgctgatgtacaataaactacacatttcaaagtatgcagtttgataagttggtgtgaaatcatcacccataaaatcactacaatcaagataatgaacatgtctaatcacactcaaaagttccactgaaggactttaagagaatggcattcaaagcaatgcttttggaaagttatttcttgatttaaaaaataaatgcccccttctgataagatgtttaagtcttgtaatcttcattggtatgttaaatttaaaaatgaatgataccatatctaaaaatgaatcaaaataatagacaaagaaaccacagctttgatcaatctgatggcagtatataggacagactggaatggagcaggaacagaacaatctattgaaagcctaagtaggaggctttattaatagtccaggcagttgctaataaatctggtagaagaaccaggacaaaaatgaagtaacaaatgagaaaaactagttgggtgagttggactggagagagagagacaaggtaaaaatgactgaggttttgagctagttgtatcgcaaacagggagagtatggggataagaaaggtacacataaataaataataagcatctgtgggtatggaattgagaagggaaataaatcatatttaggaatcactcacattgatgtgaaagtaaagccattaagagtggtttgcatctgtgagagacagggttaatggagagagaaaaaagtcaagctagaaccttatgaactgcataacacagaattccaaattgctaatggcacagtgtttaaaatattccaagtactcaccctttacaaaatgtatttgttttatttatctctcacaaaaatcttattaataagttaccaaatcatctctattttacaaatgtagaaactaaggtacagaagaattatgtctcttgcccaatgtcacataattagcctatggtgaaactaaagtgttaaaatcaggcaatctgaatccatttttaattcctgggttacaatgtcttcttcctgcagcccaatcacttaagctctcctaagatagagtctcttaaaatacacaacacctaggccagagctgcttaacgcatttgcctagtataatccccgtgggcaccatatcttcaaatctcaagataatgcagtatacttggaactgttttatgagcaacataggataaaactgggagctggaattattcaatttagattgaatttgctgaaacttagttcaaatgcatagacagaagtttatttcataaaacagaatagcaacaaagtaaaaattttgattttgcctatgaagtcaaataccacaaaactcatcatcttgagtttatagtaacataagggacaaaggagtacaagtttcttaactggtagccaaaaatataatttctactaaagagaaacaggacacatcatttatggattactaacttgttgtgatttaactaggaatagaggaaaaagcataactttatttattttctttttttttttttagacagtttcgcttttgtagcccaggctggagtgcaatggcgcgaactcagctcacagcaacctccgcctcccaggttcaagtgattctcctgcctcagcctcctgagtagctggcattacaggcacgtgccaccaagcctggctaattttttgtatttttagcagagacagggtttcaccatgttggccaggctggtctcaaactcctaacctcaggtgatccacccgccttggcctcccaaagtgctgggattacaggcatgagccactgcgccaggacaaagcataactttaaaaagcaaaaatgtattaacagcactacatatttacttctctgcatttagaggagatacatagatggctggctgatagaggggaagtggttagctttgttaaactttagccaaagttattaatgctgcttttcatgaatcactgtagcaatgcctttcttcttgatatttaggaaagtagtctggtttttggagtctctacctgatgactgcctactaatctattagatcattaaggactattttgagatacaagatcatacaaatcataagctttgcttccaatcactctcacttgtagggccagagaaatggactactcaggagctacagagctctctgattggctgaagacccagagaaactgtggattatgcaagaactaacaaacatatggagactaagttcccaaagaagagttaaatatctttgagtttaaaccctatctacagctgtgtttgctggaattgtcaggactgtaatagagtttcagttaccaaggagaaatgttgatttagagaaggggtcagccaactttttctgtaaagggccagctagtaaatattttggacttaaccagccatatggtcttctataatcattcaactctgccattgtagcacaaaagcggccatggacaatatgtaaacaagtgaatgttgctctattccaataaaactttatttacaaaataagacagcaagccagatttgacgcgtgggttgtaatttatcaatctattctctatagtgatggctgtcacactctatatgtacatcagaatcacctatggaactagtttaaaaggtaggttcctaggctccagcctacccctacagaatcagaatctctaggaatgcgaatcagcaattcaataaggtccacaagtggtgtgtgaaccacacttttaaagctttgtgttatgcagctagcttcatctaagctggggtggccttgctgtcctagatgtgggccagcacttcctgcatcctgtggcagtaaaaatggagtaacttttattttctttgaccttcctagtagaaacaactgtttttgtttgtttgtttgttttttgcttccaacctctaaaatgcataaaatagtccttctcaggtgaaattaacatgaagtttagggatgattttgaatgaaaatgctcaacttaaaataacaagattttaggccgggcgtggtggctcacgcctgtaatcccagcactttgggaggccaaggcgggcgaatcacgaggtcaggagatccagaccatcctggctaacacggcgaaacctcatctctactaaaaatacaaaaaattagccgggcgtgatggcgggctcctgtagtcccagctactcaggaggctgaggcaggagaatggagtgaaaccgggaggtggagcttgcagtgagctgagatcgcaccactgcactccagcctgggtgacagagtgagactacgtctaaaaaaaaaaaaacaagatttttcaaccaaaaagcttcctgaaatcctttaaattgcaaaattagtaggcacaattcttaccaaaagacagggctacatctgaagaaatagtttccattgttctccctttctctcaaaatacctccagcaaaggcctgccctgttgcttataattccactactaacaagtcattactttgtgtctaggggtctttgcttcaacagaacctcattaaaactcatgtgaaaacagaaagtagaaaatctctgtggtttgcattaagttgacaaaacaaaacaaaacaaaaaccaactctgcaggcctctggcagctgctcccaactttaacaatcagtaaaaaataacttattcagctaagttcagttctgataaaatgaaaaaagtgcttttttatttgtttgtttgaattcccaggaatcaatcacccaatcagtcaacaaggaagtgatgttcagtctcgtgaatagctccaactcttcagctctccagattttcctagggaagacagagaaaatcctacagtcaaaggaattgctttcaggaacttcctaagaaaccaggaaatgatctgcagatagctccaggaaatgtagctcttattaaggctttcactgaccctgtaaatggaaaggagtgctctatgacagcataagttctgatgattactaaaacatgggcttagaataccttatatagttaccactacagcaaagactgttttttcttagatactattaaggtgattctgacttccctaacacacacatagagaagttaggaaaaaaagacccagaaatttacaaaggaacggagtgaagccaggctgaaattagaactctatcatgaatatactttatagatgattatgtgtaggaaatgaagattagctttacagtagtcagcagtcaatatttaaggtagcatgactcgagtccaacatccacaggctgagcttctgtctgctccatttttccatggcaagaaaatctaggcattttcagcaaaatagggaagcctgttttcctgttggtttccaatttacaaaaagggtcatgaattggaatccc

SEQ ID NO: 546 - DNA, 109844 bp, Homo sapiens
aattttctttcctgttttgcagtattttaccacctgcgatgtcctgcacgtgtccataggtcaaattaaaaagttttgttatcttaacaatattaattctctaattcatagacatagaatgtctttccatttatttaagtcatctttaatttttctaaacaatattcattgcttctagcataaacatttttcagctcctttgttaaatttattcataagtatttttgttaaatttactcaaagtattttattcttttttgatggtaatagagtcatttccttgatttttttcattttgcttattactagtttataggagtataattgaatcttatatattgatgtcatatttctgcaatgttattgaacttgtttattatttctagtagttgttagtggggttcttaagacttcctctatataagatcatggttttcttcaaacagaaataactttacttcctttccaaactgaacaaactgaatgcttttttttttcattttcttgccttattgcatggctagaacttccatcacgtaactgaagtgttgagagtgggcatccttgttttgctcctgatcttaagggcaaaacattgttttacaatattaaatgattatattagctttgggttttacataagcgccattttcaagttgagaaaatgtccctctatttctaatttgttgagagttttcattgtgaaaagatgttaaattttgacaaatgcaatttccacatatttaagataattttgtgagttttttgccctttattctattgatattgtgtattatattaactgactttaagatgtaaaaccaacttttcagtcttgggataaatttcacttggctgtgcatatatcatatatatgttgctgtgtcctgtttgctagtattaattgaagatttttggatctatattcataagagatattggtctttgattgtagtatatttgactgatttgggtattagagtaatactggcctcatggagtttgtttgaaagtgttcccttttcctgtgttctttgggggagtttgcagcagttctagaagggaggtttatagcaaaaaaaaaaacacatcaaaaaaagaaagatttcaaataacctaaagttacacctcaaggaactagaagaagaagaacaaaccaagcacaaagttaatggaaggaaggacatactaaagaacagagcagaaataaaagtaatagaaactagatcaacagtagaaaagatcaactaagagttggtttcttgaaaaaaaaaacacaattgcaaaccttcagctggactaagaaaaaaagcctcaaataaataaaatcagaaacgatagaggatatattaaaactgataccacagaaatgcaaaggatcataggaaactactatggacaattttataccaacaaataggataacctagaaggaatggatacgttcctagacacatacaacctaccaagatttaattacaacaaaatagagtatcttaagcccagctgaattctaccaaacatttcaagaagaactatcagtcttctcaaaactttccaaaatagttaagaagaggcaacactttcaaactcatttttcaaggccagtttgatcctgatattaaagctttatgaggatactacaagaaaataaaactacaggtcaatattcctcatgaacatagatgcaaaaatcctaaaaatatatagctaactgggctgggcataatggctcacacctgtaatcccagacagggtttcaccatgttggccaggctggtctcgaactcctgacctcaggtgatccacctgcctcaacctcccaaagtgctcggattacaggcataaaccacaacacctggcaatttctgccttttgatcaggtttttagactaattttaaagtgaatatatttctctcagtcagctccctaagcatgaaagagtacattgtgacaaaatttatccttaccaagtgtgtatggtatactagtgctgcttaatattatagctaaaaaactgttatatttttgttttgctttactactacaggaagccttgaacctattttgtttttgatgttatacaataaagtgatatgaactttaaactatattattacaaagtagacgctgcttttgctctccagccaggatactttaacatctgtctcaactttccttgcacaaaagaatattaaaaatgtgttttgagaatgaaaatagctgctataataggcttaacaagtcaatgttggattttttcaaatatctcaattgcagaagcagaaaagtagtgtcatgttgatgtagaagataacacatatactatatgtatttatctttccctacaaattttcaatctgattattgggttcttagttattgaatattgattccccttgcttgcttctatttttaatgtttgttgataactaacctcaagtatagactggatttctgttccagtctcagtacacagtcaagcatgcaaagcccagtgtccatgcccagtctctactttggaaaaggggcagccccctgagctctgtgatactcccagacatacccattatctgtcttggcctttctactccacaggtaatttaggattttgtgctagtgtgtttgttgtaggcctgagatttgcatgtgttttggcgtgggggttgggggagggtaagggcaaatctgatggtttgttgatactatcaaaaagaaacaagctcacttacgttcctaatcccagtctttggaaacttaaaactgtatagattctttgtagacctacatcaacaagaccacttttctgcttttgcaattgagatatttcatgatcatactatttaaatggctgtaacagaggtctttattttttgtctggttgttctagtgtcatagcgtttgcaaaaaatatttgaagatggtgaaagtgttgtgggtggcctcccaaaattatagctggttttgaaactaccactgttgctgctacccatagagcatcttgctacttggaacactgccgagggcttcgagtcaacatgacttcatatttaaaggtcagctcaggtttttggaagtcaagccactccattttggactgccatccgcaaccctgaagccagtgtggtgtgctggctcctgtaatttcctagctgttaatgtaatgacacatggcttccaactgtgcttcagtaaattgcttcttcttaagatcctttaccattcttggatctcatagtgcacacatatttcagttttaaagcaaaaagaaaaggaagaaagaaaaaaattctatcttattgcctgaaggtaattgtgtaaaagagccattcccgcatcgtgatacaaagactggctcatatttcatgctgatttcttccctttgctcacacaggaatctccagcagtgacaagaagaacacatgaatatttcatctataatcaagaaagttagtttatacattaaacactttcaggagatacatattttatatgtctaattaataaatttaacatccatttagtccaacaaaatcagtttagaagaccaaaatactctattgtggccttcgtcacttacaaataggaagtgattaaataaacgaatacattatttataaaattttctcttcaagattgcagaaaactcactcataccatgggaattctttgaataaaaatataattcgtatcttttccatagcctactatcatggatatatatttgtcaggagaaatgattttagttaacttatgcaaatatgaactgtttttaagaagaatggatgagagcaaaagaaaatttaaataattcataaatgtcagagttttacagaaaccaaatgaaggattttaacatgagggaaatgagaagatagtggattccattaaaagagacgtgtactaaaagtgactggggagaaatctgattcttgcaacccaaactgctttaaatttttcaacatgccatcagtcacaatatataaaccaaagaatctactcctaagaattggtttatttactggccctgttttcacataacagtaattaaacccatttataataaatatgaaaggatttggaactatttgcagcaactaatgtaaacagtgttctttacaaaaataaagacaaaataaagaattcatggagatccagatgcctggattttctaatctggattattttaatggagtgaagaaatcataactgtattttgtcacgggaggagagtgcagaaggatcttaaccaaatgtttaggatttgcttttgcagttttgtaaaatataaaatgtataatttatgcattaaaaatatgtagttggtcaccagggacagcggctcatgcctgtaatcccagcactttgggagaccaaggcaggcagatcatttgaggtcaagagttcgagaccagcctgccaacatggtgaaacaccgtctctactaaaaattcaaaaattagctggacttgttggtgcgtgcctgtaatcccagctacttgggaagctgaggcaggagaatcacttgaacctgggggatggaggttgctgtgagccgagatcatgcccctgcactccagcctgggtgacagtgcctcaaaaaaaattaaactaaaaaaaatgaaaagaaatgcagtttgagtggaggtaggagaaaggtcagacaagactctgggactatatatatacacacacaaatatatacaagcatatacacatgcatacacaaatacatatatgtacatgatacacacatacactgtgtgtatgtatattccaaagaaactttgcttctgtgacagtatcagtcaaataagttggtttgcatgactcttctatttcatttaaacttcaaatcctttgagagcttaggaggacatcctttacattttctgctgcttaacatctgaggcaacatgatattcagtactcttaagaagcagtgttgctttctttcaaggtatatgactgacttttaacatacggtcccatgccacaaggccgtgactatacatactggttataaaacaggcagtatacattttggccaacattatgctctttttgtttttttttttgttttttgagacggagtctcgctcagtcacccgggttggagtgcagtggcacgatctcggctcactgcaagctccacctcctgggttcaagccattctcctgcctcagcctcccaagttgctgggactagaggcaccggccaccatgctgggctaattttttatatttttttgtagagatggggtttctccgtgttagccaggatgttctcgatctcctgatctcatgatctgccctcttcggcctcccaaagtgctgagattataggcctgagccaccgcgctccacgtttttttttttttttttagaaggtgtcttactctgtcactcaggctggagtgcagtggcacaatctcggctcactgcaacctccgcctcctgagttcaagtgattctcttgtctcagcctcccgagtagcagggattacaggtgtgctccaccatgcctggctaatttttgtaattttagtagagacgggactttgccatgttggccaggctggtctcaaactcctgaccttgggtgatccacctgtctcggcctcccaaagtgttgggattacaggtgtgagccactgtgcccggcctcatgctctctttttttaaagatactatttcaaatgccttgtcattcccaatagtggtgatatctcaatagacgggtgattcctaagccgtcatcaactagaaggctctacttaggtgttttttccccactgggtatttttataaccctccactgctagtgcagaggggagacagtgactaaaggactgtcaccttctttccaaaatgttctaagattcaagcttatttctcacattttccattactcccttccaccccaaacgcctacggtggcgcggcctatgcatcagagtcctgtgtgccaagtgttctgtgcttacctgtggtcagagagaactgcagaggctaaaaatagaaatcattcagatatgatcaaagtgaactaatgctcatcactcaattatacttcacaattataactgctttccacaagttttgatatatatattttttttactttttagttttgggttcagtctaaatattttataatttccattctaatctctttttttatgaaagtgtattttttatgaaagtgtatgtatatgctatcattttgttaattattagttttctattttgattgtatttgttatgaagtaacatacaatgtaaaataccacttggtcactgaaatttgttaaaatacaaagtgcagcacagggtcagtttttcaaaatgtttcttattttccaccagctccattccttctcttagtatccttcagaattttttactatcttaaaatcttggggtgctcataatcctgtttgttgtgactcttgattaatctgtgtgatgtgccatttcctcatatggtttgtgatttctttattgggacagggcaactgttcacatccgtttcctagcttgggatttccaaactttaaggctagtgtcaatttggttgcagacttccacaggccatgagataagagtttcttctatcccaagctggaatagaaaggaccttctctgcagcatccctggactggagatcagattttccaggtatcctccatgggaaggacgtcctaaggaagcaacttggtttatgctcatagtgttgtcctggccccaggctgcaccatccaatcccgagtgtgaatttaaaacaccagcctcaactttactgggccctatatctgactttattttgcccctggcttgccttttatatctcttgatttaggttccttctgttataaaactcagagattttctgtgtttttttctctcatattgaattacatatttcatgttctgtatcacattttgttcagcattttagaaatgtgaaacagaacaggattctggttagttcagttttccatgtcattagaaatttggggcatgggtttaaaacataaaacgtagtcttgcaggctctttgcacttctagtgtctgggctttgatttaacactggccactagggctccttgtctttactgtgcttggttcattaccatgatcaaattggaatgttctccagattcatcagcatagatctgtgtggctccagcctgctccttcagctctgcctccatgctctgtccttcagagttactggcacatccagttcatgtgttttagctttatacattttttctttcttttgtgggcaaacaatatcatattgtcaatcacatattccattccctgacagctagtcatgttgtttctttcacatgcttttccaaaaaacagattacttgatactttccacttctaaacaattctaaatttctaaaaatccaggttcttttctaacttgacttagttccttttctctcaagatatcattaccacttcacatgtgtaagtcttatcagattacgtagcctttacccagctcatttattttgatgtggtactttctttaacaatctgattaatggaaatttctactacacacacacaaaggcacatacacacatatacatacacacacacacacacacacaacctaaaactaaaaataatcattgcacttagactggagaaatgaagggcagggtatatatatccttgggaaatacttgaaatttttaccatttgcaatattattttcaagaataaaaacattaaaaacatagacaaataagtgttgtaaagtaaaatatacaaagcaaaaagcaatttatatgactaaattataatgatgtctataaagttggctgaattttcaagttttcttgtcaatcgacatacagtttttaaaatcctcatgtagtcaatccagttctattttaaatgataatttcattctgttattttaatatttgtttatgttatatgagccagtcatattaaccatgtgacatccaagttaacatgtggtcagtgtgtaaaaaataaaatgagcaatcacataggtcttgcttaaatggcagtaagatgaaacaacggcaaatgaatattatgagaaaactaaacttaaaagttcgttcgtaattgtcattttttgtttgtttgtttgtttgtttgtttgttgagacggagtctcgctctgtcgcccaggctggagtgcagtggcgtgatctcagctcactgtaagctccgcctcccaggttcacgccattctcctgcctcagcctccccagcagctgggactaccagcgcacaccaccacgcctggctaattttttgtatttgtagtagagacggggtttcaccatgttagccaggatggtctcgatctcctgaccttgtgatctgcccgcctcggactcccaaagtgctggtattacaggtgtgagccaccgtgcccggccagtaattgtcatttgttactgtcatctgcaggtaagcttactgtgactgtttctgagaaacacattacacttacattcataagatttagctgcatttcacaatgttgggccttaaaaggccaccaaatgtcaagcatctgagatttgttaggttttatcttttaaaacttagtataattaaaaattattttggattttgaaaggccatgaaatatgaaacttttatggcatattaggatttatcctttgaaacctttttagtaaaaattaatttggatcttgggaatcattaacacattttaaaacgatgaaatacactacaaactctagaaacatctttcctcattcatgatacaaaagccaccagaatattttctctaaaactaatactgcattttacaaaaggactctaaatattgggaaatgatgcctatttttaaaagtttattttgtaattgaaaaacagtagcactctctcttcgaggccctctcttggcaggacactacatgaaatctttccttaaagggtttggctgtcatggtggcttatgcttgtaattccagtgctttgggaggctgaggagggaggacagcttgaggccagaagtttgagatctgcctggggaacacagtgaaaccctatttctacaaaattaaaaaaaaaaaaacaattagttggacatggtgacgtgcacctgtagtcccacctactcaagaggctgagatgagactattgcttgagcccaggaggtgaagctgcagtgagccgtgaaggcaccactgcactgcactccagcctgggtgacagagtgagaccttgtctcaaaaaaaaaaaaaaaaagtcttggcacaaagtattctttaaaaagatctatcaaccccacatatgggtacatatttttatatcagattttaaaggctctgatctaatatgaagtgaaaatcacctaaattacttaatactcaattctgagtataaatacacttgtctatggggttctgtgtcaaatgctgtaagaaagtgcccaaattagaagaaccccacagtaacaccttttgtaaaagtcagaaacactttcaagtctgcttatagtaaattcagattgctcctgaatttcaggcttggttatatttcaattttgacatctcaggaatggcaataatgccaagtaagaggaaggtggatattgagcagttctactttaaagtctctttctctcagagagtttgcatttttcagccacatgcagaactaacaagctccctaaaataatgatattccttcactgactttttccttatgtccgaggacttagcgactaatgatggttaagataagtgccttcccagcaaagtctgacaattgtctaggttgtagatctgagaaaggggggtcagtggggagaacagcatcacaacattgtcacgaatgtatcacagacccttccagatgttttctgtaagtgcaaaactcattatttcaaaattcctgcagatatgaaaccttgaaacctctctgaattccaaaattagagattttccacaatactcatatattttttaaatattccatgatattctttttatttccaggtgtggcatataaaactgacagcttacagtaagaaatatttcttatgatcaaacacttcatatgcactttattgcttttagttttgaattatttcaaggtatgttagaaaatgaaaaaataaaagatcgtaagtatatgtaagattagatgaactaagttgcttaagtcagtggtttccatatcaacaatgtgactacaagttaaaagttctgaagtcctaaatgtctcttcctgagaaatttcccatttggggctcaacagcacaaaacttttattagcgcttctctggggaatcacttggcattcctcggtctctgcaaactggacagcaggttcctttcaccaattcaggactgggacagggagccgggggacaaatctccaccacacaggtgacctggccactctgaaaggcagcatgcacatatcacctccatgtttcttataatcaaagtacttaaaagacaaataaatgtttcttataatacataatctaataagctgactgtctcaatataataaaaaatgctcatagtatgagctcatttttgcatggtttctattcattctttctttctatacatttgcagcacgaacagcaagcctgccctataaaatgttacctaccttactgtaccatatggtaggattagctgaggaagttcatgcatttctacatggctggaaagaatcagctctgttcaaaaagcaaactaaataacgaatacagagcatttttattttcttttgttttggtagacaccatgataacacttttttatttttccatagaattgtgtaggtttaccaagtgcctttaggcagcatttataatgagcctgactgaagaataatgagatgaactcaagtcccaggttggctcagtttacttactgacataaacttccttagccttggttccctcgtccatcagtgaacatggaaaaagctcgtggtctctagcgactgctcattagattgtgactatactcttttattaataagcaaaagcctcaaaatttcacaccagtaccttgatcttaaaaatatgcctagaatctattgacataaaatatattttttctccttttgaatttttcaagtatgcttcaactggctggctagaagtgaaatggggagttggactggaaaactcgcagcacaaacctcacaaatgcagtgagtgcagtcttctttcatccagcgctcctcggccttccttggaacccctctaacatctgtacaccctgcctgcctcaggcgtgcctccagcttgtttatctgaaaggggaggcaaaggaaagaagagtggaaattgaagcggatagcaacaaagccaatcaataacatggtttgatgaaatgctctattctgtaagcacacacctagaaggcaaaagaaacttcaaagcctacataatttttcattttcccccaggacttaatgagcttgaatcatccagtatccaaacaaataaacagttctgtaggtgttaaaaaatattgaacatggacctagagtatgaaagagttaatttctaaaggaaggggaattaaaatcaaatgaatgaaattacatatttggaaaatcttctcaataagcacacttgtaaattcaactaataagtattttatttattttttgtcccccaagttgttataaaataatatttatttaacaaatatttattaagtttcaaagatgaaagcaagcagaccagggtctctccaactttacaatttggtataaaggccaataaaccacagctataagcctttagataataacggtctttaggaatcccaaggggagcagaagggcagttgatatggtttggctttgtgtccccacccaatctcatgttgaattgtaattccaaatgctgggggagggacctagtgggaggtgattggatcttgggggcagatttcccccatgctgttctcggggtagtgaattctcatgagatctgatggtttaaaggtgtgtggcagttcctcccccatttgctctctctctcctgctgccatgtgaagaaggtgcttgcttcccctttgccttccaccatgattgtaagcttcctgaggcctcccagtcatgcttcctgttaaccctatggaactgtaagtcaactaaacctattttcttcataaattgcccagtgtcaggtagttctttatagcagtgtgagaatgaactaacacagaagccacactcagttctgcctcagggaatgaggggatgcctgatattatggactgaactgtgttcccccaaaattcataagttgaagccgtaatccccaatgtgactatatttgggcatagggcctcgaaggatgtaattaaggttaaattaggtcatgggagtggggctctaacccaataacattggtgtccttgtaaaaaagaggaagagacaccagatgtgctcacacagcgaaggccatgtgaggacacagggagaaggtggccatcagcaagccaaggcgtgaggccttggaagaaaccatccctgctgacactttgatcgtggactttcagcctccagaactgtgaaaaaacaaactgttttaagttacccattttcttgtattctgctatggtgcctgagcagactaatatatgatatatggaaaaaagcatttgagctgtgagagatgaccatgtctttcaggagaacaagcagggaaaaggcatttcaggcaaatggaaaaaaaaaaatatgtgttaaagcatgggtaccagaaacagatcagtatttcagaaatgtacatttctctcccctcctttgttggggagatctacagagaacatgttagtgggaactgaggtgggatgagtgggcagcaaagaaaattaggcccttaaaagtcacataaattaattaagtgcagtctccaggcaatgggaaataacatcacaatgatcactcctgtggcaacatgaaggatcactggtgagaaactaacatggagaccaatatgggctccactgaggaaggagggagtgagacaaaaagagccatgtagcaggtagaggagattggctagatgtgggtttaaggagaagaggagaacccaaaaaatcacgatgaactcagacttcatttagaaagcaaaaagtcttgatgtgaaagaattttgattctgtaaattcttttcactgcttttgtattgaagtaggacaggagggttggttcttggaagataatttagcatgagtgcctacacttgggcagtggcatccacccattcattactcaatagatatattcagtacctgatatgtaccagctaatacactaataaactagcaggacttgacccctgactttaggtgagcagtgagaatggagaggatgataagacaaatattacaatgcaggcttgaatgacaaggcttcacaataaccagatgtgaaccaaataatccattcttgagtggggtcatgggtttgaagtatgaaaatcacaaaaaaatctctaaagatattaatgaatatgtcctagcagactaggacatatagaaaacttttatgtccaaaaacactgggaaaatgcatatctattctaaactttaggcacttaggacagtaaagctttttcaaatttaaataagctaacaaattaataaattatttaagggaaatagttttgctttttttgttttgttttgttttttgagacagtctcgctctgtcacccaggctggagtgtagtggcaccatcatggctcactgtatcctcaacctcctgggcttaagtgatcatccctcctcagcctcccaggtagctggaaccactggtgtatgccaccacgtccagctaattttttgttgttgctgttgttttgtaaagatggggtctcgctatattacccaggctgatcctaaactcctgggctcaagcaatcactctgtcttggcttcccaaagtgctgggattacaggcttaaaccaccacaccctgctctaagaagggaaataaatagtttaagaatcttgtatgtaccagggctgggtgcggtggctcatgcttataatctcagcactttgggaggctgaggcagggggatcacctgaggtcagaagttcaagaccagccgggtcaacatggtgaaaccctgtctctactaaatatacaagaaaattagccgggcgtagtggtgggtgcctgtaatcccagctactcgggaggctgaggcaggataatcatttgaacccaagaggtagaagttgcagtgagccaagatcatgccattgcactccagcctgggtgacaagagcaaaacttcatctcaaaaaaaataaaataaaataaaataaaaaaataaaaaaaaaaagaatcttgtacgggtcattagtataagaaatacagtgcgtggcacttttattccaggcttaactaaaaagtcttgataataaaaggatgtaactttccttttcctatcacccatgtgttcattgttagtatacagaaatgccattaattttttctacgtttatcttgggtttatgttgtatcctgtaaccttgctcaactcatgtattcattttaggagtatttttgtagattccttgagattttctatgtaggcagctgtatcatctgaaaatagttttatttcttccttttcaatctataggccttttcattttcttgacttattgcactggcaagaacttccagcattaggttgaataagagtggtgagaatggacatccttgccttgtttgcaataccttgcagttttatggggaaagcattcaagcattcaccattcagcatgtaaatggcagggtaatgtttctcttttgctgctttcaaaatgttttcctttttattttgttgtcaaaagtgtgactatgatgtgtcttggtgtgcatttctttggaattgtccttcccttctctcttctttctatccaagacctgaatgacacaaatgttggatgttttattataatcccacaggcttctgaggctctgctcatcttgtttttgtctatgctgtctctgttgttgagaatgtataattgctagtcttctatcttccagttcactgattctttcccctctgatccatattccgttttgagcccatcaactgatcttttttatttctgttattgtagttttcagttccaaaatctccatcttgtttccctttgtgtcttgtattactttgatgaaaattttcatccatttttcatttgtttccagtgtgtttgaaattgctcattgaagcattttttatgactgctttatttatttatttgtttgtttattttgagacagagtctcactctgttgcccaggctggagtgcagtggtgtgatcttggctccctgcaacctcctgcctcagcctcctgagtagctaggattacaggcatgcaccaccacacccggctaatttttgtatttttagtagagatggggtttcaccatgttggtcagactgatctcaaactcctgaccttgtgatccacccgcctcagcctcccaaaatgctaggattacaggtgtgagccactgcacccagcttatgactgctttgaaatctttttcagataactgcaacacctctatcacttcagtgttgattgcctgttttcattccatttgggatcttcttggttcttggtatgatgaataatttcgtattgaaacctggaggttttggatcttacttaagccttctggtttaggtgttttcctctgaaactgctctggcatgggaagaggggtcccacatcattactgccatgtgggaatagaagtccaggttccctccttggcctccgttgacacacaaaggggttctcttcattactgctgggtagagttggggttctggctccctgtcaggccacctcataaccctcctggatgggaggcatagtattctgtgacttctcccgacatggcctccatgcacctcaggatggtgaggggcagggcagcctcatcaccccctggtaaatggagagcacctggaacctccactaggccttctctgcaaccaccccagtgaagagggaggggagcttcattcctgctgggttaggacggaagcccaggctccccttatgaccccaagtttttgcatgcaatcatctggcatgatgaccccctagtttcctacttggctttctcggacagcagcctcaaggtgtccttaggtgcctcagtataccctggggagagtgaaagccacctcctcacttggcctttgctggtcttgctggaggtgggggccacagtttcttctgtgctgtttggctggggtagagtggttattgtctagaagttacctgtattgctaggcctccacttttatggcctgttgtctagagggactcaggttttgttgggcctttttctgtgtctgttgatgtgctcaggttgctggcttcttcagtttcaagcctgagctacgtgaggaaaaactacccaggaaagagcatcacattgttcctggagcccaaggtccctgatcagtctgctttcttgctcttcaccattctgagtcatcttatgtttgttttaaacgtgatatccaggggttgtagctgtctatactataatcaagaggcgtctgtgtgcggtggctcatgcctgtagtcccagcactttgggaggctgaggcaggtggatcacttgaggtcaggatttcaagaccagcctggccaacatggtgaaaccccatctctgctaaaaatacaaaaattagccaagcgtggtggcaggcacctgtaatctgagctactcaggaggctgaagcacaagaatcgcttgaacctgcaaagcagaggttgcagtgagccgagattgcaccactgcattctagcctgggtgagtgagactcagtctcagaaaaaaagtaaaaataaaagaaaaataagcaggaggcaaaaatacatctactcggccttcccagaaatagaattctcattagacactatttcatgtaacatttttacttaatttattcaaactattgcagttttagatttcctaaggatatataatcaaaagtgtagccttctcagcctcactgcattccccaaaaagcagctgctgtgtcaaagtagataatactgacaatgattgcatcattgttctgcattccagaagtatccttatctgcatggttcctgcttggggttgagctgcatcactccccaaattcaaatcttgaggtcctaaccctctgtacctcagaatgtgatattttttggaaataggagtattgcagatgtaactagttatgataaagtcagagtagagtgagcccctacttcaatatgactgatgctctcataaacaaaggaaatctgaacacagattggcacacagggataatcccatgtgaacaaaaagacagagatctacaagccaaaaaacatcacattctgaggtactgtctaatgagacttctattgcctatctccttctgcaacaggaaggtatactccatttagagatgctccttcctctgggttggaagattgaaaaactgtggaggacagacacagctgaaccccaaagagcaagcaacgtgagtgaaaaacaatcctccttgttgccataaaccaagatttgggttgttactagagcataacttagcaaaacctgtctaattcatggcttaatctagaccaagccgctgtataaaacgccagtgaaagaaaaaactctcatcacaacaacaagaattaccaagttatcttcttcagtgatggccctgatacaatcatgtaagtgtcttttcactgggagctgtacggaaacagttacggaaaatttagaagagctttcttattaaccaattcatgttgctgaaaaccttttgtatgcaaaattaaaagggtaatggaaagtactgcagaattgtaactacataagcttgaactataaagtcaagagcactccaagactcaatgttgtaaagttcaatacttttgctcagtgtacttaagatgcatctccaaatgttttatgcaagagcatggcccataaacctgaagaaccacatctcctacaagataccaggacttttaaattggcaaagaagtctctttgtgttcagaaatatgagtaaaacataaagcaactccagcattagttccagcatgtggcaagcttgtaaatcatcactcccatcctcacgacaagaaaaattggacacactgaaaatcaataaatttcttagagagctaaggttgaagggcaaaccactaaggtgaaatctgaagagacaggaggataacaagagaggcagcaaccaagatctgcttacctgggacagactgactgagcattgagccatactggtgggaacaccctgatggttagttttatgagtcagctttgggagtgcttttggatgagattaacatttaaactggtgaattctgggtaaagcagattgccctccataatgtgggtgggcctcatccagtaaggtgaaggcctgaatagaacacaaatagcagcctcccagagcaagactgacttctccagcagatggccttccacttcatctgcaccatcagctgtcctgggtcttcagcctgtcaggccaagattttggactgtccagcctccataatggtgtgagccaatgccttttaatacacatatcagatggacagacagacatttcctattaattctagttctctggagaactctgactaatgcaaactcttaaatggtaaattttaagaagttgctggaggcttccttcacttttttgttccagtcaggccctgaacaaattgaagaatgcacccctacactggggaagggcacctgcttttctcagtccaccaattctaatgctaatctcttcagaaatactctcacagaaacatccagaaatattgtttaaccagatagctgggcatcccacgatccagaaattgacacataaaattaactatcacactcaaggtggcaggggaaagaatctgttgacctgaagatatgtcaatagtaacttcccgaactaaaatgcaaagagaaaactgagaatgaaaaactaacagaaaatctaagaactacagggcaatataaaaaatgtgagcatgacaaactactaggtgttactgtcttagtgaggtaaggtattcaagaagtttaccttaaggaaacttaagaggttctcattgaagagatccaagaaacagcccctcctggccctggcagcgggaggggaagatatccttcatgaaaaacacccaaagccttctccataaaaaaggcctctataccaagggaaaggaacttgccagggtacagtactaaatcctaaaacaaactgggaaaagggattctaactcactgcatcctactccaggcttcctgactcacttaatcaggaaaaagccaacagaaaaaccaggggtcagcccttcagtgaaatcaattagctgcacaccagccagggaaaggagtaggaggtggagaaaaggccacagtactggagcaatgcttgtgaaaatcatagcctcagaacataagcccactagaaagctgaggtttcatcagaggatgataaaatatttcccatccccacacctgaccagcacatcaacaggatgccagcataataacagtgattactgctgaagcagctgaaagacacagactctctctgaggaagaatacataagaaaggccaaagtcagtaggaaaaacaaaaacaaagacactggaggaatttaaagccatggcatctacagctacaggaaacactaaacacagcacaacagtcagccttttcaatacaaaaacctaaagcaaaggcttatcaactacagttcctattacccaagacatcatgtatggctttaaacaaaatttacaaggcgtgctccaaaggaagggaaaaaacacagttttaagaggcaaaacaagcatcagaagcagacccacatgagacacagatgttgaaattatctggcagggataaaaataactatgattaatacattcatgaccctagtagaaaaagtaggcaacattcaggaaaacatgggtaatgtaagtagagagataaaaatgcaaaagaagaattaaaagaaaatgttagaaatcaaaactataacagaaatgaagaatgccttcgatggcttcatcagtagacgtaatgtattagtcaagattctccagggaaataaaaccaataagacgtgaatataaagagatttactataaggaattggatccatgtttatggagattgagaagggccacaatcttctgtctgcaagctggagacccaggaatgtcactggtacagttcaaaggctggagagccagaggacaaatggtatagattagtctgagtctgaaggcctgagaaccaggagtgctgagggcaggagaggcttatgtcccaactcaagctgtcaggcacagttaattcaaccttcctccaattttttgttccattcaggcctgaacaaattgaaggatgcccccctacactgggaggggcacctgcttttcttagtccaccaattcaaatgctaatctcttcagaaacaccctcacagaaacatgaaaaatactgtttaaccagatagctgggcatcccatgatccagaatttgacacataaaattaactatcacactcaaggttgcaggggaaagaatctgttgacctgaagatatgtcaatagtaacttcccaaactaaaatgcaaagaaaaaactgagaatggaaaactaatataaaatctaagaactacagggcaatattaaaaaaaaaatgtggctattcagcatcccttataattccatatgaattttcgacaggctgtttcatttctgcaaaaacggtatcttagtttgctagggctgtcataacaaaataccacagattgggtagcctaaacaacagaaatttactttctcacagctctagaggctgaaagtccaaaatcaaggtgccagcagggttgatttcttctcaggcctttctcttggcttgcagatggttatcaactacattcacattatgaggtactggggattagaactcaacatgaaaatttgaggaaaagacacaatttagtccataacactacaccctttgaacccctaaaattcatgtctttctcacatgcaaaataatcaattcaccccattgcaatagcccctaaagtcttaatccattccaagcctcaaatctcattaaaatatcatctaaaccaattatgggtaagactagagtatgactgatcctgagagaaaattcctctcaatctgtgaacctgagaaaccaaacaagttatttgctttcagaatacaatggataaggacttccgatagatgatagcagacaggaggcaggactagattgcagatccggatactgcagcattgcggaggcttgcattgtgaaacttaactccagatcaactgcaagaacaaaccagcaatcccgagaggatccacagaccctctgcaggaagcagactgctcctgcaggacccaggagacaccccaaatactgtaagtgccccaactgcagaagtgggaaaaggaaaccctcctttcccggacacacacccccactggagaagcttaaggtctgtttgtgggagatgttcccgactttacctggagctgagttgagttagagagccaagccaagtgaaatacaggggtggaggaggcagcagggaggccctgggagctcactgaatccccaagcagccctttcctgcctgacactgcagggatccatcaggagagaggctggaggagcaggggataaaaccgcactggagagaaggacttccttagctgaactttgtaacaatttcagtggggacagaagcttcctagccagaactctggggagggcgtgaatccggcttacagacatcacaggcaggggaagaactaaagcccttttctttcgtagctgggaggcagaaagcctgaaagcttctggcaagttttcaagcctgccctccacctggaaacagactaggggctgttgcaggtgtcacggtgggaatgggaccggcccttcggtttgcatgggagctggatgaggcctgtgactgccggcttttcctcacttcctcgacaacctgcatgactcagcagaggcagccataatcctcctaggtactaggtacacaactccagtgacctgggaatctcatccccatcccccacagcagcgcagcaagactggcccaaggagagtctaagctcacacacgcctagcccggcccccaactgatggtccctccctacccaccctggtagtggaaaacaaaggacatataatcttggtagttctagggcccagtccctctctatactactacagctgatgctttctgcagagcaccacctcctggcaggaggtcaaccagcacaaaaatagaacattaaaccacccaagctaagaaacgtcatggaatccacttcaccctctgccacctccaccagaacaggtgctggcatccatggctgagagacccatagagagttcatatcacagatttctgtgcagaaaccaccaggaccagccaggagctgtgtagactcgctggatggctagacccagaagagagacaacaatcactgcagttcagctcacaggaagccacaaccatgggaaaagggggtgagtactacatcaagagaacaccctgtgggacaaaagaatctgaacaacagccttcagccctagaccttccctctgacagagcccactcaaatgagaaggaaccagaaaaccaaccctggtaatatgacaacacaaggctcatcaatgatcccaaaaatcacactagttcaccagcaaaggatccaaaccaagaagaaatccctgacttacgagaaaaagaattcaggaggttatttattaagctaatcagagagggaccagagaaaggcgaagctcaatgcaagagcttgtatcaaaaaaaaaaagatacaagaagtgaaaggagaaatattcaatgaaatagagtgcttaaagaaaaaaacaataaaaaattcaggaaactttggacacacttttagaaatgtgaaatgctctggaaagtctcagcaataaaattgaacaagtagaagaaagaaattcaggcctcgaagacaaggtctttgaactaacccaatccaacaaagacaaagaaaaaagaataagaaaatatgaacaaagcctccaataagtctgggattatgttatatgaccaaacctaagaataatcggtgttccttaggaagaagacaattctaaaagcttggaaaacatgtttgggggaataatcgaggaaaacttccccagccttgccagagacctagacgtgcaaatacaagaagcacaaagaacacctggggaattcattgcaaaaagatcttcacctaggcacattgtcatcaggttatccaaagttaagatgaaggaaagaatcttaagagctgtgagacagaagcaccaggtaacctgtaaaggaaaacctatcagattaacagcagacttctcagcagaaaccttacaggctagaagggagtaaggccctatcttcaacctcctcaaacaaaacaatcttcagccaagaattttgtaaacagcgaaactaagcaacatatatgaaggaaagatacagtcattttcaggcaaacaaatgctgaattcaccattaccaagccaccactacaagaactgccaaaaggagctcgaaatcttgaaacaaatcctggcaacacatcaaaacagaatctctttaaagcataaggcacacaggaccaataaaacaaaatataagttaaaaagtaaaagcaaaaaacaaagtatgcaggcaacaaagagcacaatgaatgcaacagtacctcacatttcaatactaacattgaatgtaaatgtactcaatgctccacttaaaagataaggaactgcagaatggataaaagctcaccaaccaactatctgctgccttcaggagactcacctcacacataaggactcacataaacttaaagtaaaggggtggaaaaaagcatttatgaaaatagacacccagacaaaacaaactttaaagcatcagtggttaaaagagacaaagagggacattatataacagtaaaaggccttgtccaacaggacaatatcacaatcctaaacatatatgcacctaacactggagctcccaaatttataaaacaattactaatagaccaaagaaatgagatagacagcaacacattaatactgggggacttcaatactctactgacagcactagacaggtcatcaagacagaaaatcaacaaggaaataatggatctaaactatgccttgtaacaaatggacataacagatatatacagaacactccattcaacaaccatagaatacacattctattcaacagcccatggaactttctccaagatagatcatatgataggccataaaatgagcctcaatgaatttaagaaaattgaaatcatatcaagcattctcgcagaccacagtggaataaaattggaaatcaattccaaaaggaaccctcaaaaccatggaaatacatggaaattaaataacctgctcttgattgagcattgagtcaaaaacaaaatcaagatggaaattaaaaaattcttcaaactgaatgacaataatgacacaacatatcaaaatctctgggatacagctaaggtggtgctaagaggaaagtttatagccctaaatgtcaacatcaaaaagtctgaaagagcacaaacagacaatctaagatcatgcctcaaggaactagagaaataagaacaaaccaaacccaaacccagcagaagaaaggaaattaccaagatcagagcagaactaaacaaaatcaaaactaaaaaaagtacaaaagataagtgaaacaaaaagctggttctttgaaaagataaataaaattgatagaccattagcaagattaaccaagaaaagaagagagagaatccaaataacctcactgagaaatgaaacaggagatattacaactgacaccaccggaatgcaaaagatcattcaaggctgctatgaacacctatacacatataaagtagaaaacctacaagagatggataaattcctggaattcctatccatccagaagaaaaaatgtttattccttcctcatatacttagattccagaagaaaatctaatatgagcttattaggtcttctcatctagaaactttctgcctcaccaggctccttgtacattgttttgacaattttgattagctaatctccagccacactgaacatcaatctgttccttacgtatgtcataacctatttaatcttaactgtttcactttctataattgttatttggtaataacattacctgtctcctaattttaagaaagcctctggagtatcttttattccttcctttcaaccatctacatttacttgtttaatgaagtgaggaggctggattttctagaacagttctaatgtatgcatttttttccagacctaattaattttagattaacaaattatagtggccgacatagtgatctccatatctctgtttatatcagtttgtttatttgttttatgtaattggcattcagaacagaattctgtctttgtgaccacaaagtgtttttctggcgtcatgtaccatctttcctggatctctttccctttgtggttttgggttagagtctaccaatgagaggcactgatataagatttggaaggagacgccgatactatcctaagtgcagttgtcagcagatgcataaaggagggctgggcttggggatcctgtacaaatgactgagatgtgctatggcttcctggtgagctcctttcagtagctgtttccatgacctttgttctcactgctccaacagttgtgagaatctctaacttcttttattaaaacctctcctatttgtagtacctcgagtacatgcatgcacacatttttgtaatatctgtgaagacctcattaacatttttattataattaaaagtgtaaattcttatatctcatctcattgttcattatataccctacacacacacacacacacacacacacacacacacacacatccatgccctctccacagtcaggtaaactagatacaatctcaaatagaaataataaaatgttctgagtgtaattatggctctagttattcccacaataatcagaatcaaacgaaaagggcaaatataatttactgggcccaactacttacacaagagctataacatgtatgaaaatttgcagaccactttggttagcttgatcccatcatggtgataaatcaagaccaaaaatcatcattcctagacattcaaaagtcacttaacaaaggtaaaacatcaacagtgtgaaatgtcaagacagaccttatgttgcagaccataaatgtaatgtcacctagagttaggaagtaaaggtaagaaatctttagctgaagtttggaatcccctcacatctaaaggatgagtctcaagaacattagtaatctcccatgatgaggcccattatggtatatagattctcttaaacattctagattctgtttaatctatttcttcactaatttcacttccagaaatatacatgccctttatctctatgctgatttttcacaaaacaaagggtttttgtaaaaagcaaccttttcacaggacttactgcatccacaatggtgagtaatagaaaaaccacaaagtggcatacactgaacaatcagaaatttccttctccagctaacaggctcactgttacaacctacctttcaatgtggaccattaaaatttatgtctcagtatagtaagtgacagatcagtagtaagtgctaatttcacaaatactcagggcttgtcgcatctcaaaagaccgttggccctcacaaaagtctgtcttcgtcatccccatctacctttgggtgctccccactctactatagttgcacctgacagtcacccaggaaatctgcagtttatcattgctatctatcctgggttctttatttttctcaatcccctttagatgatctgggttgatttctggctttggtcaatatttcttattgctggtgttatgtcatgtttatttattgtttaattcctatcagtcaggcatttgctacatgtcactcagtgtacatgaggcactgggaactgctgcaacttctttccacctctacagcctggtcatagcttgagtaagtctctgacctctataagagatcacaggaccttctaattctctcattgaaccgtgtccagcctgtcacacaccttagattatggagagatctagagctaacttttcatgttccaacacaaagaaactggctatttttaaacacagactttgtatcaggctctgaagatacccctgtgaaatagtcacaactattaagaaattaacagtggaatggaagagacagacaattaaacaggcaaaaacactccatcttgataaatttagatataagtactaagaatgctactaaacacctagaaggggcaactactgcagtcttggggtatgtttaaaaacatacatctctgggatgtttttaatcactacagcacatatcaaatacacaattatcaccaccaatatgtaatgaaatggaaattgaactgaaatgttgctcatggaatctacctgtgtctgtaaatccataaattaaatttatgaaaaaatagtttgttgagtgatatatgagttaatgtttaaattgtttgggcccaccttctctagcccagctctgaggacttttctttgctgttacaacatctcttccctgatacacattaactcacgaggatgaaatagggtttccggactctgtgatgtccagagttctcagtcaccccaaccattgcatgctatctatcttaagggtaaccttctagaagcaatgcctcacgtctttcagatttttataaggctcagactgggctgggcatggtggctcaggcctgtaatcccagcactttgggaggctggcaggcagatcacctgaggtcaggagtttgagaccagcctggccaacatggtgaaaccccatctctattaaaaatacaaaaatgagctgggcatggtggtgggcgcctgtagtcccccagctacacgggaggctgaggctgtgcttaaacctgggaagcagaggttgcagcgagctgggatttcaccactgcactccagcctgggcaacagagcgagactccatctcaaaaaaaaaaaaagcacattggatggccaggcacagtggctcacacctgtagtcccagcactttgggaggtcgaagcgggcagatgacctgaggtcaggagtttgaaaccagcctggccaacatggcaaaaccccatctctactaaaaatacaaaaattactcaggtgcagtggtggacacctgtaatcccagctacttgggaggctgaggcaggagaattacttgagcccgggaggcagaggtaggttgcagtgagccaagatcatgtcattgcactccagcctgggtgacagagcgagactccatctcaaaaaaaaaaaaaaaaaaaagggaaaaaagattcagattggacaagtgatttcaatggtggctatttctggtcaagtgaaggcactgatacagaccacagctgcaggcagcttagcttcccaatgtgagcctctcagggaagcatatgcacctggtaatcacaccgctccacctgggactagacgtgttcacatccaaaagaagcaatcatattttaaggggcttgtagttcacaaagtccttctgttctagaatctctttggatcctcacaatagccctgaagttcagatgaggatacttgttctgaatgattaaataaattgactgggtcaggccaatagtgagggcagaacttcctgatggcacagcctgggctcagcccatcctcctacagtgttttctgctttcaaggctttgatgctatgaagaaaagcatatacctcacagtgacattactgtctaagaagcagacagcttggcaccatgccttgaaagaaatcagacatatatttttgaataaaaatatctacatcgcaatttctaatacaagtcttttccttcttgttgattcatcctcaagtttttggaaaaatgaaataaggcatgagccagaacaactggcaaaataagcaaaagtatagcggggtgtgggaatgttgttttccacaactttgtcagaaaaagaaagccagagaaaacagtacttcctaagaagcttctttgactctactccacgaaaaattgataagaaaagtatacatcgtgctgttaaaaattatctccatctgtggagatgaagcaggcatcaagttcacagttattcagaaaagtgctggtgaggcagttggaagcagcaagcagagccagtgccgaccaaattcatgcccatcagagccctgagcgttaggtagaaaggatgaagctctctgcctgtttgtagtgtgtttccccaaggcctccttccctaactcacttcttattacaatactactccctgccggtgcagtgactcacacccgtaatcccagcactttgggaggccaaggagggcaaatcacttgagtccaggagttcaagaccagcctggccaacatggccaaaccccatctctactaaaaatacaaaacttagctgggtgtagtgacggacgcctgtaatcccagctacttgggaggctgaggcagaagaatcacttgaacccaagaggtggaggctccagtgagccagaattgtgctactacattccatccggccgacagaacaagactgtgtctttaaaaaagcaaaagtaaaaacaaaaaaaaagcaatacaactccctgtataggtttttattattctgatactgtgctgtaattgtggagagttactggacaaatcttttatgtttagttattccaacgcatacaataaggacatgttatttgaagagaaaacaaacctgctctctgagtgctgtgatggtttcctgaatttccgctgcaaacgtgctgaaatcttgggagaactttgtttttgccagaactgtcacatttctagcatcttcacccacatatattttatcttgttgcctatttataacaagaagcaaataaaatgctgaaaaataaaagtcgtgtgagaattttaaaatatcatcaaatcttctttggtcatttggcatgtacaaggcattgtgattggtgttctttgtgatcttaaaaggaaaatggtatgagtggaattcaaaattaaaattaaatggcagataagatgataatccagagtgtcacatctggttcatgtaatttatctaaaataataagaaagtatttcttatgacataaaggaaatttcatgttgtattacatatatatttgatatattatttagaccttaaagtatttcttttgctaacgaattcttcatttcactttaaacagtgaaagagcagtgacaaatttaatataacatattatccagtagccaggtagggaagctgctttctctattataaattcatggcaagaactaaaataagataaggatactatgagtgacaaaaatctaacctttaacctgatgcaaaatagctcagtcttgttgataataaaaggatataaggaaaccttgggttgaatttaagatatgtttctttgagtttactgaaactttcaaaaaacagaagcaaataactaatttgggaaatagaaatgaaagttctttctatttacaattatcatgtattgttaaaaatatttttagatagatttgatttattgggtatgatatctgcatttcaagtgctcttacgtttttccaaattttgtaaaaagttgttccttgtgaagaaaccattataactttcaaaattgttctgctttattctatttgaaatatgtcttccattgtttactaagaaaatggcttgccagaaacagtacattctatgagcttgtaaaacaagtcataaatcagagacatagtatagagtttacattaatcagggaatttaaaaaagggaaacaaagaaaaataacaaaagttaccaacagcagtagtttagtcactggataactccatgtcctctgaggcactgtgagctagaggcaccatgaatcagtactgaccacatgctagcttctatacagtactgtgttaaaacagtttaaatatacaagtattgttagggataatattaatgcaaatggttggacattttactttcataatgctctcttctgtaaatcttcagtgtctaatcaaaggtatttaatcctgaagaagcctgaatgaatgtatgaagatataaccaacagtcaaaagaccacacgtgggaacacggggaagtggctgatgttggtgagcccagatgttgtggagtaggacggtattcacaatttaacaaatatgtgtgggtatgggccatgcatcaggcattctgctcaggtagatgggtgcaggatgtgagggtgctgccgttaggctcctcacattctttcaaagcagaacagttggcaaagaagcaagacacatagcatctgcattaggaagacaaataagaggtataaccttgtatttataggcaacaatactacattttaagctttactgatgtacaactgatacacacaaaaacacacatatttaatgtatacattttgatgagtttggacatgtgcatatatacctgtgatattacaaagtactaaatataaatatattcaccacctccaaaaatttccttattttttttcacgtgtgcatgtggtttgttttggtttttgtttgtttattttcatgatgatacttaatatgagatgtatcttctcaatctatttgaaactatacagtaccatttattaactatgggtactaggttgtgcagcgaatctctagaactaatttgtcttgcataagtaaaactctttactcattgagcaacaattctccatttcgtcctcctcctagcccctggcaaccaccattctattctctgccactaagaatccaactattttagatacctcatataaacagaatcatgcaatatcttccttttgtgactggctaatttcacttagcataatgtcctctagaactacaatgacatagcacctcacacctgttaggatgactattaccaaaaaacaaaagataacaaaaatgttagtgaagattatacaacgttggtggaaatgtgggttggagtagccactgtggaaaacagtatggagactcctcaaaaagcaacatggaactaccatttcatctagcaatcccacgcctgggtatacagccaaaataattgaaatgaggatatcaaagagatgtctgcactcccatgttacctgcaaaattattcataattagcacaatatggaaacaatataagtgtccatcaatggacagatgaacaatactgtattgtacactgacaaatgtgttaagaggtatgatctcatgttaagtgttcttatcacaataaaataaaattaataaagtaaaataaaatatataaaaaataaggttttacccataaaaaatagtatatgctatttaagaagatttgcaaaatgcagtaaagtataagagaaaaatcatcagtactcaattaaaaaataggggagggatgacctatattcatcagaataaacttttaacataattatttatatttttagtttattatttcatttacaaataggttttttccatagtaaaggtagcacatgttattttagaaaaaaattgtttaagcagaagttcagaagaaaaaaataccacttaaattaatcaggaaaaatggttctttcatctcaaaaattactttgcattgttgatttctgattgaaaaaaaattagaaatctctgaaaacacacaatatgaagaataaaatccacgatagtctcaaacaaacatgaatgcataaataagtaagaaggcaatgccctctgcctgggagcagagcagtaatgagtctgggaagctgtgtaaagagaatcccacgtcaggtccatgtagttagtgcctgctctgcgcaggcaggagtcgaagtgctagcgtgcactctgtgtcacttaactgcctagtagttctataagacactataactagcctgtgtttcaggtaagaatactgcagcttagaaagttgttaacatgtccacagtatatagagctgttaaactgcacagctgggatgctgattaagattcaaaaaaaaaaaaaaaaaaaagggccttgctcctaaccagtacacagtctattttccatccatagagagtggtgggtgatttaaagaatgatcaggtttacattttagacaatttggaaggatagaagagaggcaacgagcccaggtaggaaggttattgcaaaaaatgaaacacaaaaacccaagacactgtgaatgttgctatattttggattcttaccaaaaacataaaactcaacatattgcttataaaaaaagactcttggatactgtattgaaagctagctttaatttgtgaccaagacagaagaaagaaaagatagagaagagaggataagtgcaagtaaaatgggcacacagagaaaacaagaagtgaaattacaaccgcaattctttgtgcatgttggttgagggaatttgacctcctctggtctaaacaactatggtacatttaagcacaacagaaacaatctataaaggattactaaagcgtgtgttgttataaaacaaaacaaatcagagctcttcttacctttttattgtcagattaatgataaactgaactcataattgtaaagtgtatgtttgagtaaaagtttgataagattggcaggaggctaaaaataaaattagccaatctttagctgaggcaacatctgagctgggcttcaatgggccacccagagtattaagtgtttcggtaataagttaattttatctcaaaaacaagcaaaatgagtctttgaggtaaaacctgggtgtggctgtagaaaaggacagaaggtagtaatgggtgttgttatccatgcctgtgcttgtggacaccactggaagggactgatccccatcaccatcttataaaacaagggaaattgccctccaatatttgagtccggtacccacttctgatgacacactggtaaaacgcttcacctgaatcaatggaaaaacagatgaaatgccaaataaaagggccaagtgaatgtttccaacactcaaattatttaaaaatggttctcactaggactccaactcctgatcagagttccaattaccttgcctggattagctccaggaacacaaaatatatttcatttcctcaccctggaatttacagctcttcactctttgcctcaaccttctttcagaatgttctggaagaatgttcttcattcctagttattgaacacaccaactcattcattcattcattttgggttttttgtttgttttttatagaggtctatagacagtctcgttctatcactcagggtggagtatagtgccgtgatcgtaattcatgggaacctcaaactccttagctcaagacattttcctgcctcagcctccctagtagcagggactactggtgtatgctaccatgcccagctaattttttaaattaaaaaaaaaaaaacttttttagagatggagtctcactttgtggcccaggctggtcttgaactcctggcttcaggtgatgctcccacctcagcttcctgaatatttgggaccaactcatttagacacatgaattgtaccattctccaaacacacctcacttccctttgctcatgttgttctttcagacttggactcccctaaatgctatcaaaatcttagcttatccttcaagagccctcctctgtctacccggtcaaagggccccaataagaattaatcaccccttgctctgcactactcactccatgattggatttcacttcagtactcatataagcactttcgttaagtgagttaatatttgtttgatgcttaaaagaatgtttggcattcagtgaacactacaacagcatgtgtcattacagaatgtgtgttacagaatgcctgtaaaatgctaggtactatattagtattcagtgctttacatatgtatcctcaagttaagacaataatcctgtaaagtaggtattacatgcccattttacagcagaggaaatggagatttggaaattttatataacatgcatagttatgaagcagtagaaacaggatttgaatccatgtgcctgactctaaagccttcacacttcttgtccaacaacactatctcctctcctcaattttaaaacttagagtacagggcccatatattgttcaagttgacaactgtaattgaagaaatggatgccaaaaatggattttgaatttgactaaattatactacttagaaggcagctatggacaacaaaaataggatacatggttccttgaaagaacctgcatggactatgaagctgtgaattgcaatgtttattttggtaacttaatttcacaagtatgtactgactccttattcaatgaaaaggagctactggacatacctatgctcaaggtagtgtttctgctttcagaagcttccaagtcaatggtagggagaaactttttaaggcaacactttgtatcaagctaatatacaagctacacaaaagaagtcctaagggatttcaaaggaataagactgacatttctcaattttctaagagttcaaaaatattccatcttggtcacaaatcaagccttgcttgccatatattattcatgaattcaaatcaacttaacatgaattagcttaaatagatactattacctttctcgcaaacaatatgctgtttcatattttcaaaaagaatctgaaaaatatcaactcataatgtcatttaagggatcaaaactagcatctaatacacttagttttctgcactttactgagaaaaattcattgccaaatacgctctggttgggctattgcagagtgaaatggaacccaaacacattacagaattcattctgtgttttctccttttcatgtgattcatcctatatgtaaataagttaactgtggtctctattaaaaaagataaaaacaaattgtaggtttgaagcaaatctatagtaagttgcctaaagaaatgagatatttctatacatacctacttcttagatgacttaactccatatccttatcaacaggatagctgtattgagctgagcgtttcttttgagactcttgcgtcactgctctgaactgtcctctactcctacagtctgtggggaaagaagtaaccacaatagcatcatgtgagatgcgatgtcatgatctcatctagatcatttctttaacagtcagagagggcaagagtaccaagaagaaagagtagagagcgagagtgagagagactcatttagtccgttccattttgctgggtgaccacagtctcagatacctgcttttgcatgtcactgaatctctgttttgcagcagcaagtgggatgcaaggcagtctgcagaacctctggaggagccccaggcagagtgatgctgaatcttacttagtaagggcatggattgcatggtgtcttttattcactaaggacttggcacaatgaagaaagaagcaggacagtcctgagtggaatgcttgaaatttggcaactcctcaaagtgtctcaggcacacctgatacccactagggatttgttttttaagataccccctgttgcacaactgtactgtgtcctccaagtggttaaaattgtaagttttatgttatgtgtttttatcacaatcaaaaagatatgagaataacatgaaaaacttgttgcaaataaatatggaactttaaaaagtggtctctgatatagtacggatatccccctcaaacctgctgttgagatgtaattcccagtgttggtggagcctggtgggaggtatctggatgtgggagcggctccctcacgtctttgtgctgtgcctgccatagtgagtgagttcttggagatctgtcgtttacaagtgcgtgggacctcccgtactctcttgctcccactcatgtcatgtgccctgcctcctgctcccttttgccttggccatgagtgaaagctccccgaggcctccctagaagctgagcagataacttgcaccaggcttccagtatggcctacagaactgtgagcccattcaactgcttttctttataaattacccagtcttgggtattttttatagcaatgcaaaaactgcctaatacactctctaaaatttcatatgaaaacagatggtctggaaactaagatattttgaaaatgaaaaagaatgacgtaggaatcaacattctcagatagtaaaactactatatatgaagttcaaaaataaaaattcttaatattggtgggaaaatacctgaaaaaataaaacaggataacaacccgagagcatcttaccatgcaatcgaatttaacacattatattaggcagcataaattggaaaataggcagagagtacttttgttctgggcagctagcaagttattcttaaaagaagagaaagtgaaaaccacttacatcttcaccttatcatatgtaaattaaattcaagaggaatattacatgaaagattattaagctaacatgaatatgaaatttaggatgatttttaaaataacacaacaaactgcaaatgctataatgctagacaaaataagagtaaaacttatacatatgaactcactggtattaaaacataccagaaataaactaaaatgaaaacatcccaaaattaccacagtgacattgtctagaatactggttatggttgttacttgttttcttttttatttctacttctaccttttgttttcaattaaaaacgtctttatttataaaatccaaacacagttcactgaagaaaatccaagccttcttataaggtttacaagttaattatcatattgttgtatattaccataattggataaaaaatttctggaggccgggtgcagtggctcatgcctcggcctcccaaagtgctgagattactgtcatgagccaccgcgcccgacctattgctacttttataacggtgaagtcaagacattctagataaagctgtacattatactaagggacccacaggtgcttattttcccctactgttatgctgttacctcgacttagtactttactgataattaataacgcataaatatttgcagctctgagtaaaaaaaaaatacatagaaatatttacgaagaatacaactaaagaaagtgaacttcaatcgtaaaatgaaactcagtctttctatttctgaatagcacacagcttttgtcaataaatatttatggagatcttactgaattaaggtattaggctaggcactgtagagaaaataaaagtggataaggcatggttcctgattttcaataggttgcaagtattctccccactacaatgcagcatctccggctaagccaaatatctttcttttcaattctcatataaaaaggaaaaaatatagagaaaaggctctgcagataaactctcatcatctatggtctttcattattttttagaaagatgaagctttagaatttatttactttaaagcaccaatagattgttcaaggtcatataaataaaacccaaaaagcaaagaatcatgtatataacactgcaggtatacacagatgagtacacctgaacagaaacaacccaccagactgcagtgacatggcaggtttcttgtaatgtgacagctaaaatgttgtagttctgacatcatttcttttaattcacttcgttatttattcctggatactgccaaagaagcagagtattcttgattgctgaatgtttggctcttaagcaaacaacattacatttacatttaaatgcaatgttagtatagtagatgctttgattttatccctatgcatatttatcttatataaatatatacatatgcatacatatatatctatgtgcatgtgtatatatacatacatgttttcaagctctgttcttaggctttacatgagttatttatttgaaactttacaataacctatactcaatattatcttccctattgttaacctgaggcacagaaagattatattatcttgtacaaagtcctacagcttttcaacagaagagacagggtttaaatccggacagtcagactcaaaagccataacactacagcacagaatgaggaaaacagaagaaagttaactcctagatttctggcttatgcaacttgcaaataatagggtcattatttgttaactgaatgaatggatggatgagtctagtgtggaaagtaaaatgaaatgacttaaatttagatcagcttaaatttctggtctatgtgtgacatgcgggtatgaattacagcagatagggtgtttgaagacggcaacagatgtggatgaagatacagccagataactcgtgttcaagaggcataacggtgggtgggtgtgtgtgtgggggtgtgtgtgtgtgtgtgaatcttcccattcagggcagccttggttgcccccaccctgacgctgctcctgcctttgctttgtgaatggtgacctagattcttagtgggtgaaacaaggttcttccctatgcagcaccttcttgcctctccagtctcatttctccctaatgcacaatccacagccaatgatcctgctccaacttcatttggtctcacttgagtgacaaatgccataggtgtcatgtcagccttctccaggaagcctttcttaactgccaagagcaagtcgaatgtaaactcattgcactctctcagcactctctggatacattgggtcttactcctcacattctctgagaagagcagaagagaagggccttgtcctacctaccggttaatcctcagcacatgcttgtggcaggtgcctagtaaatgctttaataaaactagaaaattctcaagacagcaggttgctttcagaatatgtctgaatattgcagttcattggagtggattgacagtccgtggtgaataaacaaggtcaagtttgggagattgagctacagtagctcaggcaatcctatgtctttccacgaattgatcaaaactatgcaactttggaacactagtatcccaatgctgcattccatagattaaaaatatgtcaaaattgatttttcaaattggcaaaaatatatctgatttttattttcaacactttcaacacctcttatttgcttgcaaaaaggggaaaagtacaaataactgaaagcaaacttacaaaactgacaataaatttgagggacactttgagaatgaatgcattcatattgcatatgaaacatctctgttgtctggggtatataccctggttctttatctcttaccgagaaaaaattcaggacacggacacacacgaggagtgggtttagaggcataaagtttaatagacaaaaaagaagagaaagaaaaaaagcttccttatgctgggaaagctggtcgcccaagatagggtctctggtttgggacggaatgcaatcaattttgtacagaggcttgaggaggcagtgattgattcgcatagggcccaggggattggtctgaccaggtatgccatttagataacctaggaaaagactagccctcccaccctagtcttttattagcaaatgcagcttcttttttttttttttttttttttgagagggagtttcactcttgtcgcccaggctagagtacaatgatgcgatctcggctaactgcaacctccgcctcccaggttcaagcgattctcctgccccagcctcctgagtagctgggattacaggcccacactacccggctaatttttgtattattagtagagacggggtttcactgtgttggccaagctgttctcgagctcctgacctcaggtgatccgcccacctcggcctcccaaagtgctgggattacaggtgtgagccatcgcgcccagccgcaaatgcagcttctacctggcagcggccatgacacccgcacacgtggtgacaaggaaaagggagcaggaaccgccatgttggatggacttggctcttagccacatgtatttacacatgcatatctatgcttgcagcctgacctttcagactgctttttgttagagaagaaatgatttggggctgctttttattaaaggaaaattccaccgagaacttttaccctcgctaacttcccaaaataatttcttaataactcctgtattaatagcaaagtggcttctagttctcataaaggaactgagtatattaatacatcatatctttagatgatgtttcacctcaattagaatcaatactgaactatccccacaattgttttgaagtgagacggttccagtagcaccccattaatatttcttcatactcttactggtatttcactttcttattacaattgctttaggaatctatcacagtgttaacaggttactacaaatgcaatggcttaaaatgatacaaacacatttttatggattgctgtgtattccctcaaaattcatatgttgaaattctaatccccagtaactcagactataacattatttggaaatagggttgttgcagagtaattcgttaagagaccacactggagtagatgggccactaattcaacatgattaatgcccttataaatagaagaaatttggacacagccatgaacacagaatactgtgtgaacatgaaggtagaggtcagagagatacagcagaagccaagaaacaatggatgttggcaaaccatgaaaagtagggtgaggggcatagaatgcattctcccacacagccctcagttggaaccagccctgccagcacttgatcttagactcccagcctctggagtggggagacacattttgctgtctcgtttgtggtgctttgttacagaatcccaagcaaactaccacacgcagcacatcacaccttccgtggccagaatgcaggactcctggcacaggttagcaggtcctttgctcagtctcatgaggctccaatctgttagttgggctacattctcatgtcatctggggcagaatctgtgttggcagaactcacttcctcgtggttgtgttactgaaggccacctggaggccacccacagttcccttccatgaggccctctccataataaataaaaatcagaaaaatgttatctccacaacatagtggtttgctttctcacaatcagcaggggaatctttctccctccatctagtaagacagagtctaatatgaggtagcttcatcatgggagggacatttcatcacctttgctgtattctgctgattagaagcaggtcacaggttctgctctcactgaagaaaagggatgacatgagggcgtgactcctcagggttacattagtgtgtggtcatctcaacaaccatccactgcacactgccctcgacttactctcatgaatcaggaagataattcccaccataaaaaaaaatgtactgtagtatggagattttgcaaaaagctaaaaatagaactaccatttgatccagcaatcccactactgggtatttaccaaaaggaaaagaaatcattatttcaaaaaggcacctgcactcatatgtttatcacagctctactcaaaagagcaaaaacacgagatcaacctaaaagtgcatcggtggattaaaaaatgtggtatatatacaccatggataatatggtttggctgtgtgtccccattcaaatcacatctctaattgtaagccccacatgtccagggagggacctggtgggaggtgattggaccatgagggtggtttcccccatgctgttctcatgatagtgagggggttctcacgagatctgatggtttaaaagtatgacacttcccctttgctctctcttcctcccgccaccttctgaagaaggtgctttcttctcctttgccttccaacatgatagtgagtttcatgaggcctccccagccatgtgaaactgtgagtcagaaaccctcttttatttgtaaattatccaatctcaggtagtacctctataacagtgtggaaatggactaatacaatggaataatactcagccataaaaagagtgaaatcatgtctttttcagcaatgtggatggaacttgaggccattatcctaagtgaaataactcagaaacataaaagcaaatagcacatattctcacttatgagtgggagctaacaatgggtacccatggatagacagagtggaataacatgctggagactccgaaaggtaggagagtgggaggagagtgagtattgaagattacctattgagtacaatggtacaaagaagtatacaactaaaaagcattcctatgtctcaagactccaagaaagaaaatggctacaatcttcttctaattttcaatttcatttttctctctttgtcattattggaaaaagcatgttattattatgttattgtgtatattactatgtattatatatatattatacctatataatacatactagatattagatgaatatataatttcttatagttattacttctccttcctttattttttaagccagctattagatttattcatcaattccacttatatctttattcaggctttctcagtacattcatatttatttagctgtcttttctctaacatcttaagctgtgtgttttattaatttatttttattatttcatttttaataaaactacaagtttgtttctgtatttacctctgttacccataaattttgataataatgttgtaattaatatttttagatattacacttcttgataaaatatttatttggtctaatgactaaaaaattctcagtagctattttcttttaaatttgattattttagattagttgcactgtggtaaaagataatgaagtctgcttctgggaattttagtgttcctagtgacctagcatataatcaatatttgagaatctttatgaatatttgaagataaagttaattttagcttatagggacaaagttaaagacatctttcacaaattgatctcattagtaatattcagacacaattctattaagctgtgctgaatggatgctaagctatttcaaaattgagattgaaataaacttcgtttcagtgaatgcttttcttacttacattcaactgtgtattgttattgccactcctgtttctgtgtgcctgacttaactttgatgtatgcttttatatgtgaccattatcaatattttgcttatgtatggcccttgttaatggtatagagttaaaagctgctttttggatagataaagcagtcttcgactttcagtaattctcttaatgcactgaaacttcaggcacatttgggtcttatgaggattttaagatttttgttcttcaatgtttcctttaaactccacattgttggttttccctagtgatctgcagagcatatatcctgtttaccaaatattttgccttttatgggaacatatttgaaaccaaatttcattaattatcaatgtcatactttaacaatattaataattacaaatgtaatgaggatttctaaattttctaatttttatcatttatcatcatgcttatgctaagtcaattttatcagtagaattttgacttatttgattatggcacaaacaaatggacaattacaaaatttgctgaaataagtagattggtaacaaggacttgtgaatgttgtttaattgcacctgcaatgcctaaagtattatgcgaacactcttgatcctactgattagctgatatgaaaaattagcttaaattgatgttaaaatgtcaagattgttgcatttgtaattcattagcataagattctaaaagggaaggtcatcagctaaagacagttctcatgtttactaaaaggcacatatctaacgggaaaatactaagaggaacatatctgatgggaaaataccaagaggcacttattttatggtaaaataaagttctagtattaagaaaccattttcttaaattaagcaacttggtgaagccctgctaatgaattacctaatcctgatatagaaaaatttttctttcttatgtgatagaatagattgtaaataaatgcagaatgctgtatttggaagataacttatccttagaacttatgagagggttattttcaagggaatgctttgtactctatgtaaagtcaacatcatcagtagagtttgattaatcatctatatcactgaacactcattctgttttgtatcatttcagggctattatttgccctttttcctactgtaatgttctcaccttgatttcaacaagtttttcacacaagatattaggtactaacagacccaaggagagtgggagatgtccttatggtgttctattaaaaatagcaaaaactgtcaaagacaaacctgagatcactgttgcaatgtaattgcttcattaaagctttataggagttgcagaaatcttacttctttagtaatacttcgaaggcattttataagttaagcatgaaaatactacagtgtcatgaaatacgatggtaataaaattagtctcttatgaaagaaattaaactttcattagttcacaaacataagcacaatttatttgaaagaaagtcatgagcaaacctaaatatatttacatttgtacataaaatatactgtatttacaattacttgatgctctaaagacagaacttaatgtgacgtatgcagctggaaattacaagaccacatggttcaataaatcccagtagaaaatatacatctgttgactctttgtgcaattgttttatttgaaggaagttttatttaatcgagtggtatagtgtcttagtacgtcacttatcttgtcttaggaaacatcccacctgccttaggtgtaagtttttaatttctaaaataaatgagagtaaatcattttctgttctatattgaagagaatgctttctgctctatgcaaagtcaattttatcagtagagttttgactgatttatgacacaaacaaatgtgtcaattgtagagtttgctgaaattagtagattggtaacaagaacttgtgaatattatttaattgcatctgtaatgcctacagtattatgcaaagactcttgatctattgattagctgatactgaaaattaatttgatgttaaaatgtcaagactgttgcatttgcaattttttaggacaagattctaaaaaagaaggccacccagctaaagaagagttcctatgttaactactggtgaaagagatttggagaaaattacagaaagtataacgaaaggaaaactaacgacgaggtcacatggtggggtgaggaaaacaaatggacttggcaatggggagtctgagctctatccctaggtctgctaataaataactgagagcaaattacttaaacctttccaacttttgcttcctaatcttaagatgaagtgttggtttttttggtcttgtttcttagtcaaatactctcttaggccacctccagcttcaaaaatctataactggctgggtggggtggcccatgcctgcaatcccagcaccttgggaggccgaggagggcagatcacctgaggctgggagtttgagaccagcctggccaacatggtgaaaccccatctctactaaaaatacaaaaattagcttggtgtggtggcgggtgcctgtaatctcagctactcaggcgcctgaggcaggagaatcacttgaacccgggaggtggaggttgcagtgagccgagattgccccattgcactccagtggtgataagagtgaaactccatctcaaaaaaagaataaaaaaaaaaaaaagaaaatccgtacctaagatagctaaggaaagaaaagaacctagtaatttaatgtgaaatgttctgtaaagtatgttaagtgatataaaatattaaatctcaaagaaaatttgaaaatttttgctttatcttttatgctggtaaaataagattcttggctttctcgttatagtcattcatttatcaatcttggttactgtgatcttttgataactacaaatttagcatttgtctcatgaggtttcccttttcccttttccttaaaagaaaatccaatcaaacaacattttgaacacttgctgcttatcacttcaccagctacgcctctgtcggagctctcttggttccttatcttttcttaatattttcagtgggcacttactattccctaggccttacctacagcactgaattattatgtttctgctggctaaaagaacaaaaactccaatcaagcagctgattcatctgataattatcccccaaaccaccctactgtttatataagctctgagtcaacttgtaagttgttttgacataatttggacactgtcaatggaatagcattttctcaagtacccagaaaaacaaaaacccctcctcatggacaacaagcaacataatctttggccagaatatcccattatttgaatcagaatatagtctcattatccttaccagtattaatccttccagagtgctgtattaatggactaagttataagtatactggttttctcctatgtatcttgtaccaaagacatccatctacctgaggcaagagtacacacagaagcagcacagaactcctggactgcctcgcctctgccatgtttccacattctctggtactactgatggcagttcctgtgcaaatcacagcattcccagaatgacttccagtaaaatgctgggtggcccaaagataagtaattatacagagaatatcaagaagtggtccctgaaggaggtcatctaagcagacagtatctgatgtggcttcttcagatgcatttgcacatattttttcatacatatttagatgcaacttgctcatattgacaaaatcagagtcagtatacacacacaatagagagtataaatctatgtgtcaaaataacatgggcagagaaattaacccacaaggtaaaagaaagaagttggcaacaccagagtggaacaaataggatgcctagggaagaaaggatccctgactttttttggagattaaccacatgatttttatttttttcctaatggagggcttgtaggtttgtttttgagtaggtaagaaatataacagattggacaattctgtcaatatccacaacatacctttaaagctatgcctacttctgggcatcacactttaataaagaccttgatgaattataatgttctgaaagaaaaactgataagtaaaatcagaataatgaagcaactctaaatcatgcagcatgaagaaactagggagtctgggatggaaggtgtctgtttagtgcagaagaaaagattcattataaaaaagaaagccatcttcacaggataaacatgatgtcacaccaaaggagaattagaattatcccacgtttctccacaaggagaaaaatgaccaaatagaaacctattatgataagtttcatcttagtataagattaaaaatgaaacctaatgaattatctttaaatgaaatagattctcagatgatgtgggctcagagcccatgggatttcatcttctctcttcccaggctaaaagacaggagggggctagctgaaacagtaaacaggtagtaccagttttgctttttacttacgataatcctgaggatccttctaagagctttttcgtcttcaaagaaatcagtgttttagaactgaattccaggtcaccccttggtttcagatcaaaactggttttctcagaccttgtgtcggtacattcctggcccccataatagtgtgtaaaaaaatgattaaacagggtcttctgtgaccttgaaaaaccaaatatgctgattaatgctgtcagacaggaaagctcacatgcctgtgctctccctgaagagctcaggccttgatcagcatgtacctcaaccaaagacaagaggaatggtctcgcctggccccagcatgaggtcctcatcacaggacgctcattgcagcacgcggacaatgagctcacagggatttgggagcacggtgccctgaagatgagcaccccaaagatgggccttcttcccctcccccacaaccccaggggacaggcctcccctgggcaagtggcataggaatatagaggccacagtgtgcttgagaggacaggggaaccctggggaaaaatgcagcacacaatcctcctaaaggctgcaggcctgggggaaccacgcccagccctgctcaactgaggactcagagcagcttacctctgaaagggcttcatgttcagatttctggccgagagcttctgccctcagagtgtgcagtgtgtctccacttctcagaaagccaagaatgaactgaataagtgggttgtcttcctgctttagcctacgggaggctgatgtcatagcccagcccagtgaacctgtctccttctgctaggtttctgccatggagataaacttgacaacttgagccaagataaaaaaagtcactgtccatgaaagggtcccgaatagttatcagagagaggagccactttctcagtgaaaacatgacccaagagacagagatgacaaaagaacatctgtttaaaatagtaacaataataaataataataatacaaacagggcatttccaatgctgcagaaaatgatgtcataaaacttaaacagatgatcagatgatgttggaactaagaagttaaatagataaatttaaaaggaggttgatctctgttgagactgattagtgaatttgatataagtggtcatgggcaaaaaatatatcagagcatttagcaaaaatataaaagagagtaatatgaaggaaaagaaaagagatttggagggtagacctaatgctcaaataaagaacgtttcagaaggaaaaaaaaatatttggaggacacgtacagatatatacagtaaataaggaaatatatgtataaatttccccttgttgaagaaatatgcaaatctatgaattgaaattgttccctaagtttgacactggattgataaggaaagttacatctaagcatattctgctctaattctgaacaaaagatcttacggaatcccattaaaaaagcattagagaaccctatttaagcaggggaaaaaaaatccagactggcacctatcgcacctatccatccaattgcaatataagaaactagaaatcaggaaaggaacactggcaaagaatgggaaagaccacagtccaggaatcctatgcaagtaagatgctcttcactgttcagcgggaaaaagatacttgagtacaaaatgccatttgtagaatactttacacaagtactcaatttgaaagcattacttgataggccactttaggaaaagagaaaagcaaaaaaaaaaaaaaaagcaatgagtagtaaaggcaagcattttccacctatatatatgcacacacctatacatgtgtacacttactcatgtgtatcccagacacgtatatacctatacatgcatgtatacaaccattcacgtatacacttttgtgtacacatataaacatacccatacatgtatacaaatatgcatgtacatacccatatgtgtacacatctatgcatgcatacactcaaacatgcatacacccatacatgtgcatgcttacacatgtacacacatctgcatatacacacctgtacatgcctatacatacaatacctattcatgcatatgactatacatgtacatatgcataacttaaacatgcatgtatcatacgtgcacatagctatacatgcctatacaatacatacatctacatgtacatgtttatgcatacacatgtatatatgtacacaactacacatgcacacacccatatgtgtacacactcatgcatacacatacctatccacgtacacagttatatacacacatacatacgcatgttgttaaattaggtttagaccaaagctacttccttacatattttaagttcagcctaaatgtttttccagacatagtgaactgtaacctaactggatgtgtaaacagactgtagtctactcttgtgtcaatcgctaagttttggccaatcaaaggcagccaactctttcaaactgtgttcaataatgcaaatgctggtctggaaccaatctggctgtttctgtacctcacttctgttttctgtacatcagttctctttttctgtccgtaaatcttcttccaccacatggctgtgctggagtctctgagcctactctggctcaggagtcttcttaattcacaaatcattctttactcagttaaatttgcataaggtttttcttttaacagatggtgtcagaagtgggacctgaagtagaacttcctccgatgcccagaagcaacatgtgaccaagtgagatccctgccaggcccactgtggccactgctttctcacagcaactggggatcatggtattctctctcagattccaaagctccacggatttgtttttagctctctgagtttgagcaaatttttttatctgaactgggttcagaaaacacaacagaaactggactggatgcagaatcacgttggatctgatattaactggcttggatccagttagaggcctcttatgtctgacccagtcagacagaaactgataataaatggaaatattgcagaaggtataaatttcagcttttgcaaattcacagggatttttgtgttctaccccttccttgcacttttctctttttggttgctcaggtagaaaaaaaatcattgactaagttgatcaaggagatctgatagccaaagccaagatgtaaggtaaaaaggagatccttagtttctaaagaactgaataatccaccttccagctatgcctacatttgcatgtataaatatcagactctggaagcagcaaacacttatagaagtggtaaaatcttactaaaggtaatttaaaattagaatgcaatgttccaaatgaataataccacactttaagcagtgcatctgaaaatgagaattcctggctaggtgcagtggctcacgcctgtaatctcagcactttgagaggccaaggcaggtggattacttaaggtcaggagtttgagaccagcctggctaacatggtgaaaccccatctctactaaaaatacaaaaattaggcaggagtgatagtggacacctgtagtcccagctacttgggaggctgaggcaggagaattacttgaaccgcaggtcttgccactgcacaccagcctgggcaacagagtgagattccatctcaaaaaaaaaaaaaaaaaaaaaaaaaaaagaaaagaaaagaaaaagaaaatgagaattcttaaattagtcttaactagggatgcctattgataggcaaaagcttctaaaaagattttaatatctttactgttttttaaaagagactttttacaaatggcaaataaaaagtttaagtgactaattgataagaaaatatctgttaacattttggtttagttattattctgccccaaaggcaaaaagaaagctatcctaaagtgtttacaaaagataagacctccggtaaagtaggcttgcttctttctcacagcaatccatgctgaatccagtcatggaaaatgctttctttgctctattccttaatgggctccatgctgaactcagtaattttagctaagaaatagtagctaagttaaaaagaacacccatggaactaaaatatgcctttctggaatctaactggctatctttaaacctttttgtaaaaaaacctacatttataaaggaaatctccatttttaaggatatctgcctatgtacattagaaactcttgccattgttttcaatttacataacaagtcaaaccttttttaaagtgcttttcagactatcttgtcttaactgaacttttacttccactactttttttttggtttgagctgatgatacaatatttaggtctaaagtcttagctctgtgctgttgaaatacagattttcttgtttggcctgggagttggccctttagaagtacagatttggaattgcctggctggcagttgcttagggcaatgaagcatgtgattgaaagagggatagtctaaagagagaaaggaaaaattatttataagctagctttatgaaaactagaagatctgcttctgtgttcatatgtgtactatatatgttaagtgtatgtgataaaatttggtaaataaaactagtttttaaattgttggcaaaatatggtttcaaaattgtcagttaaatataagtaggtacttgtttgatttgactgtgagcttacggtttggttttgagagtctggattcagtgatctggacagatggccatagtgaggcctggggcaaagttctcagttcctagaacagcagctaccagccagaatcaagcccaacatgacccgttcttccctggcccagttttgcctcctggctattctgggaagggttgtatcctccaggcatcctcctcacagctgtcttccgtcctgacttctacatcaggcatggaaattcaggacttagacaagcactgcccttcatagtcctcctgggtgccacgtggctaaatggcatataggggaagacattagggaaggtacctgggggaagacattagtgaaggtactgtaacaggacaagccgtagacaaaacccctcagacactgagttaaagaaggaagggctttattcagccgggaggtttcgcaagactcacgtctgaaaaaccgagctctctgagtgagcaattcctgtctctcttaagggcttacaactctaggggttccacgtgagagggtagtgattgattgagcaagcagggggtacatgactgggggctgcatacaccggtaattagaatggaacagaacaggacagggattttcacagtgcttttccatacgatgtctgtaatttatagataacataaccgattaggtcaggggtccatctttaactaccaggcccagggcgtggtgctgcgctgtatgtctgtggatttcatttctgccttttagtttttacttcttctttctttggaggcagaaattgggcataagataatatgaggggtggtctcctcccttagtacctgggggaagacattttcagtgcatgttttctggttgtataaaagctttcccatgcacaagggctgatgttataacagtagctaaaagattattcctggagaaatagccagagataggatacttatttcactggacaagttataaaacagttaaataaggtattatagatactatagtactgggcaaagctagaggaactgactgaattgttttggtaaaaggtattgtagattaatgacaatcacatccacttccagtgtaaaacataagttgacacctttattatgtcattgaaaggactatccccctaataacacagtctcatgtatcttccactaataaactctgacataactaaatgctgcaaagccttaatgcactatgtcaaggtgtattttcacaaggtaaagaaagctttacatggtgatctgactgagcacaatctagaacctgaagactgaattttctgagaacaacatcagagttgtcctttgccatcacattgtagcaaaactttgagaccttgaaccttgggttcatgacctcacaactcagaaggtcccctccacactcttactgtattcccactggaaaccttaaggttaaagctaaccaggaaaatttctccccagaagaagataacaccattgatgtgggtagctttttcaccagatcaagaatcaagacttctctgctatcataagactcttatctttctattttttttccttgcttatacttctatgaacaataaaagtgaaaaaggagatggttgtgtggactcatggggtatacttttattttgtgaaagatattgaagccagccttatatacatagacaactttatgctttgatagatggaagatgaagggccagtgtaagtgagaaatgttcatggtacatttgttgtctcacaatcagtcagaaacagaacacggataccctcctcttaacctacatcataggttaaagagaacattgctgccatcggttatggagaaaattaataggaagacttcactcttccaaatgggcatcttttgttaggtttcttttcccatggtttggagtaaatgaagcaatgattagaaatttatccctcatgataggctcttatagcagataatactgtaaatgctatgttatacaacagactttatttttttttctttattttattttagagatgaagtctcgctctgtagcccaggttggagtgcagtggcatgatctcgactcactgaaatctctgcctcctgggttcaaacaattctcttgcctcagcctcccaagtagctgggattacaggcacccaccacacccagctaatttttgtacttttagtagagatggggttttactgtgttggccagcctggcctcaaattcctggcctcaagtgatctgcccacctcggcctcccaaagtgctgggattacaggcttgagccaccaggcccagccagttatacaacagactttaaatgctcctttgaaagttgtgctaaataataaaattgctctagatcacttagtgattaacagagaagtgtctgtgtagttgttggcacttcttgtcacccatggagaaatacatcacatcaggtattacagagattcagttgtaaggaattaatgaatagactgcttggttaaagtgagtagattctttacctagcacattctttgatctatttgattttatttggttggtttggtttatgggaccccaggtaaggagcatactccaagctcttggtattatcctcctgataatcataacagtagtctccctgctgcgttgtattctctcaaaaattttaaacgtttgcatgcagccatctgtagaatgtcaaatggcctttcttcaactggaatgacaaaaactcaaagaaacatgtgatcatgagaacatcgtagcctgtgagtgatatgctgagacagaaaacccaaaatgatggtaactgagagtggtgataaggccctaagtattggtcacatgctcacctaagtgagaaccttaccaaaaagggagaggaggtttttaaacaaaattatgggagatcattgttttggactgagctcctgcaccaggccccaacaaaccagacaaaagcaaaatggaggcacttatgctaaaagcagcataaccaaactgaaactttaaggaaggagataggtcctaaagtgaccattttctccccctgtgaacagtagattccaacaaaagaaggttgcccctactgtaaccctcatgaacacacaaaattacttgacatttacgatgatgacagagtgacattaattcctaaagttttggtctatctcccaaagttgagaggatgaccaaaagagggaaattgctaaattaagcttagcccaaagctgcctccttacatattttaagtttggcctaaagatgtctggacatagtgaacctgacttgaagtgcaaacagactgtaatcaactcctgtgtcagctgagcctcataatcagttggccaatcaaaggcagccaactcttcaaattgggttcaaataaggcaaagcccaagctgtgaccaatttggctgttcctgaacctcacttctgttttccgtacattgcttctctttttctgtccataaatcttcttccaccacgtggctgtgctggagtctctctgagcctgctctggctcaggaggctgccctttgtcaagtaaagtctgttaaacttaatttgtctaaggtttttaacaatgtacacatctgtatgtgtacacacctatacatgtatacagacatagaagatacgttttacgtatttatgtatataatgcatatgcaaataatgggaaaaataaataaggctaatttgaagagggaagctctaaataacagtaaatgaagtaactaaattaaagaaagccctctgtacagtaggacctgacagtgggcagtgcacagggagaaggagcagcacaggtgaaatgcagcagctactttgttacagagaggaccaagggactgaaagaaatcttcttaagcataaaaaaattcaaataaaccgggtgtggtggctcacacctgtaatcccagcactttgggaggccgaggcaggcagatcacaaggtcaggagttcaagaccatcctggtcaacatggtgaaaccccttctctactaaaaatacaaaaattagctgggtgtggtggtgggcacctgtagtcccagctactttggaggctgaggcaggggaatcgcttaaacctgggaggtggaggtttcaataagccgagatcacaccactgcactccagccttgcgacagagcaagactcttgtctcaaaaaaaaaaaaaaaaaaaaaaaaaaaaattcatataaaaggaagcaagcatgttgctgctgggtaaatgatgaaaccatttcaatttagtggcaagcctgggatgttcaccctcaccattgttaacacacagcatttgcagagagctcatacagattgattaaaggacaaagactatgaacacacaatgcacacagccaatccccaaaaccaaaaaccatggaaaaagctgtttaaacacactaacagagaaatgaaaattaaaatgaacttgagataattaagtttttactcactgcactatcaaaaaaccaagggctatattaccaattgctggtggggaaataaagtgggtattaatataattgtttgtggaatcgtcatgtttatctttttagaaataaatctgacaacactttttttcattaaaaagcctatatcctgtacctcagcaactttactttgggaattctataagaacctagcctatggacatataagccctgatatgcaaagtatggctgcatgaattttggtatatacaatcctatccattaaatactaagcaatattttaaaggaattacttatataacagatacatagaatgacttgaggaaatttatgaaaaaaaatgcacgacaatggatttagttaagggcaaaaagaaaaacaaaaacaccatgttgttttagaatagtttgaagagaaactgaaattcatgggttaaaaactgtggatagggccacagggtgcagtggctcatgcctgtaatcccagcattctgggaggccgagacgggtggatcacctgaggtcaggagtttgagaccagcctgatcaacatggagaaaccacgtctgtactaaaaatacaaaaattagccaggtctgatggcgcaggcctgtaatcccagctacttgggaggctgaggcaggagaatcatttgaacccgggagggagaggttgcagtgagccaagatccaagatcacgccattgcactccaggctgggtaacgagcaaaactccatctcaaaacaaaacaaaacaaaacaaaatggtggataacaaaattcttcatcaaacataataaatgacacgaaaactacaaaccaagtccttaacaccccaactttttccagtttgatcacccatacaaacccatagccttacagctaagtgacagaaatcccagctccattatttagatctcatgccttctacctacaaagaataacaagatataatgatgtaaatcttgactgcatttatattatcactgtttaaacagactcagagtccatttcaatgtgtttaggaatttaggagaagagtttctccaggattttaaaaaaatgtagttaaatttggaagatgctggtatcagtattaaccagtaagctattattcgtgggaaacaaaaaatgaaaaaaaaaatagccctgttgaaaataaaattattctttaaaaacaacataaagggctgagggtcaatttaatcatacatttcattctaacaaaatgaaccactaggactgcttggagtggccatttacatcccaaacggaggtctctattttactctaggataatgccagttaaaacaattaaatccactgggcatggtggttcacacctgtaatcacagcaatttgggaggctgaggcaggcagatcacttgagatcaggagttcaagaccagcctggccaacatggtgaaaccctgtctctactaaaaatacaaaaattagccgggcgcagtggtgcgggcctgtagtcacagctactcaggaggctgaggcaggagaatcacttgaacctgggaggcagaagttgcagtgagccgagattgcaccactgcactccagcctaggcaacagagcacaactctgtttcaaaaaaaataaaaataaaaataaataaataaatcatttaaacaccatcacttattttagtctgagagtgagattagcaaaggagagggaagaaatctattaatacaacatgaatgaacacacaacaaagacaagtgtactgagtagtgacatagtttctaggtcctttaatacaccttctctgtttgggaaattcgcaacttcaggtctcagggatggactcaatgtagtcaataccagcacttctcaactgccttacttaactcagaccattaaaatgtataacctacctgaaactacggagccacagtctagaaactagttcctcagagatctgaatgttccagcaggcctctaatctacatagagcaatgtttctgttaattgggaagtgtaagaagcccatcccataagaaagtggtccactttggagcagttactaaacaccttttgttaagccactcattttaaactgtcttttaatttttctgaaaaatccacgcttgttagtcagaaagtacacggaaaaatacacatgtatccatttgtaatggttctcattacaaacattacattaggattggaactacatcaggcatattcatatctttaggtaattttgctactgacatgacttctgagcatttttatagtgccataaaaaaaaaaacactgtatgtttgtatccagttaaggagtagatgtttactgctggcttattaattttcagacattttttaaagacactcacagagaaagagtattcttattattgattgggaccacagatcttgataagaacgctgcacaaactcaagaccccaaccctcctctggtctgttacatccttgcattgcattttccataacaaacattgcccacagcagattcattaccatttaaataaccagaggagccctcctccgagtcttcaacatggaacaatggcaatggggggagggcagcagaggaactgcccttggtgggggcctgctcactgtctctgtgccatgcacctaccctacacgtgctaccaggtggcggtgcgcacagaggaaagagccgaggccttcaggtcagctgtgggaccttagaaaatggatttagtttccaggagccttattttcctcatatgtaaatcagggataataacaaccaccttgaaagactcaggacaattatatgagctaggtgtttccctgaatcacatatcacatgggcagaggtgagaagagctagaaatggtatgtgtcagtatgggcacgcagccctggcctctacacggagccattgcttccttgcagggcactgctctggtcatcacagcccacaccctgccatgccatctatctctccctctgctcagcaggccctatgtcccatcccagggacattggagaagaagcaaaggagtgttacaagttgccatttatatggtttgtatattgctctctgctcctccaacattctgaagaggggggactatttcattattcctggatctaatcactaagaacttgaggtaagggaaagaatgccaccctccccggggtaccacattcctttttgctgtgtccgataaagcaccaccacagtgaaaaagacaaccgtgactcaggtgtcattgagtctggctctgtcacccaggctggagtgcaatggcacaatctgggctcactgcaacctccgcctccagggttcaagcgattctcttgccttagcctcccaagtagctacgattacaggtacccatcatcacgcctggctaatttttgtatttttagtggagatggggtttcgccatgttggccaggctggtcttgaactcctgacctcaaacaatccacccaccttggcttcccaaagtgctgggattacaggcgtgagcctccgcacccggccagtgttctatcacacttctagcagtggctttcaatttcctcccctgacaacaaatctctagtactacttaggtactgagaatgatcatttcagtcccagagaacatcagaactcccaggcccatggccactacacggagcaagcatgaggctatggtggcccttgtgtcattggcgtccagaggaactgcaaatatcctccatgtgacagacacctgctcacctgtgaagacgtcagcatgttctgctccagaatcatcaagtcctcagttcatctctaggtttcaacaaacaatacatcttttctctggccctggctccaccacttactcatctttggactttgagaaagtcatctaatatttttgagccacactttcatcaaaggagaaagaaatccacatttctaaagggatattgtgagcacaaaacagatgcttatagaagcaccttagggaaagtttggttcgtaaacggtgatgttgtagatatcaccaattctgttgtgtcattagggaaagtttttcctgactctatcaaaatttccttgtacttccaatgagcactactgcaacatcttatgaagaatggatagcctaagttagccaagtcactataaactttcatttctcttttgttagatgaaccccaagaagtagatatagtcagtaccaagtgattggcatttgatctttggtgcagaaatctgaaatgcagtaagaaggcagaggccagttttgccagcaagagtccccattctaacaaggttagtgtggaatggaagaggatgggcaggttgggagcctttttcctggtgtccaccccttcatcatctgtcagatttccaaaaggaaagttctgtgttgttggctttttgcgtatctttctttaaatcgcataatctttaccactgaaaacaattcaagcatgagaacatgcacatcaatccagatcgtgctcattgcattattactgacctgcacagcagtcttgccacactcgcaggtccaccttcgggatctcgctgcagttcaggtaatcctgtgggtattctgcctttacaaagacatcagcctgcacttgctgaatgctgtcaccattgtcacaaagcacccggctcagggacgcctgcttcagctgagtgagttgtgccggggtaaatactccagggttttcataccagaacctggtagtcaaccaaaaaaaaaacattgtcgtgggtctgtggcctgagaactcagctgcatgtcaaacagccacaatgcaccaagaagagctcaacataaaagacgcatactgaaagaattatgcttgttctccaactgagtatccttttaattctctccaatatttacaacattcttaaatcacattcttctgaactatcactttctactcaagctctacaaaatgattcaaaggaaagttttctaaggttttcctccaaaaaagaaaagtccattattacatttttaaattttttttaatttttaattattttttgagacggagtctcattcactctgtagcccaggttggagtgcagtggcatgatctcagctcactgcaacctctacctcccgagttcacgcaactctcctgcctcagcctcccaagtagctgggattacaggctcctgtcaccatgcctgcctaatttttatatcgttactagagacggggattcgccatgttggccaggctagtcttgaactcctggcctcaagtgatctgcccacctcggcctcccaaactgttgggattacaggcgtgagccaccgcacctagccctattgttgcatttaaattccatgaactaaccttagaaactgtctgagcaatgtaacattaacacgtttgcctaaaaagaaaatagcacttttgataattaatatatactatttggttatatccatcaactaactagaataagcacattcaattttaaatgaaaggatacaatcaattttaaatgaaagaactattaaagtcaatctttgggtacattcagcaaagtcaatccttgggttcattcattcagtaaatatttgaatatcacatgccaagcacttttttgtgctgagtatagagcaggaaattaagatggtaggcaaaaagacttcttgccactatcttgatgttatggactgagctgtgtccccctaaaatgtatatgttgaagtcctatgccccagtaccttcgaaggtgactctatttggagacagggcctttacataggtatttaaggtaaaaatagatcacgtgtgtgagccctaacccagtatgtctggtgtccttataagaaaaggaaatgtggacatagataacagagggaagaccacgtgaagacacagggagaagatgccacatacaagccagaagagacgccccagtaggaatcaaccctgctgatgccttgatcagcatctaacctccagaattgtaagaataacaaatttctgttgtctaagctatccaagctatgggactttgttacaacagcctggtaaactaatatatatggggaagacagcttaacccccaaactgaaggtttttcaattattttcagtctttgactacatatatttttaaactattgccaattgagcacattaacccaattatgtgagtcaagaaattcagtgttaaaaatgattttaaaaaattaatgaaatatactattaattgttaccaatgtgcaataaagggaattaaatcctttgctactttctctataatttgtaaagggaagggatttaaagtaaagaataatttttattgtaactttaattaaaaactaagctctgggctttgtttcaagtcttatatacatcatctctgaaataatacaaaaggttatattgtcaaacagattcacaagattcctagatcttactcaacactaagcttcactaatgattcagaagataccatgccctggaacatacttgattccaagcaatagaagagcacatgtccactcaggagaggctgcttaggtttgtatttcttggtttttattcttggttagtcttggaacagtaaacagattacgtgactaacttacattctccagcctgctgtttcccattatttcatgattaaatttatttacaatgaacattttagacaaaccaagaaattttagagaagagttcccagttatctttccactcgtaaatgccctcataatgtaattttacaaggagatctggtctagggtcatcaggtcttcctccatgagaatgaagggagggaatctcaaggctgctaccagttccttccttctcaacatcattgaaggctgcagacgtcctatggaataggtacaattgttactcacactttacagatgaggaacctggttctgagtgatacatgtctaaagttaaacagctgtaagtggtgagactcagatttaagcacaacgtagtccatctagccttcatcctctcaatcgccaacttctattgccttttgagaaattctgtttcttctcttcttacaaagatttacaaaaataaatgttatctgataatattggtggttacaaaagttctgtcacctaatgctatctgatattcattatactcaatatgcattaaatcataaaaatatgaatcacaatgttaaacatatacattttgggtcaaaaacaacttttgtgatatttaataagtataacagataatcattcacctatctccatctcttagccgctgaaactgggtaacaaacaggcacataagtgttggtcccactcttgtaccaggaatcaggtcttcaaccataagggcgggccagaggtcaatgtcacctggagagccgtacaacctggaacagagacaggcagacagcgcacacctgagactgaaagtggaattgaaaatattccttatgtgaatgaccaccaagcattattttatccacacaaaaaaagaaaagtagatatgattactgtattctcatttcatgggggaaagcactcaaatgaaggaaccctcagggatcaccccataggcaggaggcagagtcataacctaaccaaggacatatgacaccaagcctcatgcaatgtcccctgtgcaattctttataattattctctaaacatatggagtataactgtatatatatatatatgcaagtgtgtgtgtgttatgtcatgtataaatgcaactagctaattccttcagaaatacatagaaaattaacaattcagcattgagaaatgtccacatcagtgtatatgctaggtatgctaaaaagtcaatagaaaatcataatttgcggagatgataagataaaaagtgttaggtaagttttctcttgataaaaaggcaataagtatttgacctaagatttgaagcaatttttaaaaacaacaaacaaacaaaaaagcacaatgcaaatgttgattataagccaacagccttggctcaccactcagagaaagaaaatatgtccatatgcttgacactcccagtaggagccactctgattgtttttttctctctactctaatgataaacgtgacaccaacttaacttgtcccttgttttattttgtttcatacatatgattctctaaactacaaatagtttagtttgcatgttttaaccttgtcacaaatggaaatatagtattcatacttcctttttctcactcaacagtttacttggcgatgcaattgtgtggttgcatatatttgtactttcttcattttctctgctgtatagtaaacagtctattattggaaaccattccaatttagtttagttacactggtgatgaatacttgtgaggttttcaacttttacactatgaacattctctacatgtttcttcatatgcacaagagtttctctagactaggcgtcagcaaatttttaccataaagggccagagagccagtattttcagctttgtgggacaactgtgggttctgttgcaactacccaactcctgttttgcataaaagcagccatagacaacatataaacaaacagacatagttgtgttccaataaaactttatttacaaaattagaaaagtaggtcagatttggccacttggctgtggtttgcagatccctgctctagattacgttgtgcaagagctagaattctgagggcagagtatagtatcttcaattttaatagttaatgccaaactgctatatgaaattgatgtatgattcatattcccataatgagtacacggaattactctatgatagatatccatatgtatatcttcaatgttaaaagacaatgccaaactgctatccaaaatggatgtacaattcatacatccacaagaagcatatcaaaattctcaatgtcacctggagagctgtacagcctggaacagacaggcatattattcctcgacacattgtaacttattccattttactttattttgttagtcaactctcatcactgctgcccttccccactttctccttcttggtttctgataatagatggactttttagatttccaagtgcctgcttgaatgtttgagtgctgtttaattctggtttgaatgttgtgttattgtttcctcctgtttcaattctttttctgagagatttttcctctgaaatgttttgatttgcatttctgttttcttgttacatagctttatttgaaatacatctctctctctctcttaattcctatgcatttcacgaaacgaatttctggttgggtagcatactcttctttcactacagggaagtgcagtctttttgatgtctgttctggtggtgatggggagaagtgagagttaacatgttttgcttctcttctctctctctctcttttttttttttatacggagtcttactctgtcccccaggctggagtgcagtggcaggatctcagttcactgcaagctccacctcccgggttcacgccattctcctgcctcagcctcccgagtagctgggactacaggcgcccgccacaatgcccggctaattttttgtatttttagtagagacggggtttcaccgtgttagccaggatggtctcgatctcctgacctcctgatccaccctcctcagcctcccaaagtgctgggttacaggcgtgagccaccgcgcccagccttgtttctctttaagtgctagagcatccttaatttcatttcattctgctttaatgtcaccatcaaatctgaagtggcactctaccctttacacacacacacacacacacacacacacacacacacacaaagccaaagccatttctggacactctcagatttgtaaatggtgttgataacttccaggtttccagaatttcacttgacaacttagtacttggtgctggagtttttccttctaggggatttttttttttctttttaagagacagggtctcactttctcgcccatgctggactgcagtggtgcaattgagaggtgacagcgtgctggcagccctggcagccctcactcgctgtcgcggcctcctcagcctcagtggccagaggccactctggccgtgcttgaggggcctttcagcccgccgccgcactgtgggaacccctctctgagctaaacgaggccggagccggctccctcagcttgcagggaggtgtggagggagaggtgcaggcaggaaccggggctgcacagggtgcttgcgggccagcgcgagttccgggtgggcgtgggctcagctggcacacactgagagcagctcgccggcaccacccgtcccaggcagtgaggggcttagcacctgggccagcagctgcggagggtgcaccgggtcccccagcagttctggctggccagcgctgcgctcgaattctcgtggggcctcagctgcctccctgcggggcagggctgaggacctgcagcccgccatgcctgagcctcccccacaccgcgggctcctgcgcagccccagcctcccggaggagcgccactgcctgctcctgctccacagcaccaggtcccatcaactgcccaagggctgaggagtgcaggagcagagcaggggactggcaggcagctccacctgcagccccgtgcggtatccactgggtgaagccagctgggctcctgagtctagtggggacttggagaacctttatgtctagctaagggattgtaaatacaccaattagcactctgtgtctagctcaaggtttgtaaatgcactaatcagcactctgtatctagctaatctggtggggcgttggagaacctttatgtctagctaagggattgtaaatacaccaatcagcactctgtgtctagctcaaggtctgtaaatgcaccaatcagcactctgtatctagctaatctggtggggacttggagaacctttatgtctagctaagggattgtaaatacaccaatcagcactctgtgtctagctcaaggtttgtaaatgcaccaatcagcaccctgtgtctagctcaaggtttgtaaatgcaccagtcactgctctgtctagctaatctagtgaggacttggagaacttttgtgcctagctcagggattgtaaactcaccaatcagcaccctgtcaaaacagaccaatcagctctctgtaaaatggaccaatcagcaggatgtgggtggggccagaaaagggtgaaaaagcaggctgccccagccagcagtggcaatcctctggggtaccattccactctgtggaagatttgttcttttgcgctttgcaataaatcttgctgctgctcactctttgggtgtgcactggctttatgagctgtaacactcactgtgaagatctgcaacttcactgctgaggccagcaagaccaggatcccactgggacaggacgggaggaacgaacaactccacacgtgcggccttaagagctgtaacactcactgcgaaggtctgcagcttcactcctgaagccagcaagactatgaacccaccagaaggaagaaactctgaacatgttcgaacatcagaaggaacaaactctggacacatcacctttaagaactgtaacactcacggcgagggtctgcgacttcattcttgaagtcagtgagaccaagaacccaccaattctggacacacaatcacagctcactgtagcttcaagctcctgggttcaagggctcctcttgccacagcgctaggactccccagccttttctgcattttttcttctgtccttcccatttttttgtccatggagatttttttaattagtttcccttctttttcccaatccacaaacttccagtgaacgtggagttccagtggcagctccgataacttgttattttcaaacttgccattgaaactcatgccattttctgtctctcactaattgaaggtatgagtcatgttattttgtgttctctttgttgatcttacagatttggagaaggctgtggtgagagatttagaagtaagggacaattattttcctagggctaacctgaaaatatgtctttttcaaaaaatttttggtaatctgaggggtgtgaaatggtgtttcattatgattctggatcttcctaattaattatacaattgaatatcttctacgtgttgattgaaaatttagtttttttcttactgaaatgtgtatttatactttttacccttttttaattgggtttttttttcttactgttaattatctatatattctgaatgctaatactgtgatctatgtcaaaatgtattccttgtatttgtggtgcttttaatcattctcattatgttagattctgatgaaaatattttcttaatcttaaggtcattttatcaatttttatatcaattttacaattttgtgtaccttactaaaaatttctttctttccccaatgccatagagatattctcttttattttttgtgaagttaaaattttgcctctcagatttaattcctatatctatctggaattgattttcatatatgatatgagatcagaatccatactcatttttaatccaagggtagccacttggtaccgcaccacttactgaatatgtcctcacttctcactaatgtttcttgcagctctttcaaataggatatttccatatatgagccctttttcttgtggctttctattctattctattgtcttaattactaaaagctttatatcagggtatccaatctcttggcttccctgggccacattgaaaaaagaagaagtgtcttgggccacacataaaatacactaacactaagaatagctgacgagctaaaaaaaaaaaaataacaaaaaaactcataatattttaagaaagtctatgaatttgtatgggaccacagtcaaagccatcctgggctgcgtgcctcccacaagctgcaggttggacaagtttgctttataggaagggttgctaactggaacatcaagccaccctaccatgttcctcttggccatcagctttaccagtttaattttaaaatcagctgttgatgccacaaagaagcactactaagctcttcattggcactacaataagtatatcatttgtgggaagtactgacctatcaatattactgaatctttctacacctgagaatgttcgttgtctccactctttaataactatctgtaagtcttctaattatcattacaacacaatgcacaacttgttagacttctttaccttttcttctctttggaagagcaatttttctttatattcattcccatttactacatagagtatttgcaaaaaaaagtaatatggcagttttatcctttctgatctttatctttttcttatgttattgtcttgattgtacttttcaatacaattttgaagttgctgccatttatgtctattcatgtttttaaatggaatgcttctaacaattaatgcttacagtgtatttttgagatgttctttatttagttaggatgtttcatttttcctagaattctaacagcctttcttaaattctagagaaatgttgcattttacatggaatgtttttttctgccaatactgaaataatcacctttttctttttaatcggcttatgtcctaaattatatcaacactttaaaaatcttggactaattatattactgaaacgaacctattatgatcatgttatatatgtatgtatatatggcattcaacttgagttttcaatgctttgtttataatttttatatacatttatatgagatgttgtcttgtaaatttccttgcctcgtactgttattgtttattttaatatcaaaatgttactggcctgagaaagtaagttagatagtgttccttcttttgcattccctaaatgactccatgggcctttggaaccacccaaattacatttataaacggaacactaggtttgattgaagagcatatgtcaaaactttttctgaaactcttctttcccacttaggtcttctagagtcttttgccaaagcattttgtttctctttattgttctgtgtcttatcctgtgtttccaataaaatgagtaaaaaaaaaaattttgtccaaggctacaccaacctccaaaataagtaaacaatattttgttaggtaagaactaaattttaattattgctatgagttgagttgtgttcccatgaaaagatattaacatggggaagtactgccccccagtatctgctaatatggtaatactatttggaggtaggatctttgctgatgtgatcaagttaagattaggtcattagggtggaccctgatccaatatgactggtgtctttatttatttatttatttatttatttatttatttatttatttatttttgagacagagtctcactctgtcgcccaggctagagtgcagtggtgcaatctcggctactgaaagctccacctcccgggttcatgccattctcctgtctcagcctcccgagtagctgggactataggcacccgtccccacgcccagctaattttttttttttgaccagaggcccaaaagatatgatttaataagaaaaatagaaacactaatgacaggttaactgctaaattatggctactgctgactttaactttcataacaatagtgaatttttttattattattatactttaagttttagggtacatgtgcaagaacgtgcaggtttgttacatatgtatacatgtgcagagacggggtttcaccatgttaacccaggatggtctcgatctcctgaccttgtgatctgcccgccttggcctcccaaagtgctgggattacgtgtgtgagccaccgctccgggccatggtgtccttatctttaaaagggcagtttgaacaaagaccgagagtgagaatgctgtcctacagcagaggcagggactgaggcactgcagctgcaagccagggaaaccaagggttgccgggaaaccaccagaaactaggaaaagcaaaggattctctcctccaaggtcctgaggaagcgtggccctgctgacaccttgattccagacttccagactccagaactgtgggatgataaacttctgatgtcttaagccacccagtgtgtggtctgttgttacaacagcctagaaaactaatataattatgaccttccattgactttatgctaaattcactcctaatttttaaaacagtttgcctgccaaaaatgagactattgtcctaaaccttacacctgcttatttttagtataatgtaattttaatgtatctttgaagagaccattcaattaattttttaataggcttgattttgtacagcagttttaggttcacagcaaaactgagtgaaaggtacagagacttatcatacacccctgcattacttctttaaaataagttaaaaaaaaagatatattgatctctgaatggttagaattaaattatgcagaatatgagaaataataataatggaaatcagaaagttacatagggtcagatttatgtctatgaactataagagtccagaaaaaaatagtacttagaagttttagaagttagaacattgaactttcccagagagtataatcctggctttgttaatttcagttcttcatcattgatctttttctcatgtcttaaataattcagctaaacattaactattcctatccttattgttccatattactttaccatggctcaccacagcagctccaagaaatgttgggagtcttcgtgcatatcctatataagtaacttattaatcatgtagagcctatgtttggaaaaataaatcctctccactttccttagagggaagtctgagatccataagctctcaaaacatttcttattaattcatctgcattactctggagaatgtcaattctattttttttaactttttcaatcgtagacattgtagctcttcttttgtggttataattggtcattagtaagattataaagcagcttctgtattaatagctttggtatgtcatttcacttgtcaactttcgcccccaaaccatttgttccatatcttaaaatgataatccaatacaaagcggcatggttttatgacagcaaagacatctgtaatctgagatggcatccgagggcattgtccctgaaagtgagaatgacaatacacaccaagcccctttctgttgtgtgcagcagcaaatacaaagggcgctggtaactttggccagaattcccctaaatgcagacaacatgagagagtaccgcccaaagcagggctgcaaactgccatcataaaatctcctggctttgttaatgtaccatctaactgtgtttaaatttaccttttaaccttttccatgattgcaaaccaaaaacacacatggaataataagagtaaacagtctagctatattttaaaaaaagtggtgcttttgtcggtattttgatatacagagagttgaaagaaaagatttgcagaccttgaaatgaactatttcttgccacagagaccacagtgtcaagccatatctaatttcataatgacagtttgacttaaagttggctttagaaggaaggataataataataacaactttcattcagctggatcattcacagagacacaagggcagaggtcctgtatggaatcttttcagggttatacatgctcacctgattgagagagtgcaagatagatatgcagcaatgtatggtgttaatgaaacaaataaaaatccttccccaaaacacaaaggaaaggtgctttgtgataaagtgtccttgtggaaaagctttctgagagacatctggattttcagagcaaatatgatcatttagtagcttttagagaaaaaatatatttgaaacatgtcctttggcaaaaaaggcaaaatgcccttgtgtactctcacacagaacaaaatttcctctgcctcaggatgactgcatcaatttaagggaagtaaatgacattttacatcagagaaattaaaacaatgaaaacatcctaccccactagcatgattagtcagatcagacacatggtacaaaataatcttatggttaccagcactgaaataaaggtgaatgacaaaaaaaaaaaatcttatggttaatttgtcattaacaacaccagacagaaaaattgtttctttacttgaaagaaaattttcccagaatactttttattaaaagctatctcgggactctagatatctaatttcctcaaaaatcttaaggacatcacatttttgtaaaaataaattcttctacaattaaaaagtatgcattttagaaaactatatataaagctctatgttaacaaacatctctgtaacagaaatagcacagaaaagtaaacaaatgggaaaaataactcaagcgacttttgtttttaaacaagtatataatactattcattttttgcttttatgggaggaggaacttttctttctactactactttaaaggaggaaaataatctaagctatttatataagattttacatagaactaaaatgtgatagtcatcaaattttcaaaagcagagtacagaatatagaactctgtaattatgtctagtaataaaaataatcatctatactttgttttttgattagaggaaaaaggaaagaagggatataaatataaggaaaaaattaagaaacagaataaaatcaaagaaggcagagacatcaacaataagacagagataagtccaggcagtcattgagactgagatagacttccacataagaaaagagacaggtccatatccaataaaaattcacatgtattgaacaatagcatgtttgaacaatacttacagcatgacagctattaacaattatatcattttttaactccagtggagaaatttgctttctccactggttacatacagtaaccctttgaaatcctgggcctgagacatattccccttttatttaaaagattgactaaataaacatcaagtgttaaagacacacagtctccaggtgagactccctacatcataaccacagaagcagaaaaatagctaaaaaggaaaaaaaaaaaacactttccactgtgtaggacaatgtcattaaatgttatgtttacacactacataagattagttagcatacattctggggtaagtaatctacagtaataaatcatgcttttaatttctgattgagaaattaaagattaactttccattcaatccacatattcctaaggattccctgagttttctagccaccaatctagactaaaaaacgactaattaacagcccctgatttaaagagcataggccagtcagaaggcataaacagatatttaaaacataaactacgtttttataccatgtgatatggtttggctgtgtccttgcccaaatctcatcttgaattgtagctcccataattcccatgtgttgtggaggggatctggtggaagataactgaatcatagggtggtttccccatactgttctcctggtactgagtaagtctcacaagagctaatggttttataaggggtttctcctttcacttggctctcattctctcttgcctgccaccaggtaagacatgcctttcaccttccaccatgattgtgaggcctcccagccgagtggaactgtaagttcattaaacctctttttctttataaattacccaatctccagtatgtgtttatcaagcagcatgaaaatggactaatagaccatggtattgatataaaagcagataacgaataaaagaatagctctccattggtggaattcaagacatttaacagaaatgttgggtgattcattcttttttttttttgacataagactcttgctctgtcacccaggctagagtgcagtggcgtgatctcagctcaccacaacctctgcctcccaggttcaagcaattcttctgcctcagcctccggagtagctgggactacaggcacgtgccaccatgcccggctaatttttgtatttttagtagagatggggtttcaccatatcggccaggctggtctcgaactcctgacctcgtgatccgcctgcctcggcctcccaaagtgctgggattacaggcgtgagccactgtgcccggccaggtgatttattctaagcttcagaaatcacacccctatgtcatgatactggcagtagtaagatagatagatgactgatagaaaaagagataaagatagatacagagagatgacagagaattagaagcaagtgatagatgactgataaagagaggtagagatgatatagatagataagagataaagagagataatagaaatagataatatatatataggtagttaagtggataaatagatgatagatggaaacgtcgtctctactaaaaatacaaaaattagccaagcatggtggcacgcacctgtagtcccagctactagggaggctgaggcagaaaaattgcttgaacccaggaggtggaggttgtagtgagccaagatagcaccactgcactccagcctgagtgacagatgacagagcaagacttcatcttgaaaaaaaaaaaaagaaagagtcttttctacatgtcagccaagtgacaagcattttatttctattattctatttaatcaactgtatacacttgatttataaatttcatttatgtcctcaaaactgcaaaactattttggcttgatgctctgactttttttccagtcttatgaagtccattacgatgtgagagcttctccactcaaatctgatttcccactgttctactctttcacagtcagagatgaactaagcttatccttcattcagcaaaggaagcctatagttaagacctcctcaactgtccacaacaaaccatgccactgcatagatctcataattaccacccactcttacaattctcccttttagacaacattctaaactgatgaaaattatgcagttataaaaatgagcagtcttcatttcgtttctccagctcataagtcccaatagggcctgctgcactgaaatttaaaagcaatgttaactatggtaatagagccatgttttgtttccaggtgggcatgctccagtgaggggctataaggaggtctcattttgtatgccaggtcccatcaagtagagtaactgctggctgtcatgagagccatgtctagaagaagtcagagattgcctctatgttcggtaggaaaaaatcctgagagagtttagtagtgtttgtcacagatgcagtaggggagactggtctcacaattgctagatttttgccggttctaagccagtgagtgcttcatcattcactacagtatcagttgcataccttttattaaggaaataggtggaataaagtagatataatacatatttatgaattaacgtaattactaattgaatgaatacatgaatattacggtaaaaagatgtttctatttcaaaaccgctaaaaatgtttttgttgtttttattttcaccttaaatatgttttcaagttttaccaaatgtcattttggtatactctgagatgactgaatgggttttataactgtatattctaatataatgccctatattgatactaactcagttttatattctggacttatattaattattcctccttaatcatgttgcactattcttaaactattcatgatttgactgacaagcattttttaatgttattccctgtaaaaaatgacttcagggttaacattacagatcctttcttaaggtttataccagaggcatgctaatttcagctaataaatcaagtaggttatcatctttttatatattccataatactgtataatgtgctctttaaaatttgaaatattttgtctagctagaactcagaaactattaaaagtaatttttcaatgatttcaaattgatgtaggctctgttttgatattggctttcttattattcgaagaccaaatagaaaattattcaattactattattttcaagctatctttataaaaacacaaacagtaacttcttagaaatctggtttttttatgtttttgtaacttaactttcagtttgggaatatattaatcagtctttttttcaactttttactttattaactttcgcttttctatttattctttccaacttgagttagacacttaatgtaagtgaaaaatatctgctatgctcatcctgtgagatttttggttgttgattaccataatctcgcatatctagactgatacaggtttcaaatacatacattctacttcctaagtgagatgttctgcagatgagtacattggtactggttctgttcattaaatgtgaggactcaagtctttcttcaattttataactcttctattgctaacccttcaaactgggtctctctctctcattcctgttttctacctcttggaacttctataaatatttgatgttttcaatcttttctccctatctctaaatctcccttattatttattattctcatctgtctgtactacacactgagtgaattcttcagatttatcttccagttcactatttttttaattcagctatttctagtatgctgtttcactagctactgagatcttaatttaaattatatatatcatgtcttgaaattcagtttttcaaatacctgtatttttaccttttccttttaacatggtttctattcattctcttacttaatttaatgttaaatgcacagagtctctcctattgttttaatctccctaagttccattttaattttgttttgttttgttgcttttcatttattctcattgctgactatcttgcagctacatatttgctgaaatgaattttaacttgcatgtgtgagaaggagagaacttcttgggagtttggtttgtcattcccgtgattgtctgtatgcaccaggtcgtaaaagaatgcctagagagtgatttgacatgtgcttgtgcgaggatttcaggggtttcatgtgcccctgggctgtttttcatgttaatttatcttcttttctttccagcaccatgatgtttgagtaaattcagattcttttcctgtgtaacacaggctgggattcgaatttcaaaaattttcctgtttcatttcagcctcggtccctgatgtttacttgagaaaccatattgctgcttcctctttcctgatgggaaggcattttctagttcccttcatccttgcagagatgaggcaggatttcaggctttctgcagagaactctgtttcaggcctctgactaggtggattctgtatccccttaccctgtgtgggtactaaaacctcaacttctgatccctcagagcaatgtctatgactgataatcatgggccaagaaagcacattcattcctgatttctccctggcttttaagtttccttgtcctttgtgacatataagaattgcccatttgtttgagcttctttatgtttaaagccattctttatagttttactttttgttcaatggttctatgtattttttagcaaaaaggaagctcattttactgaacttattatttgccaagaaattctcaaactgccagtgaaaagaggctattagtcaaatgccttataaaacacatcattctctgtttaaagtagcttttatgtcacatttccccataatggaacaggcaagaaaaacaaagaaaaggttttaatattatatatagcacaaatgtttatatattttaattcattttcaattattatttcaggtaattaaaaatacaaaataagctaatgacttcactggctatggaagccatgccccccccaccaaaaaaaaattccattctagctaaaaaatgttatgaagtaccaatcattgttaatgagaaaatgaggatataggccaaactatccaaatgttgcaaagaacatctggcattatgcaaaatgaaagtaaatgttgactcaattcactctttaaaaacattctaaactgattcaaactagtttttgtctgccttaggctcataagtatttgcaaaggagaatattttagagccatttaaaagcattcagtaagtttcctgtggcaaccaatgaataatatgcccagggaagtggaaactcagatagatcatgcaatttgcctaagatcacaaagttaattactaggaacccaaaaaagcacctaggtagtattttcagcacattttctgaaattctccgccttctccatattaattctggatgaaataagtacaaatattaattcataaatatctttattataatttataaagcctttaaaatattttctgggtattctataaatttgcatgataacagttatggctctcttcacacaaaaacataaagcacattgactgctttcctcatttctagccaagaagtgatgtggattcaggttctctgaggatcgctatttgtttaatgaggtgacaagccgacctcactaaatggcataaagcacagattttcttttttttttattttattattattatactttaagttttagggtacatgtgcacaatgtgcaggttagttacatatgtatacatgtgccatgctggtgtgctgcacccattaactcgtcatttagcattaggtatatgtcctaatgctatccctcccccctcctccgaccccacaacagtccccagagtgtgatgttccccttcctgtgtccatgtgttctcactgttcaattcccacctatgagtgagaacatgcggtgtttggttttttgtccttgcgatagtttactgagaatgatgatttccaatttcatccatgtccttacaaaggacatgaactcatcatttgttatggctgcatagtattccatggtgtatatgtgccacattttcttaatccagtctatgttggacatttgggttggttccaagtctttgatattgtgaatagtgccgcaataaacatatgtgtgcgtgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgtcattctaactggtgtgagatggtatctcattgtggttttgatttgcatttctctgatggcaagtgatggtgagcattttttcatgtgttttttggctacataaatgtcttcttttgagaagtgtctgttcgtgtccttcacccactttttgatggggttgtttgtttttttcttgtaaatttgagttcattgtagattctggatattggccctctgtcagatgagcaggttgcgaaaattttctcccattttgtatgttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaatgtttaagtctttaatccatcttgaattaatttttgtataaggtgtaaggaagggatccactttcagctttctacatatgactagccagttttcccagcaccatttatgaaatagggaatcctttccccattgcttgtttttctcaggcttgtcaaagatcagatagttgtagatatgtgacgttatttctaagggctctgttctgttccattgatctatatctctgttttggtaccagtaccatgctgttttggttactgtggccttgtagtatagtttgaagtcaggtagtgtgatgcctccagctttgttcttttggcttaggattgacttggtgatgtgggctcttttttggttccatatgaactttaaaatagttttttccacttctgtgaagaaagtcattggtagcttgatggggatggcgttgaatctataaattaccttgagcagtatggccattttcacgatattgattcttcctatccatgagcatggaatgttcttccatttctttgtatcctcttttatttcattgagcagtggtttatagttctccttgaagaggtccttcacgtcccttgtaagttggatttctaggtattttattctctttgaagcaattgtgaatgggagttcactcatgatttggctctctgtttgtctgttattggtgtacaagaatgtttgtgatttttgtacattgattttgtatcctgagacttcactgaagttgcttatcagcttaaggatattttgggctgagacaatggggttttctagatatacaatcatgtcatctgcaaacaggaacaatttgacttcctcttttcctaattgaataccctttatttccttctcctgcctaattgccctggccagaacttccaacactatgttgaataggagtggtgagagagggcatacctgtcttgaaagcacagattttcaacagcaacagtggtgccatttctattgtgaggttaggagaaattgattggcataaaaattaatatcaaaattcctcaattttaatgtaaagagaagattagagagtacactattgggagtagtctcacttacagccatttgaaaatatatttcctgagcaaaagaaaatactgagttacatgtcactgaccatgaattttacttaatttaaagccagtctcctgtgttttcattctgaagtatacattttatgtgaatgtcatgccgctctgaaatgaaaaggaaagaattgctacctatagaaagacaggtttccacctttacttagagaatgttttttctttaattttcctgaattttaatttcctaaatttccataattggagaccaatgcagattcacttacacatggcactcagatgtgtgcatagacttagcatccaggcagtctgctaagttcttgacatactttaaattatttcatcttctcagtaaactgatgagacacatacaatgatcgtcatattcgggatgagaagtatgagactaagaacaagtacaaaaggctccacagtgagaaggaaatgaagagagcacgtgtaacaccatggtctgacatcagagcctttattgctgtattgccaagtgctgggttatgctgtttctcatagtctccttctatgctaaagctgaagcaaaacagaaaataaaaacaaacattggcagttgcgtaatagcagtgcaccacccttcaaagatgtccatggcctaatctttggaacctgtgaatatgtcaccttacgtggcaaaagagattttgccaatgtgattcaccaaaggatatcaagaggggaagaccattgtgcattatctgggtgggcccaatgtaatcacaagagttcttaaaagtggaaaagggaataggagagtgaaaagaaggggccccagcgaaggagtgtgggcagcctctagaagggggaaagacagggaaacaaatcatcccatgaagcctcctgaaagggcacagccctgattttagcccagcaagaccaatttccgactcctgacctctgaagtacaagacattaaatctgtctttttttaaggcatctattttatggtaattcattacagcagtcgcaggaaataatatagtggctaaaagcatcaactttggaatcatatagattcagattaaaacctgcattctccagttgacaactccgtgtccttgggaaagttaacaccagctcatgagataacaaaagtgttaatgaaaagtgtgaatgtgcccagggcatatacagaagagatttgcctcaaactattctatatatgttggagcatgaataattattttaaaaaatagcacttcatgtaataaattgtcttacagaatgagaggtgatatatgtcacaaaacactcctttttgtgcaacaaacgccagccaaatatgaaggaaatattattactattagagtaaagctatcccatccataaaacctaagaggttaacaagaaaaatatggcttccatttggggacttttttgatttgactgtctcatattgaggtgagaaaattataactctgaagaggaacagtatcattcctaagtcctgagacatattagaaaaactcatcaaagaatatccttcttcaatcgtgctttgattctgtaacagtaggcatcggcaaactattcttaaagggtggctagtatacccttggacttttcaagccatacaatctttgttccaactattccactctgccaggtagtgggacatagggaatgttaagtaaatgtgtctgactatgtaacaaactattcataagaacaacggccagcctgcatgctgtggtttgccaaaccctgtgttaaagtggcatcttgacctgaaggatgttcactctaactagcattcatagtgccctcttttattctcaaaaatgccctggggtacatagcgctggtcctgtggccacataggcctagaagtctctgctctgcccaggatccaacaaaggcacttgattgtggaatacaaggtgtatttattcaccttggaagaccccaagtgtagatagggactgtcctagacatgtggtacaatggtcatcccacatctgcctcacatttcacaaagatgagcacattcagcaaccccatgagatataacctgctcaaaggaagggaaaggatgtgtcatgggtctgtatttgctgagtaactacccagaggcagagttcccaggaagcaagtgaagatgactctgcagagccctaaccacaagggccactcccaagaccctagagagggcctgcagggtattcacacagtcacaagtgtgcataaagtgtgtgtgcatataagcatcaggccctccttgactttgtagacactattccagatgctgggtgaacacactcaacaaaagagctctcagaggactgggatggggctcaaccaattcagaactatcacctgctcactcaccctccagaaatcatcgatgcaggtatggtgttcaattcacttgtgctgcctctccctcaaattctggtttataacagtgacttaataaatgtctgtgaaatgtagatatcaatgcattcaatgcaagagaagaggtaagtcattctaaaagaaaatatttttaaaaaatggtttagggagttaaagagattagaaaaaagggaattcaaattatgagacaaaagaaacaaccaatattttttaagtatatattgaattgaaaaataaagggtgaagctgtgaaagagaggatctagaaagattaaaagatgatataatttggtttcaaagaggatacgaaatgttatagaggaactgaaaaagcagtagaagactggacactgagaagagatacatagaaaaacaggaaataaatggctatgttccttcttgcttgcttgcttttgttttggcagaggataaaagagctttccaaaactttaaaaaatctattactgcctaatgagacccatacttaactccaatttactctcagggcagttagcccaccacccccaactctgccagcagaactccactgagtaatgggactgtcacaggacaatcccacagctccccactgctcctttcttgtttttctaaaggaagattatctaagattatagctaatttatgactacttacacctctcttgctacaggtactgacactaatggatcttagctgcacttggctgagaaataaatcggttctatagatcggcaataaacacagctacagcagggaacgcagcttcagcagtccacctatgcctgcgagaagaaagggatgggctagacggggaatgggaatttgactgcagattcatgtgtgtatgatgtgtgatttggatggatggctaaactgagttttttctctttccacacgccaacgccagatacctggttgcaggcctctggctgcaggaaccatatgtgctgctggatggggtagtgcagcacagggacgtgggaagacccactgtccccagaggccttcccgaccagagtgcagagcgcctgtgtctccacatgactcagcaatgactgtggcctgagaatgcctggctgcacagaaacatcaatctgggatttaaaaataaacaggctgggtgcagtggctcatgcctgtaatcccagcactttgggaggccaaggcaggtggatcacctgaggtcgggagttccagaccagcctgaccaacatggagaaactccatctctactaaaaatacaaaaattagccgggcatagtggtgcatgcctgtaatcccagatactcgggaggctgagggcaggagaaacgcttgaacgtgggaggcaaaggttgaggtgagctgagattgcaccattgcattccagcctgggcaacaagaatgaaactccgtctcaaaaataacggtaataataataataataaacaaataaaccattcatactgtagtccagatattctttccaatcagccctgctacaagatcttgtgttggaagcaattttcaagcttttcctcatggaaggaaaaaaggacttacttatatttttagcctctaaacagtcactttgcacttgaaacctgtaaacttatttgctatactttatttttgaatattttgatggctgtctctgccatagccactcaactgtggtcttcacacgtctgtcataaatgaacccatatatacattaggtctgatacaaaaccaaaatatgttattaagggtttgggcagatatataaaaagttgaacacattttagtttactgctgttcttaaagtgattaccaactgcggaccattcttgtacttatgaaataaaatataagcatgcctgctaacaattccaattttagtaccttagctagaaatgggttttgaatcagttctaatgtttatattcatgttacaattatgaccaaattatactattacttttaaagattttggaactgttgtttaaatttctggtttgctatttaggtatgttaaaaatgcaaattgtttacatagttcaaatccctaatctaaggccacaggaaatataatacctcaaaaacaaaaaactaaaccaacaaaacttatgagatccatccattaatccttctgcttgtttaacaaatactaagaatcaggcattgttagacatttaaggagataagccatactcctccagaatgttcacattttaatatggaggttgcacacataaatagttgcaatgtactgtaagtattttaatattaataagtgcaaagtcctgcaatattactaaagaaaaaatagctctgcaggggtaacaatattaggtgccatagaaaagaagaaatgcattgcaggaggacataaagagagctgctgtgaacactcaggtctaagtagggagaggcctttttttttattattatactttaagttctagggtacatgtgcacaacgtgcatgtttgttacatatgtatacatgtgccatgttggtgtgctgcacccattaactcgtcttttagcattacatatatctcctaatgctatccctcccccctccacccaccccacaacaggccccggtgtgaagacacatagttaattatggtaaaaatctttcatttaaacaattgctcaggagctaaaattgtaggggaaaaatataatttagaatgaatgtaagcttctgtttctggctatggtgtgatggaaaggagactagttttcccattataaacaatcacaaaagaggacaacatgtgtgagcccacagcttccaaacactggacaacaagcagcctaagactggggagcctgagaagagggaaactcatgacagtggcctcagtttcccttcgggagaaatctcgcccacactgcacagggcactagaatcccagcacagcaaggtgcagctgcactcgaggctgccatcccagttccggaaagctgaagcagctgggaacaggtggcgggacctgcggtggggagtgggcagacatttaccttggggccccccacagtcctggggatggctggctgacacctgagcaagaggaactgcatgaggtatacacagggcaactgctgcaggaagttgaatcagaacacggtgatggctgtaacacctcagtaatacccagagagcagccagacagcagcttgccaagtcttaacagaataacttctatccttataaggataaactctactcaacagagctgaaaaccaagccctgccaagattagcatggccaacagcatttggaagttcagccaccccacatcagcggagcttaggcaacattcctggggtttctacattcccacccaaatgaagcataaagcaaaacctatgcaaatgcaaggcggaatcacagtaattgatatgcatttagaaattacgagacagagaaggaagcaaaattggaattcacacttaggaaagtaatgaacccctgaatgatggctgtgatgtttaatttatcagaaaaggacattaaagccactattatacatgtatttaacaaattaaagaaggtatgctcttattgaattaacatttaaacaaatgtagaaagaaaattaagaatcataaaaatgtaaattctagaactagtacaataatcaaaatgaaaatttcacttgatatatataagaggagattgaagatgacagtagaaagtctgtgaactagcaagaaaaatcaatagaatatttccaaccagaagaacagacaggagaaaaaaattaagcaaatataaagtcttctacactgccagtgggagtgaataatattacaaccactttgggtaacaatttggcagtttcttataaagttaaatacagagttactaagtgacctagaaattatactgttaggttttttattcaagaaaaatggaatcataggcccacaaaaagacgtgcatgtaagagttcatcgcagttattcagaagagataaatacgggaaacaacccaaatggctgcttcaaatggaagagtaaacaaatatttgtatattcatacaaacaataccactcacaatgaacaaaatatatgatctacaggtgcacttcacaatataggtgaactccaaaaacattccaagcaaaataagcttaaaacaatacatacggtgtgattcaatttatgtgaagttctagaagagacaaaatgaatgtacagtgagaggaatccaatatgtggttgctgggaagggtctggaagagaagacagactgcaaagaccatgagctatgcttctggaatgatgacaatgctctttgtcttcactggggtaatgattacagaggtatgaatattgttcaaaggcatcaaattgtacacttaaaatgtgtgcattgtaccacatgccacttttgatacatgatgttaactgaaaatttagtttagtttagtcagattttggggatttaaagacgaaatgcattaaattgcattcagatgtatactctggtggtaaaatagaatttagaagtgaaataaagcataaagttttctataaaatatttgctatgattttgtatggcatataatgaggaacaactgaatgtctttatttctgtaagtgttagattttgataatataatggtaaagatttcttcagttgaatatttataattgtaaaataatctatcatagtactaaacaattttcaaaggcaggaataaaaagcagattctaaaagtgaagaatttacatacaggttgtgagtatcccttatccagcttgggatcagcaatgtttcagatttagaatcttttcagatttgggaatacatgcacatacataatgagatatcatgggaatggaacccaactctaaacaccaaattcatttatgtttcacacacaccttaaaagatatattgcagctgaagggggctgtggaagtcttttttcccttgaggatgcttttgtgcacctgttttaactgaaactggtcacatgagttcaggatggaattttccacttgtggcatcatgatagtactaaaaaattttggatttttgatttttgagcatttcaggaattttgaatttttggattggtgatgctcaacctgtttataacttctaaaacgcgttactaagactcaccactgtctacacaactgatgttaaattaatgtcatactttaaggcgttaaattattttgcactctgtttttgctagacaaatagagctgcacgccttctaagaaatggaccttggaggataattgactgaccaccttatttttaatatggccttgtcactttttatttgctcaggcatgtgtgtcttctgtgttgcaggtctatagtgttgacagaatgagttttgattggttaagtgtgtgcatttttaactttttgaaattggggttaaggtcatgtaagaatcaaatgtgttgttctctgttgtaacttctcattcctttgtacaaaagattataatacatcatagttcattgatgccactcaatagttgatgaaaaaataaattggtaggaataagtgtaaaaatctagttttcacctaagaaaatttgtcttgtcaaaggtgttcaagcaaagaataattttcaaatcaaagcctcttggaaaattaaaatgagtctcacccaagcatgtcccacttcccctaatgaaatatctagagagcagctgctttgtgctaggccctggactgaactctggggattcaaagataaattagacaatttatttgcaaccaaggagtacatactcttggaacctgtcattcaactaatatgttctctagaaaagcagaaatactgtgcaatgaaaatgaccaggggtagcaaggctctaaaactggcatttagagtcaaacaacaggacttggtctaattgtacaatacccttataaaagtattgtttagaaaaaaaatgtgatactcaaaacccttgtgctagctttaccataaaagactatgtaaacctgggagctaggagagagccttcatcagtgcaccatatgcataagtaaggagataggagatctgagggagaagggaataaaacgctgaacagaaagcagcagagactagagatgaagacaagacgctggtcctccagaggcccagctatgtttgagcagctcagtacccttctgtgacgtaaagaacaaagtcactgcctccaaatgggataggagaaaaggactggtccttgactaagagcgcatggtagtcacaaatctgggggctgctttttggccaagagagcagccatttgaaggcatatgggagagaagcacccttttcctatgtctgagatgccagcgaggaagagacactacatcagtgaaggaatagggggcacccaggaatctgtgagtcttctgaaaatacacacagatttgggtctatttttctctctttgctgtatcttcctgcaaaaggaggttcatagattctactagatttgggaaatggtcttacatgaaatggtcaacaatcactgttttacagcaattaaagttgctcctgggcctactaaacactcaggaaaggtgacggggtggtgtcgatgcaaggtctttaaaggctgacatgaatatgaaagttgataaatatttagcagaggaatgacagctgaacatgcagaagaaggaaaagccaagcccacaggaaaggggcaaccttttcgggcaaaggaagacaaagacagagaatgcaagtttttgggaaggaatcatgcggtttgatctcctgaaacccaagagtagaaagaggaaagaaattaagaattttttgttaatttgtctatttttaatatagagtgaagctatcataaaataggtacatatactgaatacaagttacttaattggtgaaatatgagctattcttttaaggagcggaggcagggctgggcacgatggctcacatctgtaatcccagtactttgggaggctgaagcagatcacatgtggtcaggagtttgagaccggcctggctaacatggtgagacccaatctctaccaaatatacaaccaggcatggtggcatgcacctgtaatcccagctactcgggaggctgaggcaggagaatcacttgaatcttggaggtggacgctgcagcaagccgagatcgcaccactgcactccagcgtgggtgacagagaaagactccgtctcaaaataaataaataaataaagccgaggcagttacacatccctgtgattatgagtgacaaataaacttatacttactcaaaaccaaaagtaaccgtatccacaaaaaattacacacagtattatattttcaaaagaggattcaaaaatagctttcaaaatggcccatggcctctctggaaatttatgttcaccattcagtgaataactgatcttcaccttctgctcattaaatgttttagaaacaataaaaagaaacagagtggccaggcgtggtgtaatcacgcctgtaatcccagcactttgggaggctgaggcgggtggatcacgaggtcaggagatcgagaccatcctggctaacatggtaaaaccccgtctctactaaaaatacacacacacacacacacacacacacacacacaaaattagccgggcgaggtggccggcgcctatagtcccagctactggggaggctgaggcaggagaatggcgtgaacccgggaggtggagcttgcagtaagctgagatcgccactgcacttcagcctaggcgatagagccaaactccctctccaaaaaaaaaaaaaaagaaaaagaaaaagaaaaaaaaagaaacagtgtgattcttgagagcaagaataatcttataaaaagaaaataattcattttcatatgatcctggaataaaataagctctttaaaaaataataaaacacttttgaccaagaaaaaaatgaaaaaaagatttcctgagctcttggtactgaaggaggcaggatatttgtacatgtcacaaatccttctggcaaatgctgtggtctgtggatctgacagcagtgaactctgaggagtagatgccaaggaaccacacccagcccccacccacctctcccggaactcctctgctgtcctcccctctaaggggcagtgttccatgtacaattccacttagaaaaaagtgtcagcttccctggcgcatcttaatgttttgggggtgagatgagtccgatgctaattctaggattggactccttggtgcagcaagacccatggctttacacgtctcacacatatcacacgggccctggtgccagtctttaccctacttctcatgtatctcaaatgtccttcttggcactcacagccaggtctttcacagacagctgccatctgctttaggattgggtttccgcaccgctatgatctaaatgtgtctacccaaaattcaaatgtggaagcttcatctccgatgttatggtattaataagcggggccttaggtggtgattaggtcatgatgtgttcggaattggtgaggtctcggtctcactgacttcaagaatgaacttgcggaccctcacggtgagtgttacaggtcttaaaggtggtgtgtccggagtttgttccttctgatgttcggacgtgttcagagtttcttccttctggtgggttcgtggtctcactggcttcaagagtgaaattgcagaccttcgcagtgagtgttacagctcttaaggccacatgtctggagttactagatcctcctgtctgggcttgttcattcttcctggtgggttcatggtctcgctggcctcaggaatgaagctgcatacccttggggtgagtgtttcagctcataaaggcagtgtgaacccaaagagtaagcagcagcaatatttatcgcaaagagcgaaagaacaaagcttccacactgtcgaaagagaccggagtggattgccactgttggctcaggcagcctgcttttattcccttatctggctccacccacatcctgctgattggtccattttacagagagctgattggtctggtttgacagggtgctgattggtgtgtttacaatccctgagctagacacagagtcctgattggtgcatttataatcccctagctagacataaaagttctccaagtccccaccagattagccacatacagagtgctgattggtgcatttacaaaccttgagctagacacagagtgctgattggtgtgtttacaatcccatagctagacataaaggttctccaagtccccaccagattagccaggtacagagtgctaattggtgcattcacaaaccttgcgctagacacagggtgctgattggtgcatttacaaaccttgagctagacacagagtgctgattggtgtatctacaatcccttagctagacataaaggtcctccaagtccccactagactcaggagcccagctggcttcacccagtggatcctgcaccagggtggcaggcagagctgcccaccagtcccacgcagtgcgccggcactcctcagcccttgggcggtcgatgggactgggtgccccagagcaggggacggtgatcgtcagggaggctcgggctgcacaggagcccacggcaagggttgggggaggctcgggcatggtgggctgcaggtccgagtcctgccccgcagggaggcagctgaggccctgggagaattcgagctcagcaccgggacccagcgcaccctccgcagctgctggcccgggtgctaagcccctcactgcctggggccggcagccccggccagccactgggagtgcggggcccactgagcccacgcccacccagaactggcgctggcccgcccgcgcctctccttccacacctcctggcaagcagagggagccggcttccgcctgggccagcccagaaaggggctcccacagtgcaaccgcggggtgaagggctcctcaacagcggcctgagtgggtaccgaggccgaggaggtgcccagagcgagggattgctgcgagggctgccagcatgccgtcacctctcaatgagggtgaagtcctcattaaagttattaatgaattataaaagaggcttcacacgacatttgctccttttgtcttccctccacttggccatgtgaggatgcggggctcaagatacatcttagaggcagagacaagggcctccacccagtggactgaagtgatttaaaaacaaagtcctaaaaccacacttgtaaattaatacaaaaaggaaaagaagtaataagataaagaaatactttgtaaattaaactacttaaagctatatcatcttcagcagctcctgagaaattgcaatctacatatttgagaactgaccgtaaaaaccattttattttgcactcatagttgaatgagtatatgtttcatattttacaaatttgccgttaatgaaaggggaaagtcaggcatctgtgacagcctaagcaaaaagcatctggcttctactgacttctggcaacccacccatgccagtcagcaatgctctctcctcctctggctgatgccaagcaccaggctgcatagagttccactagttcaaacattctcccaggcaaggataatgactcaatgtttaggctgcacagactcttggggccaatatcccataggcatgaaaggaacaaatagaaaggctactgagtgaatgctcaatgaagtctccccagctgctgtccgtctgaaaggccactcatacttcacatcagccactgtaaggatggacagtggccgacagtggaggctaacacagctaacactagaaccacatgatttaggaggaatttgggacaggaaatttgtaagaagaaacattccgggtactctaatttgtggtgaatttacaagttagctgccaattgagaagtgagactcaaattgcacaagacgtcatacccctaactttttccaatccagataatctacccacaggaaacatttaaaattctgataggattgcatacatggccacaagcctatctgtgccatctttgagcttctcctggatgactctagcagctgttggattcttggctcctatgctagtctctcctccttgcaatacaccttccagatgcctgccagttaccatgtcagggaagagtctctcttcaggtcactctcttgctttagagttaaatacggagtgaagatcagattcccttgcatggcacacagcctctttaaaacccgtcccctattacctctttgttctctcctcctgacactcaaccccatgccttcctgcttccagtccctcaccccagatgccacctggtgttcccccatcatctagcctcttacacttaaacttctaagaccagatcaaatgacatctcttatcagtggcttgctgtgagccttccatttctcagctctgtgtgctcacagcatttaatcgcgacttctaccaagccctttccacactggtcacagcagctccccggctcccccgcacgctgtcaggctttccctggtggatgctgttcagtcatctcggctcccacgcctaccacagggctacatctgagcagatgtgcaatatcgtaatgtccctgacaactgaaatgatcatgttataataaaacatctacggctaacatttattgattgcctgtgatgcaggaggaatggggccaagtatctgatgcattttatgtaatttaatctttaaacaattctgagaagaaggtgctactttctcattttataggtatcctgagattgaaaactgtttacttttcacaggctctcggtactattgggtggtagaacagagatttaaaccaggtcttcgtgaatccaaatcaatgtcctttccaaaagaaatgtgcaaattcaatctgcagggtactctgatttcttttaaatacattacacattttcacagtttgagattccacatatgtgacaaattctattgacacagaagtatttatagccttagttttgcaaagaaaggcctaatcttgacaattggctatagaacttataattttaaacttctttgaaatatttcacagaaatataccttaaaatattaataaatattagtctcctatatttaacctactacagacaaaacttctttgtgaaactgtttttaaaaaaatatttttaaaggaggaatgttggtgaccatgaggaacagttgaatctcattcctggaaatgtatacttgtagttttaatgaaacttcaaatcccgtatgtagaaaaagttaacagtaatactttaccgaaagacattaaggatgcagtgaaaaagccctaacttaaattccgaccatgaatttagaactaccacaaaaaataatttgtttttattatcactacttttctctccctaagaaggcctatgtgatcggccagtttattttatgaatttatatcgaatgtatggcctcatatcaacaaaagggccttgcttggattaccgcagaacacgaatgggctagatatgcttacctcacctctcctaactgaaatgcaagttaataggaggcagcaatatttgcatttccaaggaggtggatagaaaaaggagcagaaagggggatttcggtttctggtgaatccttcctttaatattaaacctctccaacaataacaagtactaaaagctctgcagcacccccagggaaccaaattccagccacacaaaatgacctttaacacttttacctctcctaagaaatgtttaaatccaggcagcatttgcatacttactttctcagtttttgtctaatctctgaatctttaatttcattttgaagatcctcaaagttcttaactgaagtcaaattacagaaaactctgaagtcaacatatggtgggatcccgtggtctctacccctttgaatgatggtggcagccgaatccacggccgcagaataagccgcggagaagagcctctgggtcagctcaggactgagaaggtaggagggtgcccgccatttagcagccacgccaaacagcccccggagaaccgggtctatcccaccttccttgattattctggacggtgaaaagagcgctttatggaacggaaggtggccttcggaaatttcacctaaggtggcattcagtcggtaaagaataggattgattaatgtgtggccaaatctaaaggctgcagtagcaaaagagttaatgatgcctgcattcacgttggggttgtagcctcggtaacccctcagcatcctagtgccagggtcccccaggaccttaggcagccagtggctgtaggtgatgtgctgcagctccgcgcccacgatcttcctggcttcctggtaaaccgtgtttccctcccagtgggggttcagggcggacagctccgtggccatcctgttgtgttcccggaaccacagggtgtgcatggcggccagagccagatgctcgttggcccggtggtccccggccaggaaacaggggctctcctgctcctgtcgcgcgcactcggtgggtgggcctgtagaaaagggcaataagggctttccggagggaggccaaggaaagcctgtcttcaggagaccccgaggcaccgaagggtctctgagagcctgggattcccgctccgagctcccgtaaacgttggagccatcgatgtaggctgtttgctggttgatctgctctcgtgcatagactgaatccaccgtcgcagagggacggccgctggcacacgcggggctggagcgcgcgaagagcatgcagggcgcgtgggtgccccgggggtcggcgtgccgggtgttcatggggaaacaaggagggtcgttggtgcagacggagctgcacggccgcccatccgagaagcgggctgtgctcagcgcaggcactgtgtggtccaagtcgtgctctagaaaccagccccagtgcatgagcatgcgcgtgtagctgtggtcgggggtgacggccgccgcgcgcgcccacactgtggcgaccagccggggcggcgggaggggctggcgggagcccacaggaaggccgagcccgcggggcgcgcggatgccgtcccggtaggctggctgcagcaggcgcgcgaaggcggtcagcgccgcgccccacgtgggctgctgcaggttgttgcacgtgccgtcgtgggcgcggtacttcgcatggaaacaccggttggagcagtttggcagaggcctgcgagctgtgcatccagataaattggcgatgaggctgagggagcgcggggacaccaagtcattgtaccggaattctgaaaggcaagcggcgaaagccgtgaggagggcgggcctgggagggcgcgggcaacttggaactccagatgctgcgggaaccacctcccaccccgcccgccctgagtgaaaagaggcctttcttacttccaaaaacatttcgttagctcacaacaaaaggggggatcattctataacactaaaagatgtttccagaagatcccgggattacttttgagcgttcatcctgtaaacaatggctagctgctagaaggagcaaaatggaaggagagcagatgccagccagacactaaaagatgtttccagaagacccgggattacttttgtgctgttcatcctgtaaacaatggctagctgctagaagaagcaaaatggaaagagaacaggtgccagccagctcctaacttctactctgtgcctttacaagaacgatgttggcaaggatttgttcttccacatcccagaattgttttgttgatttttgtttgtttcatttcagaattttttctctcaagttttgtgcttctagagaacaaggtcaaagaaatatcaatatggatcatgtgaatattaacccacatgatacttgacaaggagggattaagcaacaactttctgaactactataagctgtcattccctggcaaacgggcaaaataataagggacatgcttggagctctaccttttaacagggcttaaacttccagcattctcccagtgctacaaagattgttcactaatcatactaaaagttaccatccttatttaatcttcagaaactggcaagcaataatgggaccatttgcactttatccatgttagccagtccctggctggatcctgagatatcttaatcttgggtatctggatattttgcctcaggaagctttgaaaacccatcatactgggtgaccagggacagtcaaatgccagttagttagagaaattgtacagagctctaagggctgaggcaagctcacagataggccttctgcaccacgtctcggttgatttcctaaaggagaataaagaaagggtaagccaatagaaattgatgctgtactcacagcacaaatagtatatagcaaagaatcacattcacttatttcatttgaaagagaacaacttagaaaatctgaaagctttctatatcatctcatttgacatctactaactagatgtctggttttaaaaagaaatacacaagaacttggatataccaaaaaacaaaacaacaacaacaaaaaaacaaaaatcaaaagaactggggaggtattataaatattataagtggtagaagaaatttcaagtaaattcactgaatgattcaggtgattgaaaggataagtggaagaatatccccctggtaataaagcatttctctataagacacaataatatcttttacatttgaaacacaagttcacttaatgtaggttccctagatttgttctctatacatataacttaaaagttgagacaagtttgaatatatatttatcatccttactttggaattacagttcctatgagaaacatctgcatttatttggtaaaagtagtgagtaaattaatttctaaatcccatgatattctggagattaaaagttcagtgtcctttgctaaggtggtggtcagtttttctgtgggcagtaggctgagaataaaatggctttgtggctgacctttgccttccaagtccacagtgagcccctgcttcacacgttcccgtatcagctgcagcgtgtgctcaaaaatctcccctgctcttgccatttccacaatcagtgggtcacgcgggtaatgaaattgagccagcaggtcactggaggtgtgaggttttctgcaaatgacaaaacacatgattctttacaaggcaaaacagcagagtccatgaagcttgcaaatactgtgcatttaaaaaggcatttcccaaacattcgagaagaatgaaagctccaccactacaatagaggctctacagaggagctgtgggttcttttcctattttgctaacaacttattccaaatgttagtcccagtgctgaactcaaaaatatatatttttaatgaatggatgatttaaacaatagttttaggaaacaacatctatggtggggttctaaactgggggggtcggttgatgaatggattataggaggctcagtaaaccttctgaagtactatgcaatactctcggtctgcaggacttggcattttgtgtcttctctttccctgagtgtaatctcctagaaattcctccttgcctttagaatcctcctcaggcctcactctccctgtagagtttcactgagagctctgacaagctatcactccatcttctctagtactcctgtatccttaaatatgtgtcttatatactcagtaaaatgtacttgaattgctgacatattgtctcctctgctaaagaaagaactaggttgctgatgagatgttgacctattatttatcttgtatcccaaataccaagcccactgaccagcacataatagcagtttatgcacatttgtagaactgaaccaaatatgttaaaaagaaatttaaaagcactgagaatgtgaagcaaactgttttagagactttgatcaactgaggcacatctcatcctctatgtcttgaatcttaactacttgaggtcacagaataataataatgatgctaatagttcactttggttaagcactttctattctccaggcactgttgaagcactttttacatattatcttattttttcttcctagcaagcacatccatgaagtagatcctactgttatcccaactttagagagcaaggagcctgaggtacaaagatgttaagtcacttgctcaaggtcacccagacagaaagtaatgaagtgaggaatcaggaagagaatataaatctaaatcggctgcgtggttctagaacacacatgcatgatcacaaagccattctatttatggatgtgcaggaagccagaagagactcaatttgggattttacgatgtccctttttgaccactaactgcaaatactgaatatatactttatccgattatgatgaaatcaacaatcatttttttgttaatgcatcctgatgttacaaacacagagaagttaatgggattggaaggtttcactagtccatgaacattccaattcaaattaaaataatgtaaaatgccaaatatcctaaacataatgtttgtcgtaggctcccagtttataccaaggtgtgttcaacttgataatcattctcaattcacacattgcaggagcactgcatctgacactgtttggtggatgctgaggtaacccagcccattgcctagtgtctattgtcagcctgtatagcatggacctttggcataaattaatgccatttagattctatggggaagaagtttccccttttttagggtgaactgataatgatggctagcccagatggggatgcatacacaaggactaaagaaagcactctattgcatatgcactataatgtgacttatggagatgataaaaactaagtagaacagaaatgaaaacaaggtttcaatctgtgtaaaataaattcttactgtgaaaacaaatgtcttcgtgtggagttaattgcactgtcaactctctgtacagcatcaagaatggaagattcaacaaagtcatcgccagcttgtctaccctgtatagctttgaaaatcaattccatgattaaaaatatcaaacagaccttgaagttaggcatgatattatatgaatggcattacatttttaaatgtaatgccattacatttaaaacctctaagacaatgaaaatgttatacaatatctacatgataatgcccattgcagagaggtaggtaattatcttgaagcaaggcttcatctaacaataataatgttatttagggaattaaagtattccaaaatctagtaaagctatgtaaaatatttccttttgaacaatgctgattcacacaggatccaagtatgtcagcaatttgtcatcttggagaaggtatgaaatacctatctcttcagccaccttgctttaatgttaaacattaaagcaaagtaaatattctcccatcccatagaggcttcttaaggcaagaattgaactctcaataagatttatgggaaaattaatttatgctttttttatagctctctaacatgtgaaaatactgcaaagttgaatcctgtagacaaaggaagctatttacttacagctgatcatttccaggctattgaatcttcttcaaataatggtttaagaagtttaacagtaaaggaacaaatactaaataaaaataattacgaatgaatatttacagttcatatcagagaaataatcagcacagtatctagttcatttttgagatactaaaagtacagtaacattttatgtgacacaggcaatgaaaacaataactttttggcactgctaaatattgaaagcaaaagtcaatatagctttaaatgttgagtttgaaaataatgtcatttaggggaagtaaaagtgattaaaaacttgaatagtaataggaaggtattgtatgtattatccaaaagaactcccaatgaagtaactaatataagcttaagtcaaggtgttaccacaatatagtatgatagatatatacatattatatgtatatatctatatatgtgtttctatacatatttaagcatatatatttgacaatagatgggcccatatagcattctccatctagatattacaggaaaattcctgtatattatgaccatctatatagcctagattttattgtcttaaaaagaccaccaacataaaataattttaagaaaaaaaataccaatggtatggaaatattgtaaggaaagaataaaattcaggaccatactgaaaattcttcttggcaaactagattatgtgcagcaattctgagtaagtagggtggctccactgtcaagtcattgcagcctttatgatgaccacaagattgaggctctaaatggccaatgttgcctttcctagtccaaaaaatacatgggattgatttagctaaagataattgaaagaaaaaaagacaaaaattgattaattcaattggatgaaattaacaatttcaagaacatgaacaaaataactaataaatgacacaaatagctgacaatatttgcaatctcaaactctgaggcagaaatgatattctgtttcatacaaagaaacgttataatacactaagaaacaaatatataggcaagttataaaagaggaaagctcaaaagttaataaggatataacatgctcaaaatcacttgtaacctcagaaatgaaaaagtgtcaatgaactaccattttatgcttattctagcaaaaaataaaaagctgattaaagccaaattttgacaggagtgagagttcctataaatcctcaggcagactgataggactgtggaattgacacctattttggggattgtatttagagccttctttggcgggggggagatggcagttgttactttgtaatattgcatatgcacacatcctctcatccagtaatttcaatcccatgcatatatgcagaaaaattataattgaaatccacaagggtatgtatgagaatgtttattgcaactttgtgcagtaggaattgtagaaaattggttgtacaacagtggaagtatgggtgtattagtctgttctcgcattgctataaagaactacctgagactgtgtaatttacaaagaaaagaggtttaattggcttacagttcctcgggctgtacaggaaggatcactggggaggccttaggaagcttacagtagtggtagatgaagaggaaggaagcacatgttacatggctggaacaggagagagagcaaagggagagaggctacacaattttaaacaaccagatctcatgagaattcactcattatcacaagaacagcaagagggaaactcaccccaatcacctcccaccaggcccctcctccaacactggggattacaactggacatgagatatggacagggacacaaatctaaaccataccagtgtgcaaggaaaatgtggtggatgttcaacgtggaatgtcatgcaacagttagaattgtctgggcatacatggatggacacttaaaagatgcttaaggtaaaaattcgaaaactagaaagagataaccataaaatgatcgaattaaaatatataatacttagatgtagtatagttgttacatatatagcaatgatgatgaaagcagagtatggacataaaaggtaatgaattaattagttaaccaattgaggaatcaatcaatataattactgtgattataagaaaacaatactataaacatagctacattagtctgcttatgtgttcaaaaaaagtcagtaggaatgagcctacttaatttacttttatcttagaaataaagaaactaaaatcaatcaaatcaatctgcactggcatgtatgacttgattatttaatcaacatattagctttttctttgtcccttttactccttcacttttggacctcaaatatagaaagcagcattaattacatgcttctgtttgtgacaagtattgtcattgggctactgcatctgggacaaaatatgttatcaaaggtctacgtggatttggaagtaagaagattgtgtgctaggactgagttaccgtacaggacatagtgctattgagatgccaaaacttaaaaggctattcacaatggtggacagaagttgatataaagtataaatttcaggaaaccatcatttaatatgtgaatgtgaattggattgatgtttttgcttttattctgtttataaaattgttttgctgttatagttgtataagatttacaagcatagggattttgcagcacttgtcttcatctgttagctcatccattaaatggagagagaaagccttgctcagcacagagctcagggctgatgtgtttatcagatagcaaagatacgcaaaattcttttaaaactgcatgttgcaatgcacatataaggtggctttcacgattaatgtgttttaaaacctataggcaatctgtatcctcacatgattatcaattgatactgtgttatactgtcaatatgatttgctatttatttatatgaatcagaagtcaaccagtgtgtaaaagtgaaaaggagaagaaaattttaaaaatggaattgtatgcaaatattttttgaaatatttaagctctaaactacacaaatagaaaacacataaagttgttcagattcttaaaagcacattaaatacgtgatatagtcaaacaaaaacattcttgataataaagctttctcgtttttatgtcagttatgattttttaagtttatgtggtttaagagtaaactaaaactaactcttttattattcatttgatttcagtgttgttttgtttgatttggtacaaactgcaaaaatatttttataaatttctttagaacagcactgtgttatgtaagcaaatccaatgtgttggggacacattagaattaatcaatactgttgtagttatttgtctcaaaaatcatctcagttaatggcttaaggaatagaacaatcagaaaattctgagcatattctccatctttttatgcaaaattttacaggagtagagggacaactagatcatttttctttgttaagtctcagggtaataaaaatgagaaaaaggcttcagtatatttacaaaataaacatgtttaaagttattgatgcacatctatttgcaatcctatccctgcatctatgaggctatcactactattgatggtaaaatccaatggtaatattgagtcctttcagaaaagggggagcttaggccacgtggccactcactgctctgcatgaaaggcctggctctgggtgacttggggactggacctagagatgggatgcagaaacaaaacagctgtgctcctctgtcacccttgctaaaaaatgcctagacctcaataaaggctgagattttttcacaattaccaattgggttttgagtattttttatcctccccctttttccccctggggaagaaaattagcagataatgtaactatcgtaaccaaataggtcttatcatactcagtctttccctataaagagtgatgctaaaactgacacatgtgagggctgtcccaggacaccagagacaggtccacattaccatacacactgatggtaatgactgcctttatgaaatcattttgtttaaacagcagagaatctgtcttactcatcactttgcatcattaaacatggaaaccaattcattgccctggagagctccactgttttttcagagactggaaaaggaaaggcaccatctactttgtttaaggttatggtgcttagattaagacgttttatttgttttctttataatgtttaaactattcaaacactacaacaccaaaaatctggaaatgctacttacacatattaaaatgtatatgttaaaattttgagagcatttatctcaggatagaagtatgtggtcactgtatattttatgtataaaatggatgagaaatgtgttacctttaacataaagctaatacaaacatacgtgtatgtatactaggtagatgctgttgtttacaaaaatatttccccactcattgtattattaaagtttgacaaaaataaaatagaaaacaaaattaaaagcttggcaagatagcaaagattgtcatgtatctcttaattagtttgtaaactaatttataccctattcagagtaaattttaaaatgtagtaaaatagcaatttaaaactcttcagttaccaatttcacttcattaatgtttgaataaatataactaatgaaaatattttgatactttattgtccacttataactctgcaacaacttcagtggcttagaaattgatgtttgtctaccccatgacaaatattgggattaaaatgtcaaataattcaaatagtgaattgtttatacagagttttggaaaataactagaactcacaagaactgaacaggttaattaatgtatagcatttggaacacatggtaaatgctcaataaatgttaactgtttatttttactactgatattcctatgagtttagtataggttatttcattaacttcaaagaaaaggtcccactaacctaaagtcagctaacgtagccttaaatcttcaatcagtttagtttgataataatttattgggttaaggatacagttgaagtagcaaatattatgggtgggaggataatttggaaagttatttccaaacctacgttcaaaatgatgaaaggctgagccatagaacaggagtcacataaagaagagaagtggaaaagaagcaattttagggaaggaaagacgagggaggctttgagttggagtaagggagctggggaggaagataaatcgtgagggctcagcttcctgcttctgctatgaaggcatgctaggaggagacaaggtcctcggggaaagaccaggggttcagattcgaatatgttcaaaatcagtttttaacatgaggaattgcaaggactgtgggtccaccaaaatgaggtgccacacagacaattagacacttacctaggaatttcagaggagataacattgcctagcattattttcatacaatttgaaccagtatatgcatgttacatggtccaagtttttcatttaataaattctgggtcacctttgcatttttcactttgtccatatattagttcaatgtctcaatggtaagaattttatcacagacatgctataaagtgtttcctcattactgttgtactattttcataactattgtttgaattctatcatgga

SEQ ID NO: 547 - DNA, 818694 bp, Homo sapiens
tttctcagaatcctccctttcaaatgaggctgaattttgtgattttaaaaatttaagaccttatgatttctgcaagcgggcaggaaagtcatgagacttgctggaattttcatctttgtggcaggggaaaaagctaaccccactgagttagttttaagagaatagttatgttttgattatattttacaagtcacactagttcaatgcaataaatatacagattttctgctacacagttggtggaaacctttcagaacctgcgggtacatgtcttaagaggaaaagagcattgcaagctcaaatttttaaaataaaaaattttacaattcctatattagtttcattcaccaatcactacactaagtcccgaagcaaataaaatgtatatattcaaaatttatgaaggaaataaattaaaaatttgaatgacaaaaaattcagtcttttggccaggtgcggtggctcatgcctataatcccagcactttgggaggctgaggcaggcggatcacttgaggtcaggagtttgagaccagcctggccaacattgtgaaaccccatctctactaaaaatacaaaaattcgctgggcatggtgacgcacacctgtaatcccagctactctggaggctgaggctggagactcgcttgaacccggaggcagaggttgcagtgagccgagatcacgccaccgcattccagcctgggtgacagagtgagactccatctcaaaaaaaaaattcagtctttctaagacagggaaatatgcagtgtactttcagtagaatgattatcaaaccacaaaggacttaaaaaacaacaacaaccctttagccatggttattaagatgaaataattactgaaattcttatttaaatttcctatatcagctatccttctagatatgaggcatccaagtgaagaatttcaattttaaaggaattattattattgttattattatttttagagacacggtcttcctttatcacccaggctggactgcagtggtgctatcatagcttactataacctcaaactcctgggctcaagtgatcctcctgctgtagcctccacagtagctgagactacaggcgtgtgccaccatgtctggctatttaaaaacattttttttatagagatggggtcttgctatgttgcccaggctagtctcaaactcctggcctgaagtgatcctcttgctttggcctcccaaagtgctgggattcaaggcatgagtcaccatgcctggctaggaatttttatttgttttttgagatagggtctcactctgttgcctaggctggagtacagtggcgggatctctgctcactgcagcctccacctctctggctcaagcaatccttccacttcagccccccaagcagctgggactactggcaggcaccaccacacccagataatttttgtattttttgtagagatgggatttcgccatgttgcccaggctggtcttgaactcctgagctctagtgatccacccgccttgacctcccagagtgctagaattatatttttctgaaattattttaataatcccataaattataaattataatctcttcagaaatcatgtgaatcaattaagaaggaatatgaccctaagataaggtttaagagtaaaaatagtagttagaattaagttcagttgcaagtgagtaaaactaaaaatagcaaataatggattaaacacacaaggtttcattctctataagtttggaaattggcattttaggtgggatttcaggtgggatggaggttccacaaagtcatcatggacataaactccttctggttggtcactacaccatacctagggtggtcctcatcctccggctgaagatggttgctagattcaaccatcacatctatgttccaggtagtaggagggaagaaagggaaaagaagaggccagtctctctctttgaagaaaatttcacagttacttttctcatttgccagaatattggctgcaaaggaagacaggaattatagtcttttatctgtgtatagtttaatattggataaatttggggttcttttactaagatggaaggagaaaatggatgatgaggcaagcagctaggagtctctggcatacacacttaaatatatttcttttaataagatggttaggtctgacattaattactaataagtttgaattattggtaaagatatttaattgtactgtagattcagtgttctttaaatgcttgctttctctatgtagagaacacttctgtcacttgcaaccaaagaaagactaactcatggtcagtaatcagggatttgttctattatttaagctctctgtttcactaagagaagcatctcagcaaattctaacacaaatttgtaaatatattcattcaatcattcatacaataaacatactgaatgcctaggtactaggaaaaaaaaacccataatttttgaattcaaagtgttcagtctggtagaaaaagatggtgataaaaaattttaaatgtatgaaagtgttataggtgcagtaaaaatatatgtatctggtgttgtggggtacagtagagcaagatatcaattctacaaaaatgagattaaagggtatgcatccaaagtaaggcatacattgatggtggaattcaattaaaaatgattacataatttaaaatacatcaaaaggtacagagaataacacaatggctatcaatttatgcaccatctgcctatgaaacaagatattttgaatataattacaagatacaattctgattttcatatgcagtttgaaattattagcagtttgaaattattagtaatgatgtatgtaggtgtgtcaaaaactaaaaatcttccacgaagaggttgttattgtcaccgtcaccaaatcagagaattaaatagtaagaattttcctgaaattgaaagtgttagacaaagttttaggaatattttaatatattctaaagcaatggcatttgtcattttataattctcatttacttttgtattagagagtctcttagaattagacataatcttttttcaaatttgcagcttattttttatgtggcaaagggaaaaggactaaaaaaatgtcttggagggaggggtagggtgtggtggagagggcgtgaacttcccttgactcagaagaggaaagtggtaattttcctccctttaccatgaaagtatttgtaatttttgaagtagctttttctacaaaacatatgtatttaaggaatatttcttatatattcaaaacctgcaatttagtaggcctatggtaagtacttcaaaggaacttggagtttactgccaaagctctgtttggaaacgcttgtgcagggaaagcatcaggaaggaagataccacatctgtagaaaagcagcctccctctttgtatagtttctttacattattaaaaaattaacataattcagactaatatggctagctgggctgacaaggaaagactccctacctttacaaaaatatacaaatgtgggataataactttaaaaattgaaaaaatgtattttgtcaagcttgaaagcaagaaagggaaatcagctaggtatggtggctgcaatcctagcactttgggaggctgaggcagaaggctcacttgagcccagaagtttaagaccagcctgggcaacatagagatgtcccatttctatcaaaaataaaaaaaaaaaatccaggcatggcagcgttcacctgaggtcccagctactcgggaggctgaggtgaaaggatcacttgagcccaggggattgaagctgcagtgagctgtgatcatgccacttccactgtggcctgggcgacacagtaaaaccctgtctcaaagaaattttttttttagccatcgaaacaacaacaataacaaaaaaaaaaaaaaagaaagaaagaaaaaagaaaaggaaatcactagcttttagaaaaaggaaaacaaaaaaccagagcattacaggaagctgaagtcaagtatatactgaagcccagtggctcacatgagtactggaacttgatacatgttgtgagactcaaagacttagaaggaatagattattgacaagtgcaaaaacatggatgaatcctgaaatgattatactgagtaaaaaaagcaacacaaaaaaagaatacatactatatgattccatttatagaaaattctagaaaatgcaaacaaatctctagcaacatcagtgagtgcctgaggacatggaggggtatgagtcagagtaggagggagagattacaaaggggcatgatggatatgtttactcttgattgtggtgatggtttcacagttgcgtacatatgtcaaaacttgtcaaattgtacactttaaatatgaatagcttattgtatgtctgttatatctcatgaagatgttaaaaaggacaaacaaaatcaacatccaagcaagttcaacagatccttcttctcacttatatgtatgcaatttatttgctgaagaaacttggtggtatgtcctatagagtttcccacattctggattttattgattgcaaaaaggaatccttatcttttttttttttgagacaggtattgctttgtcacccccttatggctcactgcagccttgacctcccaggttcaagcggtcttcctacctcaacctcccaagtagctgggaccacaggtgcgtgccatcacccctggctaatttttaaattttttgtagagatggggtctagctatgtttcccaggctggtctcaaactcctgggctcaagcaatcctcctgcctcggtctcccaaaacgctgggattacaggcctgagccaccatgcctggtcaagaattcttatcttttagagctttatatgatgaagtatttatgggtgatatccatgtgaggggtggggaaggagattggccacatattgataattgttcaagctgaatgactgactcatgaaggctcattatactcttctctctactttttatgtgcttaaacattttttataagaaaaagttgaaacaagtcctggggcctatcttagaggtactgaatttcttgggggttgagcatagagatatgcatttttataaactcccaaggtgattttgttatacactacagaggatcactgccccacataaaagaaaaggactcctatggtgagatgaatttcagacacctaccataatgtatgggaaaaaccatttttggtaggtgtcctttacattaagtatcaaattctaaaagtagtagaggctgggcatggtggctcatgcctgtaatctcagcactttgggaggccacggtgggcagatcacttgaggtcaggagtttgagaccagcctggccaacacggtgaaaccccgtctgtactaaaaatacaaaaattagccaggtgtggtggtgggcacctataatcccagctacttgggaggctgaggcaggagagtcacttgaacccgggaggtggaggttgcagtgagccaagatcgcaccactgcactccagcctgggtgacagagtgagaccctgtctcaaaaaataaaaaatataaaaaataaaagaaataaaagtagtaggctagctattcttcctcaagagacatttagggccaggcgcagtggctcatgcctttaatccctcccagcactttgggaggctgaggcgggtggatcacctgaggtcaggagttcgagaccagactggccaatgtggcgaaacgctgtctctactaaaaaaatacaaaaattagctgggcatggtggtgcgtgcctgtaatcccagctactccggaggctaaggcaggggaattgcttgaacccgggaggcggaggttgcagtcagccgagattgcgccactgcactccagcctgggcagcaagagtgaaactctgtctcaaaaaaataaaataaaacaggcatttagatctctgcctgcctcttctactgctgaggaaattttctgctccctatatacatattttattgtgttcttagtcttaaatgggcgattgcaacacaggtttggtttatcatataagctcattatgacttgtccagattactctgaatttcagccctacataaaaccgtgaaataaaaaaggttttcttctgtatctccagttttacctgttacatctttcgctctctcggtgatttctcccttcctccagtagccagtgcctcttttccaaatcttcctgttagtaaaaaaaaaaaagactaaaaaatcatgtgataaactcatttatataagattagtgattcgagtcatgaagtgctcttcttgggcaaagttgatttaaatagggcacaggatttaagtcaaagtgaaaaaaaaaaaaagtgtaacgatgggctttcaggcatcaggtagcccagtcagggaaggattttttggtgtggtcaaattcctttcaagaccctgtaaaatcttgccagacagcttgttacctttctatcattggaaacgtatccttggaagagtcatataatgcaactaaagttatttgttccatagtatgcatggaaagatttagctttatctgtaagaaatacaaagccaaactcgaaccttcttaaaaagctgtcaaaatcaggccgggcacggtggttcacgcctgtaatcctagcactttgggaggccgaggcgggtggatcacctgaggtcaggagtttgagaccagctcggccaatatggtgaaaccccatctctactaaaaatacaaaaattagctgggcgtggtggtgggcacctgtaatcccagcttctcaggaggctgagacaggacaatcgcttgaacccgggaggcaggggttgtagtgaaccgagattgcgccactgcactccagtctgggcaacagagtgagactgtttaaaaaaaaaaaaaaaagctgtgaaaatttattgtctcagaggaaggggtaggcttcaagctgggtttgagtgcttccatcatgtgtcagcttcatcctcaggctggcttcctcatggtagcaaagtggctgcagtaactattggactcacatctacccatcacactagccagagtaagaaaaagagcacttttcatttcccaacaaacacaagatatggccttccatgtgactggcaccaatttagactcatgtcagtgcctatcagtgaatactgacaggtcaagtgagaatgggattaggctgattatcacaatcactgtccacacctggagcgggagatgggcctaatcagatccttggctgtcttgcaattgcagaggggtggaaatatattctggggaatcaatcaatataatgctcactataaaatcaatatgatattctgtaccattagataccagtttaaactcttacattattgttcaatgtttaacttgtttctaattttttttttcttttttgtggagacagggtattgttatgttgcccaggctaatcttgaacttctgggctcaagcaattctgccttggcctctcaaagtgctgggattacaggcatgaaccactgcacctggtctgtttccaatttttgatattacattttaaactaggagttgcagacataaatgagagaaacaacactgtaagatacaatagagaatgtagagactttggcaaaagagagaatgcatgtcctgcagctgatcgttatcatgtaataatgtaagctcactgttaccaaatcttccactttttaaagagaagcccaaaatgcatgtataatcttctggtttttaactttggatatgtgtttttttaagcaccatgtatgccaaacaaaacatgtttgtgggtttgatttgtacctggggcaccagtttgtcatgttatgaatcatgctggagtattttataacaccatctctcaaagtgagagtttcagtcctttcatggaccagggctgctaggatacgcttaatgcaaatgaagccacagtggaaagagaagtgagcagcacataccacatgaagaatgctttgttattaattttttattccttttagtttctcgactaaaagcctgaagatctgttaataattttttggcatgtgcttagaattgtttttctggtggtaaggatgagtttgcatcagatcaccttaattgtcttttatctaggttctctcatgacttgtctcttatctatgttgtactgtgaggaaaagttcagttttaaagaatgacccctgttgatgagaggtgttacatgtggccatgggacaggatttttcttttccttatagcaagttggcacatgaagatagcatgctccacttaaatagaagaattaactcgcagtggccagtggtgtccactattgctttcaaagacatatggaactgaatttggggaacactaaacttgttttggacttgccattttttttttaaattcttttttagctaagttacctattgaatgcccataattaccacatccattgtccttttttgtcaaaaagcttcactccagttagaagatacctgaaggcagaaactgcggctttgtcaactgttgatttcctcatggcgcgcagtgtaaatttactagtactttatttagtagaggcttagtacttactggttggcagatttattaatagttcctgtacatctcaggaaatcaacagatgatttatgttattctaaccctaactttattaaatataataaaaactttcagcatttattgtcaggcccagggctaggtaggctcctgagatacagaagttaataagggaagcagcccagaaggtaggggaaacaaaaaaatagttacaacactcttgatatgtctcagcatctatagacattaacatcaggaaaagcgggggtgtggggggaaggaatttgtcagggagggccctttggacaaatgtcacgtttctcagagtagcttttaaatatgggtgggaaaatgagggcaggggaattgaagtgggatagaagggagatatttaaactaaagtcattctatggctgcaatcactggacactatattcacttatccatgcaatcacattcattgagtgcttcctatgagttaggcagggtgcacagtgtaagatacaaatgaatgatacaggttcacagcggttgtctagtgggataaaatgctgcacagggcaacctggataagcctgacatgttaggtgccacaaaactacagaacaaagtgctaaggagattcggaaaatttacaggtcatttctggttgcaggatctagaagaaggatgtccacaattcaaggatcagtacaatcttcgtagcgaaaaagcgttggtttattctacctctacctagtttgtacctcaacatcttttaccccaaaggataaaaaggtgcaaatgagggcacattttcttcatataatacgtaatggtgcttacttattgctttcctgttcattccccgcaggtgatttccctcttcagtctcccccgagtctcacagaaggaactaacaagggagcgcttcacaagcacacagacaccttcaaacaggcgcagaagagtacttggtgaaaaagtattctttcaggtgactttccttaagattactgagcattaagaatgaaaatatgtaaaccaggtttacgagcaagaaaataatctctccacattcagagttaatcttccgaactcagcaactgccagtagaacgcaccccggtcagggcgggctcgcgggcgcggtcccacccccaggcccctccgccgcggaggttctccagcgccgcccgtactcccgcctttcgcgcgtccctgctctaacagctctggttctgtcaggacctcactcctccgctcccggcgcaaccgcggccacgcagcgacgtgcacgcgcgtgtgcgccgccgccgcccggcagagtgggcgcctccgacatcaggagcgcgcacgccgcgcagaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtgaggcgaggacggcctcctagggacacgagggcggcccggcggcccggatccgcgggccgaggctgcctgggtgtgttggcgtcgggctgagcctggggagggtcgagatggggccccagccgaggactgggatgcgggaggaccgcggtaaggagggtagggggcgggttcaggactgtcggccgcctcccggacaccgcagttctcccaggtggccgctcctcgcggatagggcgggcggggtcggcgcccttacctgggggtggggtagtggctttggcggccgcctcctccagctgtgccctcctgacattgctgcctcggcggctgccgcccgctgctacgctgtggctgctgctggattcgcagtcccagccgccctgcgtccggtgggcgagtggttagggtattttcttacccacacgcaggcttctgtactcgaccatttctctccctcgcccttcctcttcctccgccgagcactttgctcggctcctgctgttgatgcttgtggttttgcagtttgggatgggatgcgttccgggcagatccctacctgtagggaatgccccgcttcaaagttgacctcctgagccatgacaaacacctccccccaacccccacccaccttgtgagtgctcagtgtcctgataactgagtcaaagtttctgagactgggctagtactttgcactggtcgccaacggtacagggctgggcagtgcgtcagcatgtggaaaggggccaccggctagcgggaggtggccgggtgcatgggagctgaactgacgggtttcagatactaggcagtgtgtccaggtccttggatctctcagatagggttatattagaatatgtaccaaaacttgggtggtcacttgcaaaattggtttcatgcaagtaaactgaaatgccagccttattacactaatggtaaggagaacttttgcttgcctgacagatttcagcgcagtttggaaaatgattttaaggcctttatttttggcactggaggggtttagggatttttaatacatttaaatttcctcgtgcatagtgggaggtaagtagttgcttgttaaaattctgaaaacacagtttcatgaaaaccttctgacttttcttacagtagtgtttatatttggcatcttccgtagaatatccattagttatgatgtcagaagatacggatgtgaagtttgctttttgtgatcacattggaagtggattttgttcatggaaaatactggttcacaagctcctagtactagaaaactggcctgtgattcattttctcagtagagcgtcccttatgaaattgacaatgagatttctaaggagaaagactagttgaactttatgtatacattatcatcaaattgtattaaatgtacacctgcctgaggggttagctctagactttgagttagactggtgtctatactaaatcagttcaataaatgcgctgatattatgtattattcatttggagagaagtagataaagcagggcagagtttatattttaacatattatgtagcctacatttgctctgatgtgtattattattattattattattattattattattatttttgagacgaagtttcgctcttgatgcccaggctggagtgcaacagcgcgatctcggctcaccacaacctccgcctcccgggttcaagcgattctcctgcctcagctttttgtgtagctgggactacaggcatgcgccgccacgcctggctaattttgtatttttagtacagactgggtttctccatgttggtcaggctggtggaactgctgacctcaggtgatctgcccgcctcagcctcccaaagtgctgggattacaggcgttagccacagcgcccggcctctgatgtgtactagtaagtcatatggggagaagtagatgaaatagggtagagcttatatgtgaacatattatataacctacattgtcctctagaaagctggaaacaagttagtaagtctcagtactattggggcatatggtgaatatacaaaccaacctaaaaaagtgtgactgtaaatagatgaagtttgtttgtttcttttaaagagacaaggtctcgctctggcgcccaggctggagtgcagtggctcagtcctagctcactgcagccacgaagttctggtctcaagagatcctcccacctcagcctcctgagtagctgggaccacaggcacatgccaccaaacctggctaattttttgttttatttttgtagagtcaagggtctcaccatgttgctcaggctagtctccaactcctggcctcaggcagtccttgcgcctcagcctctcgaagtgctgggattacaggcctgagccaacggtgcttgtcccattttttttttttttcacctgagttatttgatgggaatttctatatattacagttgcgatgttctgagaatttttgtttctttgataattgtttcatgatttagatgttttctttttacgctggtagttatgatttttttttcctttgaatgaaagaattttattaggcatgtgaaacaggagttttcatgtgatcagctctccagttctaaatttgtgacttttaaaaaacttgaatttttttctttgccttaacccaaacttgaatttgctcagccattgtatatttatttgaactctcagatgatacagcattgaagcagaaagtccttttatccatgcttttggagtaatcaaaagaaggaattctgttgtgccaagtaaaaatatgtgtgggagatagctaggcttcaagagattgactttgaagagagtagtggctaagtagcaaaaatttcctatattgaaggtgtagaagtgggcctgcattccaacctaccattgtcttcaagtggggtatggatcattatgactggttagagggggtttggagaatgaagttgttgctgtaagcctatgggattcccaggcacagagcttgcttatgtcttaattttaatgagttctatatttttataactcttgacttatataaatgggtcagccgttgagtctgaggatgaccagcagcccaaggctattccaggtgctggtatttctttttttttttttttctctttctgttttttttttttttttttttttttttaattatactttaagttttagggtacatgtgcacattgtgcaggttagttacatatgtatacatgtgccatgctgggaattgaacaatgagatcacatggacacaggaaggggaatatcacactctggggactgtggtggggaggggggaggggggagggatagcattgggagatatacctaatgctagatgatgagttagtgggtgcagcgcaccaggtgctggtatttcaaagatggctcaggggtttcttgtggagatgatctgatgagcattttgccattacaaacagtggaggcggagaaagtacggacttgagcctgagttatggtaaaacatactcatttttaaaggagagttttaatgctgatattatagagaaagacattgtttgactcctagactttcagaacgggaaataattttgactttatagtcagtatttgaattgggtataagtatgtgaacatcagtggaccctaataaggaagagttaatgaattaagaagagcttgcatctctgaacatcttctttttatacttcgtttacttcccatattgctcttattcaacagatgggatggcataattgggtatacgaagtttatgcgcatgctaactcttttttgttatcttttggtgttttttggtgtactttttggggattttcctgggaaagttctaggcatatattcagttgatttagagttagatttgggctaagattattagtatacttgaaattctgagccttcttattttctaaatagcttttaaagtagaaaacatttgccagtgctgttgggcttaaaaaaaaaaaaaacccaacaacaacacaattctttataaatactcatgaaaaatctggttacaggctgtgttgtgatagacatagtacagccaaaaatatatttaagaaaattctcacccagtttagtaagcttaaataagaggaaaataagacagtttttttttttaataaaaggctgattttcccagaatatgaagcctaacaactgtttgctgtgttattttccctgttgcctgttctaaattcagcaagaactatgcatccctagtccatggtaaaagcttagttccagtaggtgattcttagtaatggaagtctcattgagggatgcaagggaatttgattgggaaacatcaggcatggaacatttactttttactgctctaattttctgtgtatctgggtattcagtggggtgggaacatgagcacaaatactagaattatctggattttttttttatactatggatttcctcctcttaccccctacctgccccccaacccattgctaagtgagccattgatagtaggagtgtgttatatccttcaggtatgtagggctgaacaaatgctaaaaaccttggcacttggctgatattccataaaccaaattcctgctctgtgtaatttgccttctggtgatatcagtttgttactcccatttttgaagaaaaatatgaattgtggtgaagagacatctgtaaccaagagtaagatttatcaaattatgtagtatacatgaaggacaccaggagattgtttacctgaacatttattaaactcatttgactgtgacccacaataaaaaatacattttactacttgattccgcaagcgcacacacacacaaagttgaaagtttggtgaaataatatttatcttttcagggccctactgagttagctataatggcttgcaagaccagttgtgcatatttcttcctatctagctctttgtccagtgacatcatgttggtagctcaaaattggtcatggtgggaatatttacaccaggaaattcagcaaatggtattcttagggcttccctcctcataggtagttgttaaacatttatagcaccccactgcttataacacacattgatatattctgttatttcatttcattttaaaaatgctgggttttgacttccaaattaattttacacccagctaatggattatagcctacatttaacaacaaatacaactagtttagcctaccctcttaactttgtaagtgaaggaacatactaagagcctcaaggccaaggtcagatagtgagttattagcaaagccagggctctggactcaatctggagttgtttctggtgggcttctttcctaacctcacttagtgtgtataagggattgtgttaatcagtttgaataaagatggaccttgaccctgaggactttatgcttaggtgggggattaaatatggaaacaacagtgataatgaaaggcagaaagtaatgggtggtaaaaagataaagataaggaactataagagtttagagaggagggagagattacttttatttttgtttgtttgtttgtttttcgtttttgacccaggctggagtacagtggtacaatctcggctcactgcaacctctgcctcccaggttcaagtgattctcctgcgtcagcctccctgagtagctgggattacaggcgccaactgccacaccaggctaatttttgtatttttagtacagacggggtttcgccatgttggcccggctggttttgaacttctgacctcaggtgatccatccgcctcagcctcccaaagtgctgggattacaggcgtgagccaccgtgcccggtctacttttagttttaaggataaaagaagaggtgacatttgaactacttttttttttttttttaatttggagacagcatctcactcccgttactcaaactgagtgctgtggtgccatcacagctcactgcatccttgatttcctggcctctaacagttcttctgcctcagcccccaagtggctgggactatataggcacacaccaacatgcttggctaatttttcattacttgtagagacggggtctcattatgttgcccaggctgttcttgaacttctggactgaaactgtcctcctgcctcggcctcccaaagtgctgggattacagttgtgagccaccacgcccggcccctgaactatgctttgaagaatgggtaggatttggacatgtggaaataggacaactagtatgagagaaaggcctttctgggccaggggccagggtgatcaaaggcatacaagcatagacagggaaaaatgagtagtgaaagagctaggcaagaaagagtccgttagcaccagatggttaagagcctagaatgccagttttcctttctgcttttcagtttatctttcatttttgactctggagtaatctagtacttcttaacattgaacaggatttatatgttatgattaaaatatgatccagagagcacataagtatccttagagtagaagctgaagggaaaaattattagtgttagagaagcaaccttgagtttaccaatcctaaaagtgttggaaagtgaaaaatattttatttgtaaggagagacagtgttttttttttgtttgttttttgtttttcttcattagcgtcaaattggctgtagtagaacaggaagcagttttgaaagtctttacaagggccttctaaaatgtgatttctaaatgactggatcttaatttttggaggcaggtttagttcaggcagaagggtagtttatacagatctgcagctaagctgagtagcttttagaatttagggcagcaaagcagggtattttatacaaaatccacttgtaaggaattgatggcttctttattccaagaattttcttagatttcagcatttatgtctttgacagcctgtatgactgaagatgttttgaagtcttggatggaacttgccttgtttcacaggggaattgggtagctagaaatgaaggtataaatgccagtaagttgtgtctgttaatcaagttgaagtactggtggcagttctcaagcttttctgtctgctgatgatttcacacttactgcttctaattaaatagtgtgtagtcgatttgaagaagccttgcttctctttgacccaccagttctgtaaaggtaaaagccttcttagagtgttgcccaggtaacaacacatacagagactgcttaatagctcatcatggaagtgtgtggaaaattttggaaatgttggtaaagaagttgctatagtaaataactacttggttggtaaaaagctgggctacttctggatagttgataaagagtttttgagatgagccgtggttctaaaataaatatgaattgtgtcattgccacacgattttcttcagttatgtaagctcctaatatgtaaatgttgtcctaccattttagaaggtgtcagcagtttcatgtgacctgttccacaatatagcacaccccaaacaccacgataagagttcaaatatggcatggcccagatgcctcacaccagttaaatgataaagctaatcatgtcagcacagtgtttctgttaaagttttttccccctcttttttgaggcatgttagttttcacgaattgaggttattagaatctttccagattttctgccaccattttttttgtgtgtgtggtaaaaagtataatgatggtgcccttaattaaattatgtaaacatttgtaaagatatacacgcatacacatagtgtgcatatatgtatgtgtagacatacatacatatatatttacatatcattagttcttggaatttgtggtgaaaatacacccacctggcaaatggttgaaaacaagtgttctagctctttgaagactaccatgtgagtattcacaaatatgaaagtaatgcaaacccaaagggagtttttgtatgcccaatttcaagaaaggagcacattttaaaaggcaagtatggaattcattcatataccagtgaggaatttctcaacttctcctttaccccacacatacacccgtttaccattctcattattagcagtaagcaaaattagaagactttaagaatcagacttctactacaagtgatgcaaataaatattatttttagaaaaaatacaaacctgtggttttgagttatgaaggtttaagagacacatatcactagttttttttataaactacatggagtgttttctgtgcttcaagatgtcgtaattgtcattgtgaggccttttgctgagagcattgtataaaggaatagttgttagaatggttattaggtgtttctttgaatagtttatttttctgtagtcaatttatcttgcatacattgatggccgggggtggtggcccacacctgtaatcccagcactttaggaggccaaggcaggcagatcacttgaggctaggagtttgagcctagcctggccaagatggtgaaaccccacctctgctaaaaatacaaaaattagccgaatgtggtggtgtgtgcctgtagtcccagctacttgggaggctgaggcacaagaatcccttgaacctgggagatggaggttgcagtgagccaagatcgtgccactgcactccagcctgagctacagagtgagactcggtctcaaaaaaaaaaaaaaaaaaaaaaaaaattgaatagagtatactactttagtgaaaaattgaccattgaaaaatcaaccattgaagggaggttatatatatattggcagacagtagggtttctgaagttgttttagaataattttgttattgagcagctgttttatcaccagacctcattcatttattattgcttttttccatttttttttaaatctcatgaactgtattctttcattttaaatctctcatatttgccctgaagtcagtggtcatatttggactaatgttttgatttgctgttgtctgcgcaaagatctattaccaagttgcatgatcaagttggtattgaatggtaattcagttaatgtcttcttctctccattccttttttccttctgtattctagaagttaccttaacactagtgtgagattcctggcaaagttaatggggaaatgaaattaaatattactgttattcaaatcctagggtgacctttttgccaacactaatgaacatagaaaatttttcagcatgaattatgcagcttaaattttcactgaggctaggcctcttaagtttaaaaaattaaaagttaaaaaaatatttatggggtacaagtgcagatttcttacatgtatagattcttacatgtatagatgtggtgaagtctgggcttttagtatacccatcacctgaatatccaccattctgtatgtccatgtgtacccattgtttagctgtcacatataagtgagaacatgcggcatttgactttctgtttctgagttattttacatatgataatgtaggcctcttaagttaaaaaacattctgacatgcattttatagttcttgtcaacattatcaatagctttgatagatgaaacaggtttctcctgttgcagttggtatcacacacaataaattagccatccctaccatttgaaaatataaaggtgttttttttttttgacacggagtcttgctctgtcgcccaggctggagtgcagtggcatgatcttggctcactgcagcctctgacctctgcctcccaggttcaagcaattctcctgcctcagcctcctgagtagctgggaccacaggcacgtgccatcatgtctggttaattgttgtatttttagtagtattttcactatgttggccaggctggtctcaaactcctgaactcgtgatctgccagccttggcctcccaaagtgctgggattacaggcgtgagtgactgtgcctggcccagataaagtttttttaaaagataatctagtaatagtaggaaagagaaaccagtttatcagttaatctaatacttcctattttgaatataaatttcattgtgttgcatggtaacttcattatgttccactgagtatttacttttctaaagacagacctttaacaatttttcctttttttcatgttttggagacagggtatctctctgttgcccaggctggagtgcagtggcacggtcatagctcattgcagcctcaaacttctggtctcaaagcgattctccaaccttcgtctcaggagtagctggtgggactataggactgtacccaccacactctgctaattttttaaatgggagtctccctatgttgcccaggcaggtctcagactcctgggtttaagcaatcctcctgcctcagcccttccaagcattggaattacagatgtgagccactaaaccctgcacaatttttcaacttttgggaatttcacttagaggaggataatagtagcttttagacatttttatcagttatccaagggtggaaaaaaatacttaaaatgcaagtaactacaaacatttttggttttgtgggagacagtgtagatagaacatagaaccttaattcttgatctagtgctgctgtgaaattcagagagaataagtaatttagacacaacttctttctcctctttgcacattaaccatgagctaatattgagtgtttacatggggtagttattacataagaaaatgtacattatctcgctaatcttcacagtaaccatatgaggtaggaacgattataatatcatctccagtttgcaggtgaggaagcaggattagagaacttcagtaacttacctaagatcacatagccaggcgccgtggctcatgcctgtaatcccagcactttggaagtccgaggcgggcagatcacgaggtcaggagattgagaccatcctggccacatggtgaaaccccatctctactaaaaatacaaaaattaaccaggcgtggtggcatgtgcctgtaatcccagctgctcgggaggctgaggtaggagaatcgcttgaaccagggaggctgaggttgcagtgagccgagattgcgccactgcactccagcctggacagagtgagacgctgtttcaaaaaaaaaaaaaaaaaaaaaaatcacgtagcttgtgagaggcagttatctcttgcttctaaatctgtctcacagtgactctctactactactctgtattgacaatctttaaatgggatggtacttgttttgcacatttcataggatagttatgagaatcaaaaaagataagatgtacaaaagaacacacagatgtctctggtgtattcattttattggataatatttgagacaccaaagaaatctttgaaatcttgtacacatatttgtttgtaatcagtaatgctataaaataagttgaacagatgaatatttgaaaagttatctataaagacatattttgtgtgggttcaagggatctgtgagtgaaaggtagaggaatgcagaaatgtagggatgtattataaaaagtggatcagatgatctctagcagcctgaattctttctgcaatgaggagtatatgtaaataacaggtgacctataagatccttccaacatcaataatctatgagtctttgttatgggttacttattttctgttagaatatcctcaaattagcgagatatgcccaaaagagctttttaattttattttagcttagatcatcaataatcaccattctttctttgtccatttctaaaattgtttatatttaaggtatacagcatgttttgctatacatatacaaaacatatacagatacaaaatcatgaaatgatttttatgttttgatacacagatacaaaatcatgaaatgattactacagttaagcaaattaacctatccatctccttctataatttttaaaattgtggtataagcatctaaaatctgtcttagcaaattttatatatactatacaatatgaataattatagacttcgcgctatacattagctctctagacttattcatcctacataactgcgagtttgtaccctttgacctacttattcccatttcgtccccctcctttcccctggtaactgtggctatactcttgtttctgcgtattcagctttaaaaaaaaaaaaaaaaaaggatttcgctgggtgtggtggctcacgcctgtaatcccagcactttgggaggccgaggcaggcagatcacgaggtcaggagttcgagaccagcctgaccaaaatggtgaaaacccgtctctactaaaaatacaaaaattagccaggcatggtggcatgtgcctgtaatcccagctatttaggaggctgaggcagcagaatcgttttaacccgggaggcggaggttgcagtgagctgagattacaccactgcactccagcctgggcgacagagtgagactccatctaaataaataaataaataaaaagtaaaaaaaaggatttcatatataaatgagatcatgtagtgtctttctttttgtgtctggcttatttcatttaacatagtgtcctccaggttcatctatgttgtttcaaatgacagtatctcctttttttttttttaaggctgaataatattcccttgtgtgtgtgtgtgtgtgtgtgtgtgtgtgtgtgtgtgtgtatatatgccacaaattctttatctgttcatcttaggacagacacttaggttgtttccataatctaggctattgtgaataatgctgcaatgaatatgtgaaagcatatatctctatgaggtgctgatttcagtttctttgggtgtatacccagcagagggattgctggatcataggcagttctatttttaatgttttgaggaacttctataccattttccgtaatgtctgtgtagcaatttacattttcaacaacagtgtacaagggtttccttttctccacactttggccaacacttttgtctttttgataatagccatccaaacaggtgtgaggtgatagctcattgtggtttcgatttgcttttccctgataattagtgatgttttcagtgctttttcatatacctgttggccctttgtatgtcttctttggaaaaatgtctctttaggttctttgcccattttttaattgggttatttcgttttgttttgttttttgctgttgagttgtgagagttccttatgtattttggatattaaccctttaccagatacatagtttgcaaatattttctcccagtccataggctgccttttcattttgttgtttgttttggagaagctttttagtttgatgtagtcctacttatttatttttgcttttgttgtttgagcttttggtgtagtatccaccaatatcattgccaaggccgaacaatatcagggagcttttcccttgtgttttcttctaggggttttaaggttttattatagatattagtgtttacttctttaagctattttagcaaacattctttaaatgtcagttgcacttagattgaatataaatatataattatctgagtaagatgcagctatggtgttttgctttttcccctccaagttaaaaagattttttttttttttttaagatggagtctcactcttgttgcccaggctggagtgcaatggcatggtctcggttcaccgtaacctctgcctcccaggttccagtgattctcctgcctcagcctcccgagtagctgggattacaggcgtgcaccaccatgcccggctagttttgtatttttagtagagatggcgtttctccatgttggtcaggctggtctcaaactcccaacctcaggtaatctgcccacctcagcctcccaaagtgctgggattacaggcgtgagccacagcacccggctgttaaaaagattttttagaggatggggtgggtgaagtggcttactattacattattacatacttggttcttaatgcatttcttatgacttcctctcaaatttggatttcctgagtgtgcattttgagaagaaacttaatatcattatatatatgaaaggtcattttaattttatgtagtaagtttatggctttttatacagttggtttcattctctgtcgtttttttttcaacaagtatttatttataaggtagaatatgggttttgtgctggagaagcagagatgagagattgttgaagagctgacagtcttattggggaaacagatgaatagagagtggcaaggaaggggcaccacaaggtgtgtcttcagaaggatatgtaaactgatctgggtttcaagtaaggctgtctggaatatctgagttgagtttatagaaagcaagagggatattttagatataggtatgaaactttgaaatagtaagtctttacctatctagactcagtggcagtacctcatctctctgaaacattacaaaagcccccaaatagttgtcagtttaataagaaattctttataaataaagctctttaggctgtcgctgagagcttatttttactttatatatgatacttaaggtttctaaggttgtagtagattaaggaggaataatttacaagcagcaagatgctgcaataaacatactgataacaagacagatttctgacaacatgatagcaatgaagaaattggaaaaaaaatacacacacacacacacacacacacacacacacacacacaactgaataagtcatagataatacaaggaaaacatccttggacaactaaattagctttaagggtatcaaatgtatttgtaatactatagaataataatgaaagtttgctgtgctctctgttaccaagaagacatgaaatatatgtcctgtatagtatatatattagttaggattcttcagagaaacagaaccaataggatagctatgtgtagatacagatctgttggaattggcttacacaattatggaggctgagaaatcccgtgataggccgtctgcaaactagggaactagggaaaccagtagctcatttcaagtccaaaggcctgagaaccagcagagccaacattgtattaggttggtgcaaaagtgattgaggtttttgcaaaataactctcaattcgaggctgaaggctgaaaaactagggggctgctgatgcaagtcctggagtccaaaggctggagaacctgaagttctgaggtcagagggcaagaaagacaaatgtctgagctccagaacagagagtgagtgaatttgcccttcctctgcctttttgttttatcttatcccccagcagattggatggtgcctgcccacactgggtaagggtagatcgttcttactcagtctattgattcaaatggcagtctctttgggaaacaccctcataggcaaatgcggaaataatgcttttactagctatctgggtatcccctagtttagtcaagttgacaactaaaactagctatcacagtaaatttatgaaggtgtcaaagtatttatattactaagatttttaaaatatgaaataggatgaaaaccagggggtaaacttagtacagttatcaaattgtttttttcagcatgattgatttctaaaaggctttgaataaccatagatttaattttcttgtatatgacacagaccagtagattatggaatgctagacattgttcagtacaatattatataactgtagttagaaattacttagataccagagttatggttcttaaccacttgggtaccaagaatttttagagagcatgaaccatgtcgtctttttgttctggatggcatgaagttggggtctgagcatagatatcatcttaaaaagcctttcttgagactgtggtctctgttagaaatctctcatttgtgcttttaaagcattcagttttcctctttgttgtcatactaatcacattgtattgcaacttgcctgtttctgcattagactacaggctttcttttttctttttttttttttttgagacagagtcttgctatcttggctcactgtaacctctgcctgctgggctcaagcagttctcctacctcaacctcctgaatagggactacaggcacgtgccaccacgcccggctacttttttttttttttttttttgagacggagtcttgctcagttgcccaggctggagtgcaatggtgcgatctcagcttactgcaacctctgcctcccaggatcaagcgattctcctgcctcagcctcctgagtagctgggattacaggcacccaccatcatgcctggctacattttgtatttttgtagaaatggagtttcaccatgttggccaggctggtcttgaacgcctgacctcaggtgatctgccctccttggcctctcagagtgctgggattagagacatgagccaccgtgcccagccagtattacttaattcttataatagtcctgtattactaacagtttagcgagaagacagcattgttttagattttgcaaacctgtgtaatgtctggctttgtagaagacagacaaattctcatatttgtcactgcattcaccctattgcagtatgctttttgggttgaaatatccaaagaaaagctggcctcatatgtagcttgtaaagggaggagtattttaatagtcttttaaggtaatgttgatatttttctttcatatcacaccagaattctacagttggtagttttatattaatggttagttgccatgtaaaatcttacatcacattaatgaactttttgtaacctgttacatttaaaatccactggtctgtcttgcagtttgaatggatcttttatctatgtgtaattttataactcgtcatttgtaaggcattggttcactgatttatgcagatctttataatattggcacatcttattatacaatataaagaagtcaagctgggcatggtggctcacgcctgtaatcctagcactttgggaggccgaggcgggcggatcgctggagcttaggagttcaagattagcctgggcaacatggtgaaacgctgtctctaccaaaaatacaaaaaacttagccaggcatggtggcacatgcctgtagtcccaactacttgggaggctaagatgggaggatcacttgagcctaggaggcggaggttgcagtgagctgacatggcaccactgtactccagcatggacaacagagggagaccctttttcagaaaaaaaaaaaaaaaaaaaaaaaaaaaaaaaaaggtcaacatttgttaatactgccatcagtgtcatcagaaaagtcttctaagggctgggcatggtggctcacgtgtgtaatcccagcactttgagaggctaagtcaggcagatcatttgagtcagaagtttgggaccagtctgaccaacatggtgaaacctttactgaaaatacaaaaaaattagctgggcatggtggtgggcgcctgtaatcccagctactcgggaggctgaagaaggacaattgcttgaacccaggaggtcaaggttgcagtgaactgagataacaccactggactccagcctgggcgacagagtgagaccctctctcaaaacaaaacaaaacaaaaccaacagtgtaaaacgttcctgtttctccacagccttgccagcatctgttggttcctgactttttaataattaccattctaactggcgtgagatggtatctcattttggttttgatttgcgtttctctaatgaccagtgatgatgagctttttttcttatgtttgttggccgcataaatgtcttcttttgagaagtgtctgttcatatccttcgcctacttttgatgggattgtttgtttttttcttgtaaatttgtttaagtttcttgtagattctggatattagaccatagttagatgggtagattgcaaaaattttctcccgttctgtaggttgcctattcactctgatgatagtttcttttgctgtgcagaagctctttagcttaattagatcccatttgtcaattttgggttttattaaaattgcttttggcgttttagtcatgaagtctttgcccatgcctatgtcctgaatggcattgcctaggttttttcctagggttattatgattttgggttttacatttaagtctttaatccatctttagttaatttttgtataaggtgtaaggaaggggtccagtttcagttttctgcatatggctagccagttttcccaacgccatttattaagtagggaattctttccccattgcttgtttttgtcaggtttgtcaaagatcagctggttgtagatgtgtggtgttatttccgaggtctctattctgttccattggtctgtatatctgttttggtagcagtaccatgctgttttggttactgtagccttgtagtatagtttgaaggcaggtagcatgatgcctccagctttgttctttttgcttaaggttgtcttggctatatggattgttttttggttccatatgaaatttaaagtagttttttctaattctgcaaagaaagtcaatggtagcttgatgggaatagcattgaatctataaattactttgggcatatggccattttcacgacattgattcttcctatccgtgagtatggactgtttttccatttgtttgtgtcctcccttatttccttgagcagtggtttgtagttctccttgaagaggtccttcatgtcccttataagttgtattcctagttattttattctctttgtagcaattgtgaatggcctgatttggctctctgcttgtctgttggtgtataggaatgcttgtgatttttgcacattgattttgtatcctgagactttgccgaagttgcttatcagcttaaggagtttttgggctgagatgggtggtggcagtataaattagttcagccattgtggaagacagtgtgtcaattcctgaaggataaagaaccagcaataccatttgacccagcaatctcattactgggtatatacccaaaggattataaatcattctgccataaagacagatgcacacgtatgtttattgcagcactatttacaatagcaaagacttggaatgaacccaggtgcccatcagtgatagactggataaagaaaatgtggcacatatacaccatggaatactatgcagccataaaaaagaatgagttcatgcccttggcagggacatggatgaagctggaagccatcattctcaacaaactaacaaaggaacagaaaaccaaacaccgaatgttctcactcataagtgggagttgaacagtaagaacacatggacccaggcaggggaacatcacatactggggcctattgggggttgggaggcaagggaagggagagcattaggaaaaacaggtaatgcatgcagggcttaaaacctaggtgacgggttgataggtgcagcaaaccaccatggcacatgtatacctatgtaacaagcctgcacattctgcacatgtatcccaaaactgaaagtaaaacaaacaaaaacaaaacaaaacaaaacaatcccagaaaagtcttttaagtagtgtgaggctgttaagctagtttttttttattttttatttttcaagagacagggtcttgctgtgttgcccaggctgtactcaaactcctgggctcaagcgatcctcttgccttagcctaagctgatttttttttttgcttgaagctaaaattttatcattggcaacaaatactgtcagttgttttcttcgaattgactgtgttagcttgttccattgagagaaaatgtcttccaaatacccaagtccttacaactatagtttgtcagttagttgttctttaaagtaaaaatggtactctgtgaagaaaatggttaatttaacttgccactcaaacaattgcacaagtgcattttcttctgaaaactattatactttggtgtgcagcagaaatactttgtgtatttcctactttgtcacatagaatgttaaaaagatgtgtgctcaaaaggttggagataatttttactgtttcattaaagacagtcttagcacgtgcacacacacacacacacacacacacacacacacacacactttttaactgagcatatatggttgtacagtgactaccagtatactttggtgctgctgtttcatttgtgttaagacaccagcaatcttacccaccattgcttttgcatcatcacattagcacagtgaaaaaagcaaataatgtctcagtattattaggaaaattgctctgaccttatgaactctctgaaagggtcttgggggacttctggggtccatggaccacactttgggaatagctggaatagagcaagccctgtataagcccagcaatttgttgttcaatgttactttttcatcttatgtatgcatttaatgtagaaaataatatgttagtagtattcaagaatttggacatttgttaaagtctcagaatatattccttggagatagcaagagtatgctggagcaaacattttttaaataacttcattgaaacatgttttataatgcatattcttaagactcttcttcctaaaaggaataaagaattagttgagatttccataagggatacctttatatcagttgctaagttcagggtactgatcctgtataagaatagcttccaattcagatctataaacaacaaaatagtttagtgaaaacacacacacaggatttggagtggcagagaactagtagttctagagccagacagacctggtttgaaccctgactccactgttgtaaccttgggcaagttggtgtgaccacactgtcatttcttagcactctttactgccgctttatatgttcttgaggtctttcattagtactagaataatgatacaatgatagtgatgcatgtaatcatgacaattggaaacttgctatttcctccattagctaaaatttgaaagccataattgataaactttgcttaagttgtacatttttttgagataaggtctcactctgtcacctaccttagagtacaatagtgtgatcatagctcactgcagccttgaactcctgggctcaagggatcttcctgccttagcctcccaagtggctgggactgaaggcatatgccaccacgcctggctaattttttatatttttttgtagagacaagatctcgctttgttgcccaagctggtctcgaactcctgggcttcagttatcctcgtgccttggcctcccaaagtgctaggattacaggcatgagccaccgcatctggccaagttttacttttattttgtgaaaatagtacctggtagcctctgaataatatatatttcttgttgtgttttaaaatttgcttatttgtgttcatatattcactcttgataatttaataattattaaaacactctgtgcctggtacttgtttcatgctttacctgcattatttcatttaagatcaatatgtgaagtgggcacttctcttacatttaattcacagacgagaaaacagaggatacagggagattgagtaacttgtcctatatgatatggtttataagtggcagaactgagatgtaaactcttttctattaggttcttttttgctacaactaacaccagaaaagtagcttaaacttaggatgtatataggttatatgccagtactaagccatattattttattttgatttttttaaagagatgaggtcttgctgtattgtccaggttggtcttgaattcctatgcttaagtgatcctctcactttggtctcccaagtagctggaattatgtgcatgtgccactgtgcctagctactaatcattttatacaagggtctttctttttttctttttttttttttttgagacggagtcttgctctgtcacccaggctggagtgcagtggcgtgatctcggcccactgcaagctccgcctcccaggttcacgccattctcctgcctcagcctcccgagtagctgggactacaggtgcctgccaccacgcccagctcattttttgtatttttagtagagatggggtttcaccgtgttagccaggatggtctcgatctcatgacctcgtgatctgcccacctcggcctcccaaagtgttgggattacaggcgtgagccaccatgcccagcctgtacaagggtcttgagcatcatctgtggattttggtatccatgggggatcctggaatcaagcccccacagatactaagggactgtaaccaccattagtagggctgtgaagagagagtatgtgtgtaaggtcactattcctgagcatatgccagtaagggagacagcttaaacaaattaagggctctgccaacagaaagaagggaggtgggtaggaatgattatttacataggtaacaaagagtgtctgcacctttgtgtcttttaactactactatactgtactccctccctaatttaagaagatattttaaaatagcataaatgagggagaaatataaatggtaataaatttcaggatagaagaaatcctatggagatttgacagttacagtggttaggtagtctaagttctgatgcagatggataagtaatacagatcatgttaaaaagcaactttgggttgaattaatataactgtgtcctccgtggactgttgagtaaccacttgctttacttaaccctaattggcttcatattaaataatttggtttagctgtgtagtttcagggctatgggaagaaactgaggagattcggggaaaaaaaaatgaaatatgcattaaggagatgaagcataggctttctaagctaattaccagaattagtggaatttctctgtattttggttgagagaaagttagtaagtgaccttaatagttttcaagcttgtaaaatttctaagtcgaaatggttcttgtctctcccaccccttcaattcctagaagacgaaattgagattatcataaaatactttggttagaggtaaagaacagctttctgactgtagaggttattaaacactggatctcaggggaagagggccagctgtaggttttagtcaaaagatgaagtgaaaaggcaagacccataaatcacaaattatagtttaagcagtgaaattatagtttaagccatttttgaagctgttggagttgggacataattctgagtctgaatatttccacagtcaagctcctgaaggtcctgcctcccatcctatcctctctccccacttgagtgaatctttgttagcatttaagacttttacttccccccgtaaacagctctacaacagtgtagaatgtaaaaaattagaactgcaaatatgtgttgccctgacaaatacatcaactattttgattttctttcatgttgcctttctcagtatggctatttaaagtttcttaagacatttttttcccactaagttatttatatttattatagaaaaccagaaataacttctgtgaacatgttgtaatatttttctaaagctatttctttatatgcatgtgttttagagttgtgtgattctgtagtttcataacagcatgcataataacactgagttataatagttcccttattatctctttcctattagactgtgagcccctttaaggcatatattattgttttcatctttatataccttgaaaagttgatgtacttcacataaagatgaggcgagagttgtagatacaatttgtatattttcttgatctattattagcattttcttccaaattttattaaaatggatgccaataaaaacagatacattattcaactcactcttttgcccaggccctgccgtggtgaagatcacggctcactggggtgttgctttgttgcctaggttggtctcgaacttctgggcttaagtgatactcctgccttggcctcccaaagtcttgggattacaggtgtgagccactgtgcgagccgctgtaaccggcctaaagatatactttattttttaaagcagttttaggcccacagcaaaactgagcagaaagtacagacagttcctgcatacccctgcccttacacaacgtgcacagccttccccactatcgacattcatacatcagggtagtaaatttgttacagctgatgaacctacttgacacatcatttcttcaccttaagtctgtagtttatattagatttcactattgatgttatacattctatgggttttgacaaatgtatagtgacgtgtgtccaccattattagtatcatatggaatggtttcactgctctaaaaatcctgtcttcagcctattcctccctccctggaccctagtttgtcttgcctcaatacttttgccttttccagaatgtgatacagttgagtcacagaatatacagccctttcagattggcttttttttttttttttgagatggagtctcactctgttgcccaggctggagtgcagtggcgcgatctcggctcactgcaagctctgcctcctgggttcacgccattctcctgcctcagcctcccaagtagctgggactacaggcacccaccaccatgcccggctaattttttgtttttttttagtagagacggggtttcaccgtgttagccaggatagtcttgatctcctgacctcgtgatctgcccacctcggcctcccaaagtgctgggattacaggtgtgagccaccgtgcccggcagattggcttctttcacctagtaaaatgcatttactgttcctttgtgttttcgtggctttgtcactcatttcttagcatggaatagtattacattttgtctggatgtaccacagtctgtctgttcatctactgaaggacattttggctgcttgcaaggtttgacagttatgaataaagctgctgtaaatatccatgcgcaggtttttgtatgaatacgttttcaactcatttgggtaaataccagggagtgcaattgtggggtcatatggtaagactgtgtttagttttgtaagaaaccatcagactatcttccaaagtagctgtattattttgcatccccactagcagtgaatgaaatgacatcataaatttaaattcacttaaaatgtccaaaacgaaatctgtcagcatttttaaaaaaataaattaaaacaaaaacgaaacacttttaagctcaggaaagtaacctccagagtactttcagaatatcccagacaaattggggctttgcagattaatatttgcaggttgatctttgcctgggatcttccatataaaactaaaaaatgaagtctgtggtagctgttcttgcctagagtctctgctaacacagaagtttcgtgaaattttatggtgttaatcccttgtaaactatggatttagaaactcatattcccagactaagactagtctctttatttatttcttcaattcctagtagccaaaggtaattagattttacttttggcaggtgtatgctagcgatgtctactttatttaagaagatgctcaacctctaagtggtgtgggaggtgtttctaaaggtcactcaaggttggggtacagttgtggtggcaacccttccctgcctaacttgttgtttgctctatagggcaatgattcttgacctctttgggttatagatttcaatgaagtgtttctagggaaaggaggaacctgggagagatctgtcagtgctctctgctatccttttgtttgtagtgacagtatctgcaaaatatggggacaccttaagatgccttataatcttttagatctattaggttggtgcaaaaatgattgccgttaataacttcaaaatctaccggttagggatcattcagtaagcaagtaaatataccaactgaggtggagaaaagtgtaggcagcttgctttgagaattttagagctaaagtacagtgaagggtaattttaaattttacttcttttagaaggttttatttataattaaattgcttttttggttttatttgaataaatataaaattatacattcaaataattatttcttgaaattttctcctttattttaaaatgctggttagtatgtgatagttgtagcacatttaaagaagaatacaagtaaaaagtgcaattctacttctccctatacattgtttaataagcatatgccttttaaaaaatgaccttataatgggctgagtatattttggatattgttctgtggcagcataataccacataacttaattaactgtctccttattgttaaatgtttagattccctccttcctgcaccccctttgaaagcaatgctgacatgtgtgtccttgtaattgtactttgatatattggcaagtattttcctgggacagaattttgcagatggatcactggattattgtgtacatttactttaaaatttgcttaaagtcggggcgcggtggctcacacctgtaatcccagcactttgggaggccaaggtgggcggatcacctaaggtcgggagttcgcgaccagcctgaccaacatggagaaaccccgtctttactaaaaatacaaaattagccaggagtggtggtgcatgcctgtattcccagctacttgggaagggtgaggcaggagaatcgcttgaacccgggaggcggaggttgcggtgagccgagattgcgccattgcactccagcctgggcaacaagagcgaaattccatctcaaaaaaaaaaaaaaaaaatttcttaaaaattttcttttaattctaagagagttttatgttgacttctagtgctttttgggcgctgatgctcacacttattttgataaagatgaaagatgtttaccaaatagaatattggacatagaaactcccaaggaaattctctacgtagctgaatttcaggcagatggtgaagatgcaaggataatctcacaaagttatagctaacaatcactaattctgggtgatttggcaatgttttggcaagcagttattttaaactgctttctagtaagaaataattaaagtcaatgctttgatttaaaaagaatgcatatggttaaaatttaaagagttcagaatgctatctgtctactatatagatccctgctccccttctacaccaacctgtagaaaaactagtcagctcagttattcagaggctgatttcccagtttgttattatctgtgtacttttattctccacatttgacctgttactactcagttctacatctgctagtatggacatgtaaaggaaagggagagaatgtgatcagatctagtaaatgatgggttaattgaagaagttgtttaaagttaggagtcataaaaacataacatacatacactttaaacattttattttaacttgaaatcgaggtatacatttatttaccaagattttgatgttgggccaaggccttctggcattctatatcttggtctttctttcatccatttcccctataatgcttcattgtagatttttcaatgtacttaaaactttaaatccttaaatgtggtacaagactgtacattatgtggctctttgccagtttcttcgaaatctacttatccttaggttttctgtgataagtttcactgacttttcagtttccgaaacttgcctcagcgcctttccacatattgttcccataacctggaatgataatttctttaaatccttggctggcccagatcttttgaggtctcttctcaaatgttctgtcctcagagaggcttcgtaaatattagataatattccagtataaagtaggataaccccaacctccccacaagcccactaatatcacccttttctcttccttcactctacctgccaaatgtggcaggtagagtgaaggaagtgaacagggtaattttctttttacaagactgaagcctctgtgaaggcaagggccatccatatatattgggtttaccatagtgtaatagcctttggttagagcagtgtctgctatgtaataagaagcttaaatatttgtagacttaatcaaatgtttattatttatatataaagtgtcaggcactgtggggggcattacttagtaaaatgccacttagtcatctcattgatagcctatagtacattttaaaatggaagtgtgtacatccaagtatgcatttaatgaaatatgggacatttaaaaaagttttcagatgctaatactgaagagaataatgcaaatttactaaaataattaggaccctttttaaaacatgggggcaatgttgcttatctttttaaaaatagtcatttatttttcgttcactatcttaagaattctgatcatcttgtaggaaacttagaaacactaggaaggtcataggcactattattaataattatagaattgttttcctctaaattagagttttctttgtgaccctacataacgtaatgatatttgctctctggagagccaaatgggcctgaagtatagaaacagaactgaaatatagataattaaaactaaactaatatactataattctgattgttatgtcttaagatttgttggccttaataaggtgtgctgggataaacaaaaaggaaggcatcatttgtaaaggttttcttctttaatcccacttttgtttttgcatgaccagaaattctctgatatagcagggtatactttatataaagactatgggcagtaagtgtttagtgtttgtctttatattaggtctatagagtgtggtttcttgattatgggtgaggaaattagcctttcaaattccattagctgtaaagtggatttggatttggtatttgtattggttggctaatttaattcaaatcttttaaaattctcgtgctgaaatgatcttaggaagatcaaaatttctctaacagaaattattttggtctttgaagtgtataaatttaacctgttcataaaataagtattatcagctggtatgtttcttatacttttctgggaatacaaaaatgaataaagcatggtggttgtcttagaggaaataattgtaattgatgagatacatataaataatgtgatacgataaatgctagagtaggaatataaattatgtcaagtgttgtataagcactgtagagggagtgattgattctttgggagagttggagaaagttttatggatttgttaatccagacatatctaattattagggtttttaacacttttgtgtcttctctttttcctgtttagcttggtactttgccgttagaactcttgagtgaccaggtgcattgtaaatgagcaataatattttgaaagaaatcttttttcctgagcagtgggtctcaacaatggttttaaaatactcagtaaacagtgctctaagcagatgtgctgtcatttaggctttgttgttccatttatacagcacaggcagagtagattttgcataatttttaagggccgtatgatttttggaatgggatatgaacattggctacaacttaaagtcaccagttgtgttagcctctaacgagagtcagcatgtcctttgaagctttgaagccagtcattgacttctctctagctatgaaagtcttagatagcatttatttatttatttgtttatgatggagtcttgctctgttgcccaggctggagagcagtggtgtgatcttgggtcactgcaagctccgcctcctgggttcacgccattctcctgcctcagcctcccgagtagctgggactacaggcgcctgccaccacacctggctaattttttgtgtttttggtagagacggggtttcactgtgttagccaggatggtctcaacctcctgactttgtgatccacccacctctgcctcccaaagcactaggattacaggcgtgagccacgacgcccggcagatagcatttctttcagtagaagattgtttgtttacattgaaaatctgtggtttaatgaagccacatttatcaattatcttagccagatcttctggataacttactgcagcttctgttactgtattagtacttactgcttcactttatacttacatgtcatggagatggcttttctttaaacctcgcttatcgtttgaatatttctcccctccaaaacttctgttgatacttaatttccattgtggcaatattgagaagtgtggtttttcagaggtgattgggtcatgagggctctgccctcatgaattcattcatggattaatgtgttagtggattatcatgggagtgagactgactcattgctttttaagaagagaaaggggctggatgcagtagctcatgcctgtaatccttgtactttgggaggccaaggcaggaggattgcttgatcccaggagtttgagaccagtctgggcaacatagtgagactctgtctctacaaaaactaaaaaaataactagctggatgtggttgtgtgtgcctgtagtgccacctgtagtcccaggctgggtgacagaatgagactctgtctccaaacaaaaagaaaaaaggaagagagacctgagctagcatattcagcctctttgccatgtgattccctgttctgccgttctgctcagtactctgcagagagtccccacctgaaagaaggcccttggctgggtgcagtggctaacgcctgtaatcccagcactttgggaggccgaggcgggtggatcatgaggtcaggggatgaagaccatcctggccaacatggtgaaaccccgtctctactaaaaatacaaaaattagctgggcatggtggcgtgcacctgtagtcccagctacttgggaggctgagccaggagaatcacttgaacgcgggaggcagaggttgcggtgagccaagatcacaccactgcactccaccctggtgacagagcgagactccgttgcaaaaaaaaaaaaaaaaaagaaagaaagaaagaaagaaggctctcaccagatgctgcccatttaccttgggcttctcagcatccataactgtaagaaatcatttttttttataaattaccaagtttcaggtattttttaataagcaatagaaagcagactaagataaatgacatgaatcagcatctgctagtttcatacttttcttctgcggcttccttaccctttttatccttgcttagaattgaagagttagagcctagctctggattgggatttggcttaagacaatggttggttggtttgatattctatccaaagcactaaaactttctactcagcagcaaaaggctgtttcactttcttaccatttgtgtgttcagtggactggcactttaaattttttaaaagaactttatctttgcattcagacttcactgaccggtacaagaggcccagcttttggcctgtctccgcattcaacatgttgccttcctcagtaagcttaatcatttctagcttttgctttaaaatgagagacttgcaacttttcctttcatttgaacacttagaagccattgtagcattattaattggcctattttcaatattgttgtgtttcaggaatagggaggcccaaggagagggaaagagatggaagaacggctagttggtggagcaggcagaacacacagagactttaaactctgaagttcgctgtcttagataggtgcggtttgtggcacctgtaaactattgcaatagtaataccaaagatcgctgatcacagatcaccagaacagatagaataataatgaaaaagcacaataaagtgaagcacaataaaatgaggtatgcctgtaccttataatagcttgaaaatttcttaaattctgtgttttatctcaggaatgtgtgtgaattttgcatttcattgcatactgttaataaaaatatagaaatatttgaattactgccagaaaaaggaaaaacaaaaatcatttcctgtttgtctgttgatttttgaaaactggggtgaatgaagagagctgacactacatacctggtttagcacttactttctttttcttagtgtatccctggtatgtttcagtttatgcctgaagatgtacgtcaccagtttgagaaaaaaagattggccagtcagatcatgaaacattgcattacttttctccctcttacgtgtagtatagccttggggaaaattacttaatttgagtctgctaccctcataaattgggccaataatgtgtacccatactttttttgggaggggatcatatagtagctgctaattaaacatttattagctgcttcctccttttcctgccacattcctgttgctttcttcttggctttaacccaggtcttataactgcttggtatgctttaatcagcttgcttactgccctgatggtttttattagccagtgcgtagagaataatgctagaagatgcttggggcataagctgagacattcctggaataatagagacacactgactcaggaacagtcagtgcacagggaaatgttcggatttagcttatcagagtaagcaaaggtctagaaatacatctacattaatcagtggaaagatgggccagactaaaaattggaattagaatgtaggactgaatgcatttatactagagtctgctttctgtgcagcagtaaaagcaggtgatattgacttagtttttttcaaagtggttagagtattagactgaatggtctaaaaatttcatagatggaagtaaaggtatgttcaaaaatagactttctctgaaatgttataattgaacttagaacatttatgttagtggttttattctgtaaatgataatactcattcctgtaattctctttatgttgtcagtgtgtttcattaactatatctgcttgatctcaaaccttgattatttctctaactgcgtaacacatggcagttggaggttcaagagagtctaattgagtcacttatccacctgtctgaggtgttttttttttttttttttttggagatggagtctgtcactctgttgcccagcctggagtgcagtggcatgatcttggctcactgcaccttcacctaccaggttcaagtgattcttgtgcctcagcctcccaagtagctgggattataggcacatgccaccatgcccagctaaattttgtatttttattagagacagggttttaccatcttgccagactggtctcgaacttccaacctcaggtgatccacctgtctcggcctcccaaagtgctgggattacacacgtgagccactgcacccagcctctgatttcttaacagagaagagaaacaataagccaaacatggatcaaaataaagtattgagcttcattactggtaaaggtgagttagaaaatgtggtgaatattacagtattgcactcctagcaaaaagtgaaagcccccacatgaaaataggagaacaaaggaataggttttttgccagagtcccttcacataaacactttgggcaggaaactaggcaggcatgtcaccattgggcttcagatgggcacctgacaatgctgtcgttactgtaggagacagaccaccacaaagtgagattgatttggttgcttcagatctggactgaattatgtattttaattagctatattaaataaaacaaattaactcttttgaacgtattccttcatttgtaaggtgggaatacagttgagtgatgactgcgaacataaacatgactaaaatgcccagaactttctggtttatagtagtagtttctggtttagcaaatagtagtaataaaaggataactgttatccttaacagttattcttaacaaatcaaacctcgaatgtttacatctttaaaaattttaactgccacatttgttacattcttaaattgtgctgttaaaagtagacaacttggctgagcgcggtggctcacgcctgtaatcccagcactttggaatgcccaggcgggcagatcatctgaggtcaggagttcaagaccacccttgccaacatgacaaaaccctgtctctactaaaaatacaaaaattagctgggcatggtggtgcatgcctgtaatcccagctactcgggaggctgaggcatgagaatcgcttgaatctgggaggtggaggttgcagtgagtcgagatcttgccactgcactccagcctgggtgacagagcaagactctcagaaaaaatccccaaaatagaaaacctgtctccttaaactaatattgtttctctgacctactcatttcaggaaacaaaagactacaattgcctttatgctgatatgcccttatattgaagacttgaccatatataggaacattaaacagaatgccaggtagaggttttgattttcttgtcaaaataaaatgtcagaaatattcttcatgtgttttggggaagggagtattaataggggtcaactgtacattagtgaatacctgtcatttgaaataggagcttttaaaatagtatatatttaaggtgtaaaacatgatattttgatatacatatacatagttaaatgattactacagtaataggagcaataattttatgtgtgctgttctaagcacttatggtaactcattttatgttaacaacaatcctgtgagatgggaatatttatcctccatctgaaaaaaattaaggcacggagagaccaagttacgtgttcagggtcattaaactgatccatgtagaagccatgattcaaaaccaggcattcttagtgcccagcatggggtcaacactgacctgcttggctttggtacctctttaattgcattcgtactaagcactcagtcagtcataaccattctcttctcccttgtggtaattaatggtggtggtggtggagaatctacgggattaggcttcagttaattcttttttttttttttttggagacggagtcttgccctgtcgcccaggctggagggcaatagcatgatctcaggtcactgaaacctctgcctcctgggttcaagcgattctcctgccccagcctcctaagtagctgggattacaggtgtgcaccaccacgcccagctaattttttgtatctttagtagagatggggtttcaccatgttggccatgctggtctcaaactcctgacctcgtgatctgctcacctcagcctcccaaagtgctgggattataggcatgagccaccgtgcccggccggcttcagttaattctaaagcctgggactgtcagtaggattttaaatcttagagaccagttctgagaaagtgacctgttggctctgcattgcccccaggaaaagtgctaagattgttatcagttacctgacatctggtgggccggcacgccttagccacagtctcttgaatagtcaggaatgtctaaaaagttataagaagaaaaagcaacaggaagagacagacaacagataggtggttgccaggagtgggggaaggagagaatgggtagtgactgctggtgggcacagggtttgctttgaaattagattgacacaaattattattttccagtttataaaatcaggtttttcaggaggtctttacattgaatcacaagtgatttcaccctaatatggtgtgaattgattttattgttcactcttagttctttataaactaatttccccctccttgagtgtttgttttaaaattttggctctttcttgataacctggaatatatatatttggataattattttcaggaagagtatattatatgagtgatctcttttctgagttcttgttcagttgagaaggacttgattatgtacatgtgcagatatgggattctcagattttgatctttatgtttctccctgggaaagtttaagggttgatccattataatctggcttttagttttccagaggaaagggctaagtctgagattaacttgattcctcttggcccttccgaatatccatttctccttttttcctctttgtagataatcttttttgatttcttgtttttctgtaggattgaaaaatgtttttattaggctgtatttagatattggcatgttttaattaatttttccctatatactcaaaatctgtacatgttccgattcagatttttcttcagtttagaaaaatttccttctcgtatttttttgagagtgtaatatgtttaagaccacagactgaggagccagattgtttggtttccaattcctgttatgatactagtaactttgggtagggttcttaatcaattctttctttctttctttctttctttctttctttctttctttcttccttccttccttccttccttccttccttccttcctttcctttcctttcctttccttctttccttctttccttctttccttctttccttctttcttttctttcttttctttcttttctttctttctttctttctctctttctctctttctctctttcctttctttcttttctttctttctttctttctttctatccttctttctttctatccttcttcttcttttttttttttttgagacagagtcttgctctatcgtccaggctggagtgcagtggcgtgatctcagctcactgcaacttccacctcctgggttcaagtgattctcctgcctcagcctcctgagtagctgggattacaggcatgcaccaccatgcctggctaattttttgtatttttagcagagacagggtttcaccgttttagccaggatggtctgggtctcctgacctcgtgatccgcccaccttggcctcccagcatgagccaccacgcctgggctgtagttctttttattttcttcttgtggaattattttatttagattgcctcttttggatatgatctccatatttttctttcctcagcatttgtacttctttctttctttcttttttttttttttgagactgagtcttgctctgtcgcccaggctggagtgcagtggcacgatcttggctcactgcaagctctgcctcctgggttcacgccattctcctgcctcagccttccgagcagctgggactacaggtgcccgccaccacgcctggctaattttttgtattttttggtagagacggggtttcgctgtgttagccaggatagtctcgatctcctgaccttgtgatccacccgcctcggcctcccgaagtgctgggattacaggcgtgagcagcatttatatttcttaatccttttattctttctgggaaaattttttgagtttttaatcttttttcttttttttttttttctctttactgaagttctaatctggccagttctgctgttgttttcatattattttttctctgcaatttctccaaatcttagattgtttcctcatcataacttcctgctctagtttcttgtttgtaatcttctcttggattgtcctgagaacatcaattagaaattttataaacatgttttcctgtatcttatagtaaatctgtttctgaagaaattgtgcattcattgtttaggctagtatccataatttgaattatggtatttttttggacatcaactttgtcttctgctcatttttataagtgggaggtctctgccagcttagtattagtcttagcataaggtggaatttgagatgttttataacaaaggtagatatagatcatattaaatttttgatttaagaaaaatgaaaggtggcaatatttcttgaagccccaggaatgactgatctgggattcatattatcataaaagagaacaataagtgataaacattaatatttatttagctttttaaaatgtgccaggcactgtgcccagtgctttacatatgaattatatccttttctctttctcagcaactttatggtagatactgtttttcctgtaaacttaatgaagttgaagtttagagatttactcacctaaggtcataaggctcataaatagtagagccaggattaaacccaagtgtctgactccagcagttgagtgtcaaatagttaggttttaatggcctcttgtcaatatcccaaagggcttgaactcttataagtaggtttggttccagactgatacactgcccgatcttaatcatgatggtcagtagaagatgtgtttagatccctcttggtgaaaggagcccctgagtttccacgtaatacacttggaaaaccatagaatttgtttccttaattttgctcattcacaacccctctgtcacactgcttgattctctgtttcttaagcgtagcacaatacgtctgatctcttgtttttaaaatatctgttatgcctggacaacatggtgaaaccctgtctgtactaaaaatacaaaaattagccgggcattggttgcgggcgcatgtaatctcagccactcgggtggctgaggcaggagaatcacttgaactcaagaggcggaggttgcagggagctgagattgcaccattgcactccagcctgggtaacgagagcgaaactccgtctaaaaaaaaaaaatctgttatggtgtgtgttatgtagatattcttagagttctgggcatgtagctgacaccttttcatgaagtgcagaaaaacccattttatatgaatgtgttttcagaatcagccatagttcctgttacagaagatggacccaataattattggttgtgtgaatgttgtatgaattaaattagataaggagattacatagcatactcctctaaaatgcgcatatttaaagtagttgggtatatgtatcatgatcaactggaaaccttttttgaaatacagatgcttattatgacttagaaacactgttctaattatagtctaatatatagtgattattatagtctaataatcactgactataaaagtgattgaatagttcttggtaaataattgttacttttcttgatttttaaatattcatgctgtaatgataaaaatgtccaaatccatagtgtatatggtttagatcttgtttataatatacagagaaaggccttcaggagtttcttgaagtaataaatacattattgttgagttcattttggagttatttactgtactaaaccagcctcacaatgactttgcagatttgtgatattactcttggcttttagagagagaaggacacacagtaaataatccctaaattcaaggaattgacttaatgagaatagttgaatttttaagctctttggattctgagttagtatttagatttatttgatttaagatgattgttgaagttacatgaaaataagtctttccaaaatgaaaatctttttagtaatcaaatgaggattttctgatagcaacagggtgcattggaaatgagattttctgatcagcagcagcatgcattgcactgtattggggaattgaggtaaagtaatatttaaaagttcatattattggccgggcaccttggtcatcaagagtgagtgagtccaacaactagcaggtgtcttggcttgtgaggcgccccctccagcattaatgggaaaagagatgagggccagggccgggcatggtggctcacgcctataatcccagtactttaggaggctgaggcgggtggatcacctgaggttgggagttcgagaccagcctcaccaacatggagaaaccccatctgtactaaaaatacaaaattagccgggcgtggtggcgcatgcctgtaatcccagctactcgggaggctgaggcagtagagtcgcttgaacctgggaggcggaggttgcagtgagccaagattgcgccattgcactccagcctgggcaacaagagcaaaactccatctcgacaaaagaaaaagttcttattactgaggaaaattaaaaaattcagtgccttcaatataaacacttaaagttatgggatatgaaaattatggacatatcagacctgaattttatgttattttactcactcgaccagtaagatcttgagtcatatattttagtggaggcaattttattcatgtattgttttttttcttttttaagacagggtctcgctctactgcccaggctgaagtgcagtggtgtggtcttggctcactgcaacctctgcctgccggattcaagcaattctcctgcctgagcctcctgagcagctaggattacaggcgtatactaccacactcagccaatttctgtatttttagtagagatggggtttcactattttgaccaggctggtctcgaactcctgaccgcaagtgatccgcccattttggcttcccaaagtgctgggattacagatgtgagccaccatgcccggcccatacattgtttttcaattctaaaacattctgttttaaaagatcagttgttttgttcattatttccttaatagtggattccttcatgattgtgagagccaattcaatatctctaacggtcttttgaaaatcttaaatagggcaaattttattctgggtttccatgagtcaaaaatcagtgttgatggttcttgtctcccctccctcataatgtggtttggcaaaatgcttcagggaaataacagtgagggtgattgagggaaaactgaaaaatccatgaaggaagtaatagctattcttagaattattggctctaaaaaatactttcttaggttctctctagtcatgattactcataggaaacaaatatgaggtttatagatttaaatccaggtatttctttaaagagaaaataaatgttaaagaagtcatattcattgttttcattaagatttgagattttcgtaacaagttagagtaagagggaagtaaaaatcaaataagctaaaataggtacctgagatgtctttttcttccatgttagacagataatgtaccaatgctgtagcaaggtttgagggaggcacatctcatatgtgtgtgaaaacccagttatcatgcttatgaactacaaaaggatctatatgagttcttgtgtaggtgttagctaacaatctggtgttcctaaaatgtgaaacacatatatcttactctttggcaaattaacaaagtaagctggcataacagcttctattcttgacaggaaaattctatacctttttgtacttgattagtccattaggttattatctacagttacctgaatatgagtaaaaattaaaaagaaatctgtatatgaggtagagggatggctcctagaaaacatgtatatacagatgtttttgccataaacctatagaataatcatattttactagagtagatttaatcagttggggagattgttgaaactgcttccagaggtggcacaagttatattttgaaggttacaaattgtgttatatttagtttatgccactttgatacttctaaggtttaaattttctgtgcttttttgtttacttgacatttctgggattgagatcatgtttgtttcctgctatatttgttttctagtcacgttgaaccttgtttttctaataattatgctgcaatattatttgatacatacaattttagctatgttctcttgtccctgctggtattttgcatttatataaataacctttataggataaagtacagtgtcttttgttttgaaaaaagatgaaaaactttttcaatgtgtccccgtttggtttcagttatccacatctgaagtcactgtggctttgcctgtttaaacaagtttcttttcttgtcccttcagtagcaaccaccagggccgtcgttttacatgtcacttttctttcattcagaaagaggtgctcactttggtcgttaatttttgttttagtctgctcctatcattatggtagtttatagaaactattttttaattttagttttaatttttctttttttgcagagacaagagtctccctctgttgctcaggctggtcttgaactcttggcctcaagcagtaatccgtcgcaggctcccaaagtgttgaaattacaggtgtgagccaccacacccagtgtagaaattttttttttttttttttgagatggagtcttactcaagtgattctcctgcctcagcctcccgagtagctgggattacaggcacccaccaccacacccggctaatttttgtttgttttagtagagatggagtttcaccatgttggttagtctagtctcgaactcctgagctcaggtgatccgcccaccttggcctcccaaggggctgggattacaggtgccaccgcacccggcctagaaactattctttagctgtgatatgtactttattctatcatcatttattttatgtagatgctacacagtgtgctagagtctaaagggaatgtgtgcttgtatttttcttttttttgttaaactacctctcatgctattattgcttggcttttttttttcttttttttaattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtaatgttccccttcctgtgtccatgtgttctcattgttcaattcccacctacgagtgagaacatgcggtgtttgattctttgtccttgcgacagtttgctgagaatgatggtttccagcttcatccatgtccctacaaaggacatgaactcatcattttttatggctgctagtattccatggtgtatatgtgccacattttcttaacccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgctacactgacttccacaatggttgaactagtttacagtcccaccaacagtgtaaaagtgttcctatttctccacatcctctccagcacctgttgtttcctgactttttaatgattcccattctaactggtgtgagatggtatctcattgtggttttgatttgcatttctctgatggccagtgatggtgagcattttttaatgtggtttttggctgcataaatgccttcttttgagaagtgtctgttcatatccttcgcctactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagtagctctttagtttaattagatcccatttgtcaattttggcttttgttgccattgctttctgtgttttagacatgaagtccttgcccatgcctatgtcctgaatggtattgcctaggttttcttctagggtttttatggttttaggtctaacatttaagtctttaatccatgttgaattaatttttgtataaggtgtaaggaagggatccagtttcagctttctacatatggctagccagttttcccagcaccatttattaaatagggaatcctttccccattgcttctttttgtcaggtttgtcaaagatcagatggttgtagatgtgtggtattatttcttttgctgtgcagaagctcatgaatttaattagatcccacttgtcctttttttcctttattgtgattgctttgatgtcttcgtcatgaaatctttgcctgttcctatgtccagggtggtattttttaggttgtcttacaggatttttataattttgggttttacacttaagtctttagtccatcttgagttaatttttgtttatgatgtaaggaaatggtccaccttcagtgttctgtgtgtggctagccagtttatcccatcactatttattgaatagggagtcttttccccattgctcatttgtatatgatgtaaggaaatggtccatcttcagtgttctgcatatggctagccagttatctcatcaccatttattgaacagggagtcttttccccattgtttttgtcagctttgtcaaagatcagatggttgtaggtgtgtggccttatttctgggctctctattttgttccattggtctatgtgcctgtttttgtacccgtaccatgctgttttggttactgtagccctgtagtatagtttgaagttgggtaacatggtgccttcagctttgttatttttgcttaggatttctctggctgttcaggttctttttttggttccatatgaattttaaaatagtttttcctagttctgtgaagaatgttgtttgataggaatagcattgaatctgtaaattgctttaggcagtttggccatttcaatgacattctatccatgagcatgggatgtttttccatttatttgtgttgtttctgatttccttgagcagtgttttataattcttagtgtagagatgttctacctcgtggttggctgtattcccaggtattttgttctttttgtggcaatttggaatgggattgcctttctgatttggctcttggcttagctgttgttggtgtataggaatgctagtgatttttgtacattgatttttttttttttttttttaaagatagtgtatctctctgttgcccagagtgcagtggcactagagtgcagtggcacaatctcggctcactgcaacctccacttcccaggttcaagtgttcttgtgtgtcaacctcctgaatagctgggatttcaggcatgtgccaccatgcccagctaatttttgtatttttagtagagacaggatttcaccatgttggccaggctggtctcaaactcctgacctcaagtgatctgcccacctcagcctcccaaagtgctgggattatacgtgtgagccactgtgcctggcctgtacattgattttgtatcctgaaactttgctgaagttgtttatcagctgaaggagcttttgggctgagactggggctttctagatatagagtcgtgttatctgtaaacagagatagtttgacttctactctttctgtttgaatgctctttcttactcttgcctaattgctctggctaggacttccaatactatttttaataggagtggtgagagagggcatccttgtgttgtgccggtttttacagggaatgcttctagcttttgaccgttgagtataatgttggctgtgggtttgtcatagatggcttattattttattccttcagtacatagtttactgagaatttttaacatgaaggggtgttgaattttaccagaggccttgatatggtttagctctgtgtccccatccacatctcatattgaattgtaatccccagtgttaggggagggacctggtgggaggtgattggatcctgggggcggatgtctcccttgctgttctcatggtagtgagtgagttctcacaagatctggttgttctcacgagatgtggagtgtagtacttcccccttcactctctctctctttcctgctcctccatggtaagatgtgcttctttgcccttcgccttctgctatgattgttaagttttctgaggcctaccagccatgctttctgtacagcctgtggaactgtgagtcagtgaaatctcctttcttcataaattacccagtcatgggtagttctttatagcaatgtgagaatggactaataaaggccttttctgcttctcttgagataatcacgtggtttttgtctttagttctgtttttgtgatgagtcacatttattgatttgtgtatgtttaaccaacttcacatcctggagatgaaggctgcttgattgtggtggattagctttttgatgtgttgccggattcggttttcaagtattttgttgaggatttttgcgttgatgttcatcaaggatattagcctgcagttttcttttattgttgtgtttatcaggatggtgctggcctcatagaatgagttggggaggagtccctcctcctcagttttttggaatagtttctgtaggaatggtaccagctcttctctgtagatctggtagaattcagctgtgaatccatcaggtcctgggatttttttggttggtagacgttttattactgattcaattttggagcttgttattggtctctgtggggaatcagtttcttcctggttcagtcttgggaggacatatgtgtccaggaatttatgtctcttttaggctttctagtttgtatgcatagaggtgtctgtagtagtttctgatggttattttttatttctgtggggtcagtggtaacatttcctttgttatttctaattgtgttctctcttttctttattactctagctagtggcctatgtatcttactaagtttttcaaaaaaccaactcctggattcattcatcttttaattgttttttcttgtctctatttacttcagttcagctctgattttgaatacttcttttcttctggtagctttggtgttgatttcttcttgcttctctaattctagaaacccaatttaaactaatttgtgcaaaaataatttgttgaaaggaatattttagggaaataaaaaatggaagatttattaagactgaggatggggacaattggagctaggcctcaggaatgactcagggatatgacttggttaagaccctttttcttgtctccgtctagggtttacttttctctctcactgcacactgtcattcttcattgaggaaaaacatggctggtcactagtccaaaaatcttagaaattggattaattgatctagcttagattcatctatttggctgtggggttgacatttttataaaagctatgtggtttaagtagagagaaggcttattcgcagaataagatgtttgagaattattgttggacagataaaaataggtatccattaaagtaatgtgaattaataaagttcttttgtccccttttcagagctagagacatacttgtgtacatgcatacatattggtttggttcttgcttgggaactagagtagtggatagactgtttagtaaacaaaagtcatggtaattttttcctggattggctcagtttttcaaagcacagaagaattttggttggcaaatgttgttctataaagtatttgtccattttcttagtgtaagttaagaatagttccctttctacttttgttatggatctcctacagtcattctaattctaatgcctgatagtctttgcagcctatccaatcttgactcacccttatatttttaggtttctattttagctcaggagccacttgaaaatgagtaggcacaaacacgtgatctaaaagcaagaaggaggctaaccacatttggcactgaaggaaattagatcacgtgcactgtgattgcacactttcgaatatgttacgttattttgggaagaaaatagctttcagttagacattgctgaatattgttgtactatttcttgtatatgtgaaaattgtagttttaggcatccaagtgaggtattaatttagatatcattattgctcatttagcaaaaatgatgtggcattaaagtaagaattataagctatttcactggtagaattgctgtaggtatgggggagaagtgtgtctttaagtgatttaatttaatctaaatatttattgagctcctttgagtttagaaggggatggatagaagaaacaaaacactgatacataccagattttctataatgctgataagcttctgttccttatttccgtatatctttaaaatgccctgaaagtgaaaatatttatgcctatatttccattattttttgcacctgaagaaacataaaaatcttttgtcagattttatattctgatttttagattgcaacagagcagtcttaactaaatgcattttaaagcagttttgcatttgtacactgctctgtagtacatgctgcgttgaaatggatgtattagtctgaagttcactagaacagtgagcttcatattatttaaaagacctctgagaatattccagctgttatttcttttgatttgaaataatagcagattgccatacataaagacaaagttaacattttgttatagcacactgctgcataatagtagacttagtaaattatattttgaaaggacgttttggaatgtaggtcaggagctgactggattcttctggaaatcacatagcatgagaatcttgagtcaagtcagtacttgactttagaactcatgcagtccaacttcctacctgatgctggaatccatcttgctatcccaaataattcatttggttattaaagaagtatttattgaggcatagtgtgtgtagatactgtcctggggatgtgttggctaaaataaaaatagacttggtccctgcccatgtgcagataggtcttttttagaaggctattaattattgttgattcagtttcttgaaaaatataggggtattcaagttatctgtgtctcctggtgtgaattttggtactttgtgtcttttaaggaactggtctccttcatctaagtggccgaatttgtggataaagagtctaacttgtagttgggtgttcagtgctcaatcagtctcaacaagttattttttgaatcaagtactcaagttgggaagaattgacaatttaacaactttgaatttcctaatccatgaacattgaatatctctacattaattagatctgatttaatttccttcctcagtgttttttagatttctgcttacagaccctatgcatattttgttagatttatacctaagtatttcaatttttcccttgctattgtaaatgatactgcttttctaactttcaaattcctattgtccattgtatgtagggaggatagtgacttttgtatattgaccttgtatcctccaaccttactgtacttgcttattagttctgagggttttttttttctctttttgaatctttaggttttccacattgacaatcatgtaatctgtaaataaagacagtttgatttcttcctttccaatctgtatacgttttatttcttccaatcttagggggaaagtgtctgcttcgtgattattaagtgtgatgttttgtaaatttatttattggaggaaattcccctcaattgctagtttactgagagtttttgttttgttttgttttatgagtggatgttggattttgtcaaatgcatttcaattgacatgattatgatttttctttagcctattgatatgtagggtgacattgattggtttttgaatgttgagccagtctttcgtacctggtatataattcttttaatacattgttggatatggttttctaatattttgttaagaatttttgtattaatgtcattatagatatggatgtatagtttttcatttttcttgttatctggttttggtattagagcagtgctgatctcacagaatgagttagaaagtattacctctgcttctatattctggaagatattgtggaaaattgatattatttcttctttaaatgtttggtggagtttaccagtgaagtcatctttggtgcttcctttaaaaatatagggctattcagtttatcagcttggccatagtggggtagaacagcagtccccaacctttttggcacaggggaccagtttcatggaagatggttgttgtccacggaatgggggctggatgaaactgttctacctcaaattatcaggcattagttagattcttgtaaggagcactcaacctagatccctcacatgtgcagtacacagtagggttcacactcctatgagaatctaatgccactgctgattggatgtgaggtggagctcaggcaataataatactcgcttatgcattgcgtacctcctgctctgtggccttgttcctaacaggcctgggaccagtatcagtctgtggcctgggggttggggatgaggtagagcacaaagtggagtctttgggtccccttttccaggccttggctcttagatggtatttctggacctgccctggaccagaggggagccctctgccctgaggaatgagtcccaggccagccagcattcaccagaaactgactgaagagcccttgggccttaagggaacatcggcagtagcttggaagtataccaaatgggcctgtgttgtgggtggccacaggataaggctcctctgcctgtggaaacgacagggatgagtggaagaattgtgtcttgtggtttgagtgccagctcatctgtagcatagtagaatattaggtagacttctaggtttttaaactccagtccctggctcccagatgacacttcttgacccacctggggcccaggggaacttgttgccctgaggggaaggacacaaacctggctggctttgctacctgttgattatacagcatcaagaccttgagctgccataggcggtagccaggtagtgcttacagcaggcctttggtgagacacagtgctgtcctgactttaggtttgactcagtgcagtttcagtggtggtgaaacaggagtcttgtgtcactctatcctcagccccaggtggcacagaacagagagggagattccattggtttgagagaaagtaagtaaagagaataaaagtctctgcctggtaatcaagagaattctcccagatctcttacgcaagaccgtcaaggtgatacctttgtgagtctgcaagatccacagtgttactgggtttggatggagtgcccctaatgcagatacagcttagatcacaacacctaagtccttttgaatgctaggaaagccttcccaagaagatgggtacaaacaagcccagactgagaagactacagtagatacctaactcttcaatgcccagacgcagatgaacatcgacaagcatcaagaccattcaggaaaacatgaccttaccaaaggaactaaataaggcaccagggaccaattctggagaaagcgagacagaaaattcaaaatagctgttttgaggcagttcaaagaaattcaagaaaacacagagaaggaattcagaattctatcagatatattgaacacagatttaaataattaaaaagaatcaagcagaaattttggaattgaaaaatgctgttgacacactgaagaatgtattgaagtcttttaatagcagaattgatcaagccgaaggaagaatttgtgaacttgaagataggccatttgaaaatacacagaggagacaaaagaaaaacaaaacagaacaaaaacaatgaagcatgcctacaggatctagaacatagcctcagaagggcaaatctaaaagttattggccttaaagaggagatagagaaagatatgggtagaaagtttattcaaaggggtaataacagagaacttaccaaatctacagaaagatatcaatatccaagtacaagaaggttatagaacaccaagcagatttaaaggaagatgatgtctgcctcaagacatttaataatcagacttccaaaggtcaaggataaaggaaggatcctaaaagaagcaagagagaagaaacaaataacatataatggagctccattgtgtcagacttttcagtggaaaccttatataccagaagagagcagcaggacatgtttaaagtgctgaaggaaaaaacttttactctagaataatatgtttggtgaaaatatcctttaaacatgaaggagaagtaaagactttctcagacaaaagctgagggatttcatgaacaccagacctgtcctataagaaatgctaaagggagtacttcaaccagaaagaaaagaacgttaatgagcattaagaaattatctgaaggtacaaaactcactggtaatagtaaattcacagaaaaagacagagtatggtaacagtaactgtggtgtgtaaactactcttgtcctaagtagaaagactaaatgatgaaccaataaaaaataataactgcaacaacttttcaagacatagataatcaaaaaagatataaatagaaacaagaaaagattaagcaggggataaagttagggtgtagtgtctttatgagttttcttcttgcttgtttgcttgcttatgcaaagtgttgttatcagcttaaaataatgggttacaagatagtatttgcaagactcattgtaaccttaaatctaaaaacatacaataagtacaaaaaaattgagaagcaagaaattaaatcatgccatcatagaaaatcaccttgactaaaaggatgacagaaaggaaagaaggaagcaaataccagaaaacaagtaacagttataggagtaagtccttacttatcagcaataacagtgaatgtaaatggattaaactctccaatgaaaggatacagagtagtggctgaatgtataaaaaaccaagacccactgatctgttgcctacatgaaacatactttacctgtaaagacacacatagactgaaaataaaaggatggaaaaagatattccatgtcaatggaaaccaaaaaggagcaggaatagctatacttctatcagacaaaattgattttaagacaaaaactattagaagagacaaagaagatcactgtataatgactaaaaggtcaattcagcaagaggatataatgattgtacatatatatgcacctaaccctagagcacccagatatataaagcagatattagagctaaagagagggatagacccaaatacgataacagctggaaacttcaacacatcactttcaacattgaacagatcttccagtcaaaaaatcaacaaagagtaatcagacttaatgtgccttatagaccaaatggacctcatagatgtttatagaacatttaatccaatgactgaagaatacatatttttttcctcagtacatggattattcttaaggatagaccgtacttaggtcacaaaacaagttttaaaacatcaaaaaaagaaataatatcaagcattgtctctgacgacaacagaatgaaacttaggttggtgcaaaagtaattgtggtctttgccgttaaaaaggcaattacttttgcaccaacctaatagaaatcagtaacaaaaggaattttagaaactatacaaacacatggaaattaaacaacatgctcctgaatgaccagtgcatcaatgaagaaattaaggaggaaattgaaaaattcattgaaacaaatgataatggaaacagaagataccaaaacatatatgatacagctaaagcagtactaagagggaaatttattactgtaagtgcctacatcaaaaaagaagaaaaacttcaagtaagcgacctaacaatacttaaagaactagaaaaacaagagcaaaccaaacccaaaattagtagaaaaaaagaaataataaagatcagggcagaaataaattaatttgacatgaagaaaataatataatagatcaacaaaaccaaaagctggtggtttgaaaagttaatgaaaattgacaaacccttagccagactaagagaaaaagagagatccaaattaataaaataaaatcagagatgaaaaaggaggcattacagttgatattgcagaaattcaaaggatcattagtggttactatgagcaactatatgccaataaatgggaaaacctagaagaaatggctaaattcctagacacatacaatctatcaagattgaactgtgaagaaatccaaaacctcaacagaccaataacaagtaatgagattgaagctgtaatgaaaagtgtcctagcaaaaaaagcctgggacctgatggcttcactggtgaactttcccaaacatttagagaactaatcaaatatattcaaactattccagctgggcatggtggctcatgcctgtaatcccagcactttgggaggctgaggtgggtggatcacctgaggtcaggaattcaagaccagcctggccaacatggtgaaaccctgtctctactaaaaatacaaaaattaactgggcacggtggtgcatgcctgtagtcctagctactctggaggctgaggcaggataatcacttgaacctgggaggtggaggttgcagtgagccgagattgtgccactgcactccagcctgagcgacagagtgagacttactcaaactattccaaaaaatagaggagaagggaatactttcaaagtcattctaagaggctaatattaccctcatacccaaccaaagacacatcaaaaacaaacaagtaaacaactgtaggctaatatctctgatgaatatcgatgcaaaaatcctcaacaaaatgttaccaaacaaaacacaggaacacattagaaagatcaaattgatcacaatcagtgggatttatcccagggatgcaaatatggttcaacagacacatatcaatcggtgtgatacatcatatcaacagaattaaggatgaaaaccatatgatgatttcagatgatgatttcagttgatgataaaaaagcatttgaaaacattcaacatcgcttcgtgataaaaacccttaaagaactgggtaaggaagaaatatacttcaacataataaaagccatgtatgagagacccattgctaatatcatactgaagaaggaaaagctgaaagccttttctctgagattgataacacaataaggatgcatactttcactgcttttgttttcagcatatactggaagtcctagctagagctatcagacaagagaaagcaataaagggcatacaaattggaatggaaaatgtcagattatccttgtttgcagatgatatggtcttatatttggaaaaacctaaagactccaccaaaaaactgttagaactgataaacagatttattaaagttgcaggataaaaaatcaacatataaaaatcagtagcatttctatatgccaacagtgaaaaatatgaaattgaaaccaagaaagtaatcccatttacaatagctacaaataagataaaatacctaggaataaaccaaagaagtgaaagatctccacaatgaaaaccataaaacattgatgtaagaaatcagagaagacacaacattggaaagatattccatgttcatgggttggaggaaccaatattgttaaaatgtccatacttacccaaagcaatctatagattaaatgtaatccatatcaaaataacaatgacattcttcacagaaatagaaaaaaaagtcctaaaatttatatgaaactacaaaagacccagaatagccaaaactatcctaagcaaaaagaacaaagctgcagcaatcacattatttgcttttaaattatgctccatagctatagtaaccaaaacagcaaaaaccagtactagcaagaaacacatagaccagtggaacataatagggaacccagagataaatctgtacatctatggtgaactcagttttgactaagctgctaagaacataacactggggaaaggacagtctgttcaataaatggtgctgggaagaatggatatccatatacagaaggatgaaactggacccctgtatctcatcatgtacaaaaacaaaattaaaatacattgaagactcaaatataagacctcaaactatgaagctactaagagaaattattgggaaactctccaggacgttggactgggcaaagatttattgagtgataccctaaaagcatgggcaaaaaaagcaaaaatggacaaatggtatcacatcaagttaaaaaggtatctgcacaacaaagaaaacaatcaacaaagtgaagagacaacccacagaatgggagaaaatattttcaaactacctatctgacaagggattaataaccagaatatataaggagcgcaaacaactctataggaaaaagtctaatctaattaaaaatctaatttagattgggtgcagtggctcacgcctgtaatcccagcactttgggaggccagggcgagtagatcacctggggtcaggagttcgagcccagcctggccaacatagtgaaaccctgtctctaccaataatacaaaaattagctgggtgtggtggtgcacacctgtaatcccagctacttgggaggctgaggcaggagaattgcttgaaccagggaggtggaggttgcagtgagccaatgttgcgccattatattccagcctgggcgacaagagcgaaactccatctcaaaaaaaaaaaataataataataaaataaaatctaatttaaaaatggacaatagatttgaatagacatttctcaaaagaagatatacaaatggcaaaaaggcatatgaaaaggtgcttagcaacactgatcatcagagaaatgcaaatcaaaactacaatgagatattatctcaccccaggtaaattggcttttattcaaaagtcaagcattaacaaatgctagtgaggatgtggagaaaaggtaaccctggtacactgttggtgggagtatgcattagtacaagcactatgaagaacagtttatatgttccttagaaatctaaaaattgaggtttcacatgattcaccaatcccactgctaggtatatactccgaagaagagatatctgcactcccttgtttattgcagcactactcacagcagccaagatttggaagcaacgttaagtgtccatcaacagataaagaaaatgtatacatatacagtggagtactattcagccataaagaagaaggagatcctgtcattttgcagcaacatggatgaaagcagatgtcattaggttaagtgaacaggcacagaaagacaaagttcacacattctcacttatttctgattgctaaaaattggaataattgaactcatgtagatagagaattagaacaatgattaccagaagctgaaaagggtagtgggaaggtgggatgggtaagggacatggggatggttaataggtatgaaaaaataattagaaagaatgaataaaacctagtatctgctagcacagcagggtgaatgtagtcaatttaattggacatttaaaaataactaagagaataattgaattgcttctaacacaaaggataaatgcttgaggtgatggatactccatttgccctgatgtgattattatgcatttcatgcctatgtaaaagtatctcacataacacattaatatatacacatgtacccacaaaaattaaaaataaaggagtaaaaaagtaattttttaaataattttatactgcatgtaacccatgtacaagtagtgccattaccttgtaacaggatatttccaattcctccctctctccccctcccctttttttttttgccattgctgtcatgttttttttttttgtccatgtggtataatcatccaatacatttattcttccttttatcacatagatccacatttttgacctatataattttctttctgtctgaagaactacttttaatctttctttcaagccagatatgctggcaatgatttttcttggtttttgcttgttttggaacttgtgtgattaaggaattataatgagaaagtgatgggggcaagggtgtattgggccttgtaagtcttgggaagcagtttgaattttatttaaattttagtgaaaaggttttggtctggagttttcatgtaatctaatttattttccgaaaaaaaattaaataaattggcagctttgtgaacaatgacgtagattgagggaagaagactggaaatagaagatgggttaggaggcttttacagtagataagagcattgtttggactagagtggtagtagtagtagacagaaaaatggatagatgtgagtcttattttggaagtgggtctgacatgacttgctgatgtgaggagtaaagaagtggaggtgaatcaaggatgatatccaggtttcgtgttcaagtaactttgtagaagatagtggtgttatttactgaaatggcaaatcgggactggaaacaagtttggaggagacattaggaattccattttggtcatgtttcatttaagatacgataagacttccacatggaaatatcaagtagagaggtgaatttcagggcaggaatttagagaaggtatttgagttgggatagaaatttggaagactgttagcctgcagatggtattttcgtccatgacaatgacagacattacttagagtgtgtgacaagggaaaaggtcaggatctgaactcagggaatttctaacatttagaaatcaggtagaggagcagcaacctgagaaggacttgaaggattgaccacagaaagacatctggaatatgtggtgtgttggcagttaaggattcatcgtgcagtctggaagagtaaagacctggcttgtaacacattctgcatttttagaaacaaaatatacaaagtgagaaaaaaaccttcagaggacagatgaatgtcgcttgggttttaaaaaggaagggtgttaacatgcataacagaaataaatgatggctagctaattacactggtccaggagtatggttattctttattttgatattcttgaaatttttgattttttataaagttggaaagtaattactttttaaaagatacacatgtaacttgaagctagactcattctttttattgccaagagtaatggtgttagtgtcacctaatggcaaaatggaatattgcagctatacttataggctataatgaaaaggtaacctaattagaaagaaaaataacatttctggggggattttaggcatggatcagtagacttactatggcttacaaggtcccgtgttctttagccctagcctgcttgtcctgcccctctatcacattactcatttggtcactgagcagattgtgtaatagtagggttcttttttgtctttcaggtttaggctcagatattttcctctcagagagctttttcctaccaccttaatttgtccgtatacttcccatagctactgtttgtcacattaacgtgtttattgtttgcatagcctttagagtgacttggaatcaccatttgctccctttttatttgttttcttactagtatgtaagccccagaagtgcaggctacttgttttccttattcacttaggtaacctcagggctgagttgtgtctgttatatagtgtatgtctgcagttaaacttagttgtgtgagtacatgaacttctggatatgatagtgagtgttgtttctatgctgtagagatctatccagaaaacagaattacactgtgtttgattactgaaacattatttgctacgtgaaggcaatatagaagcttttttctttttctttttggtgttaataagtgataatgtgtcaggaaagagaagctatatgtcttaggatgttgaattctgtattagtcaactttagttactcagaaaaaatatttgcaggtacaatattcggtcttgaggagataagtttttttttgaagcatttagatttaattaatatagcagtgtcagtgaatatggttttgtgtctgtgtgtgcatttgtaggtatttctagtatcatttaattatttcctctattaaaaagaaaacagtatttctaagagaaatgagagtgagtgtgtcaggtaaacagtgataaatctggttgagatatggactggtttgtgtaaatttttaggtaacaatatggctctattagtctggaaacttaggatgaagagagagtacatttccattaagtggctcagtccaagaaggtagcctccctaactttgagataattatctagccagcaggattcttcttcacataaaccatttttaaagctttattagttcatgtttttaattagttcatgtttttaatcagtaggtttttttttttaatcccttttgtttttccaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaaggtatttttttcttttctacatatggtataatttttaattaaaaactatttgaaacttaggagatgtgtaaaatgcaaaggtttttctcaagtgctgactttcaaaataaaatcaatgtttgatttatccagaccctaattatttggtttgtgtattttaaaaagttcttgcttttggttgtttaccttttgatttggaattttagggggaagaataaaagaagaaaaagaagagaaaggattttttggtgaattagacataatggttaaattttacattactttatctggatgtttttgtttctcttactgctgggttttagaagttaattaaatgttttgctttcacttgagagacttttttctttatgatttttatgttttaaatcagctggtaacgttccgttgtgtgatttaacagtcgacttgtctaaatgtttttaaagcatatcttatatttttagcatttgagtttttatttagatatggtccctttttcacttctgtgttgcactttctaagtcaaagaaaaggaagcaagtaaactcagttatataggcttgaaaatggtataactgtcttctagaaacaggaataggaaaagtagttaaaagtgctatatattacttatgacttttatttagtattaactatggcatcaaaagtgtattaatatatcagtctaataaaatatattctgaaaatgagattactaaatgtttatgttgagaatatattgttttataattttatttaaataatcagtggctttatttttagatacctgtattttagcattattgtgtttaagacatcacttatttgcttaggctttgtgtttcacctgcctttgagaaaactatgagtcaacttaagtgtaaggaaattagcaatattcatcttgggagctagccaacaatttgtaaagaaatcagaaatatggttatgctgtgctaacaagaaatataaccttttaaatgatattcataatagacccgatttaaatttacctattttttcctttagacatgtaaatttaaggttatctgatttttagggtgtgttcctaaaaaagaaaaagaaaaagaagggccaggcgtggtggctcatagcctgtactcccagcactttgggaggccaaggtgggcagattgcttgaggtaaggagctcaagaccagcctggccaatgtggggaaatcccgtctctacaaaaaatacaaaaattagctgggtgtggtcgtgcacgcctgtagtcccatctacttgagaggctgaggcatgagaatcgcttgaacccaggaggcgaagtttgcaataagctgagattgcaccgctgcattccagcctgggtgacagagtgagactctgtctttaaaaagaaaggggaaaaaaagataaatacatctctgtaaataggatcttatataaaatgtagttggaaactgtcttaagtgttttataaagaatccttttgtgaaactaataatcttcctctaatttagttttataaccaggattttaatgtattatatatgtgaaacaacttcttagtattttagtaactatatttaaatatttagattgttttaatttcttctagaaatgaaatactttcataaaatttagcttcagaactatggtagaattgaaacagaattgtcttgctgtgtctgtagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacaggtactgtattgaattcttagaaactattaaagaaatgggataaagtaatagtgaaaattttaagatgaaaatcagaaaaaattgttagctcttctcaagctttcagttcttgttgagagtttccacttcggtgttatgtttctgcctatatctctgcctataaaaatcaggtcttaatgttctttgggaacaaagactatgtctgggtcctcattttacccctagtacttcatgcatggtaggtcctcaacagatacttactgaacaaatgagtaaatacttgggtgtcacagaatagtgtaatggagatagtctttcatgtgatgtgcctttttgctcagtttcactacacttatttaaagttatatttagtaaaaactctaagtaaaacatatcaattccaacagtgtattaaataataaatacatctatgaataattaggatttgtactttgaatactagcttataagtcaagatgcttttgggtgcaaaaataaataaaaccaaaaccagctccaacttcagctggcttaaacaccacaggtataatttgatctaggctctgatggtgtttttttggtaactactcagctctgatcttgtctatgttacctttctccttagctggttacaaagtagctaccagcagaaactggtaggtaagggaaggtgacctgtttgtgcctggtggcaaagagaaagtcttcattcttttactgatttttaaaatttctttggtgacacgatctcattctgtcatccaggctgaagtgcagtgatgctgttcagccttctgagtagctgggtgtgtaccaccatgcctagctaattttttttttttttttgtagtgatggggttttgccatgttgaccaggccggtcttgaattcctggcttcaggtgatctgcccacctcagcctcccaaagtgtcgggtttaccagtgcaagccattgcacccatccctggcctgttttacggattaaataaaagttctgagttttactctgattggaccagtgaaaccattttctagtagtgagggaaatgacatgaactgatagctgtaggcctgggttacattcaaacctgtaaataagtcactctgacagaggggatgggattatcctaattggcttaggaaactcgtgattcatttctgaaccaaatgaaccttggtacagggtaagtataggtatagccaaactgttacacaatagggctgtgatgcatttatgtagggaatgtaatcacagtgccttccatggcaaggatgattaagcattagaaaaatctttcagtgtggtttaccacataaagtggtgaagagtgaaaaagtatcagtagataaagaacaagcactggataaaatttaaaattttacatgtatatgcacatgtaaagttcttggaaaacttagaaggaaacttgcttaatcaaatatctatcaaagtcttatgttttatgctgaaatttaaaatgcgttaccatcaagatatattgaaacaggagcagttagggcatgatagctatcaccatagctctttgacgttgtactaaagaatccagccaatgcaagatgacaggaaaaagaaatgaagtgtgattagaaaaaaagtgaaaaaattctcatgattggtaaagtatttaagaaagtgaatggataagctattagatttaaagactttttgccaggcatggtggctcatgcctgtaatcccagcaatttgggagggtgaggcgggcagatcacttgaagtcaggagtttgagaccagcctggccaacatggcaaaaccccgtctctattaaaaatacaaaaatggctgggcggggtggctcaagcctgtaatcccaccactttgggaggccaagatgggcaggtcacgagatcaggagttccagaccagcctggctaatatagtgaaaccccgtctctactaaaaatacaaaaattaactgggtgtggcagcacatgcctgtagtcccagctactcaggaggctgaggcgagagaatcgcttgaacctgggaggcagaggttgcagtgagccaagactgcaccattgcactccagcctgcgtgacagtgagactctgtctaaaaaaaaaaaaaaaaaaaaaaaaaaaaattagctgggcagggtggtgaacacttgaaattccagctgctcaggaggctgagacagaaaagtcacttgaacccaggaggtggaggttgcaatgaactgagatcatgccactgcactccaacctgggcaacagagtgagactccatctcaaaaaaaaaaaaaaaaaaaagatttaacgacttttaggaaggttagcaccaacagtagaaaataaaattgccattcataataccaacaaaaataataggtaacaaggaagaaacaaaaatttatgtaaaattttaataaaattataaaatgttattgaaggaaatgaacacctgaatgaatggggagagatgccatgttgattgataggagtcaaccttgaaaagatgtaacttatctccaaattagtctgtaacttgggtgggaatttcaaattttcagttatttttataaacattctgaaatgtatctggacaagtagaggtacacaggtagctaagaaaatttttaaaaagaatattatgtattaagatagactacagagttacagtgattaaaccaatgtgatattggcttgttatagaagtgaatcactagaacagggtaccagaaacaaacctatgtatataaaggatttcagtatatgacagaattcgcttcacataccactgggggaaatggtaactatgcagtaaatagtgttgggacagttgcatctttgagtgcaataaaataaaattaggttccttagttgtacataaaaattatttttagtgaatcagatatttaaagtgagaaataagcctgtaagaagaaaacaatggagcatatttttgtgattgtcaaggtaggaaaagccaaatcacaaaaggaaaagatagttgcatatcattatagaaaaatttaagtctggcctgggcatggtggctcacacctgtaatcccagcactttgggaggccaaggtgggtggattacttgaggtcaggagttcaagaccagcctggccaacatggtgacacccggtgtctactaaaatacaaaaattagccgggcatggtggttcatgcctgtaatcccagctgagaatctgggcaggagaatggcttgaacccaggaggcggaggttgcagtgagccaagattacaccactgcactccagcctaggcagcagagtgagactccatctcaaaaaaaaattttaaatctgagtgcaaaagaccatttaggttatctatttcttcttgagtgtactttggtgttttcatctttcaagtaattggttaatttcacctaagtatggggatagagttgtttctctgttatagagtaatattctcttattatccttttaatgtctgcaggatgtgtattaatatcctctcattcctgatattgacatgtattacatatacatacattgaaaaacctaccagtctaataattttgctttcaacagccatacgtatatttccttgagcactttaaaaatgcttttccagtgtcttcttgtctccattgtttctgataacaaatctgaagggatttgaatcattgttctcctatttgtaatatgttatttttctttgctttcagtacttttatttcattgttttcagcagtttgattatctgtgtgtggttttctttgagtttatcttttttttttggatcactgagattcttgaatctgtaaatttatatctttaaccaaatttgggagttttcacccattatttcttggtaattgttttgtttctacactaatctctttcttttctgggactcagtagacaaaaatggtagacatttccataccgttctcacaattccttaggctcttttcattgttttccctgtgttcaagctcactgactttttactttgttaatctccattctgctattgagatcgtctgatgaatttttaattttagatattgtatttttctgtttttaaatttacattgttttttaaagtttttttgtttctctgtggatagttttgatatttttattcattacaggtgttttcacgtttattttatggattatttatggagcaactgggacatcttgggattggtctgtggattattttttcacttgagaatagatcacccttttatgtttgttgagtaattggcttgttcccagagttttcgaatcttatgttttgagactatttcttgttaaaatcctctgaagaatgttgactttttttttttttttttttttaaagcagacattccacctggttgtgtccaaactgcaagatctgtcttgctttctggttccaaagtattttcaattctcaaaacctttgctgtgcttcttcagtctgttccacatgcatacacagtttgctagtttacacgcagagttaggggattatcttcttcagctctctcctctctgagatttccccacactctctggcttccttgggccattttccttctacccctgtgttagaaagacaggtttctttcttagagtttttgctgctttgtgctgttttgcagaatcatatgtctggagcactttatgacaaagtggtgagagaaaagagagggaaaaataatagagtttttcttttccatttttgggttataggggcctctttgctttggtattttagcctttgagacacatttcttttcctccagattgtagatgcttacagtaccaccgcgactaccagcatttcaggtagttctgtggtcggggctagtggtagaactgggagagaaaacaaaacagaaacaagtcatgatttctcagatactctctagtttgcagggacttctttttctgttatttggctggaaagattggatttctttgttttgttgctcactgctattctgcaactcggaccacccttaggtcaaaactgggaggtgatgatgagaaaaatggaaaactcaccactgtaatagaggttcagattttcactttcctctccactctggctgttcctatttactttttaaaaggaggctggatgtggtggctcacgcctgtaatcccagcgctttgggaagccaaagtgggcggatcacttgagctcaggagttcaagaccagcctgcgcaacatagcgaaacccaatctcaataaaaaaagaaagaaagagtcctccggtcgttgctttttatattctgtcgaaagttttcaggtataatctgtgggagagataacttataacagtaggagagataaattgtaacaggcttatcacttcaatttcactggtccagttcaataatcttgagtctgtttttgcttcagctgttttgaagttctgctattaagggcatagtcacttagaatttttgtgttttcttaatgaattgaccattttagccttgtgaaatatccgttttctttttgttaaaattccttgtcctgaagtctagtttttcttatattaatatagccacttttggtttcttatgattagtatttgcatggtatatatttttctttttcctttttttttaaaaaaaattttcatctatttttatctttaaagagtgtttcttgtagatacctttttaaaatccagtttaacaatctcagtcttttagttgggtttagactaggataagtaaactactatctgtgagccaaattccacttcctacttgtttatggtgtggcttgcaaagtaaaatggtttttacatttttaaatggctctaacatatcaaaaggagaataatattgtgacacatgaagcttatatgaaattcaaattttagtatccataattaagttttaagttttgtcaaaaaatctgtggaaggtttttttctcacttgtataaatacttgcataatattgtagattttgtctcttggcccaccaaacctaaaatatttatcatatgaccctttacagaaaaagctgaccatttacttttttttttttttttttgagatggagtttcactcttgttgcctaggctggagtgcaatggcacgatctcagctcactgcaacctccacctcctgagttcaagcaattctcctgcctcagcctcctgagtagctgggactacaggtgcatgccaccatgcccagctaatttttttttttttttagtagagatggggtttcaccctgttggccaggatggtctccatctcttgacctcatgatctgcctgcctgggcctaccaaagtgctgggattacaggcatgagtcactgcgcccagctgaccatttacctttgatgtaattttaaatatatttggatctaagtgtacttactctcttgctgtttttctctgtctcttctgttcttgtttttcccctcctttcctgcctttagattatttttaatgttctattttatctccattattggcacattagctatataattttgtcttattattttagtatttgctctggagtttataactcaagtctttaactcatttacattctaataatgtcataacactttatgtacattgtaaggatcttttgttaccttctagattttatgcttctgctctcattcattttgctaatacatatgttagaagttctacaaaatactgtggttttttttttttttgctttagtctgttatattttgaagaaattaaagagcaaggaataggtctttttctcatatttaacttctcgtgctcttcagttttctatcattttcctgtagcccaaggaacttcctttaacattcctcttctgcaatttagaaactgctgttatattcacctggggaatattttactgcagatcttgtattttttcagctctagaatttcttttggttcttttttatgtctttcatttttcttcttattttgttagatgtttatctttaaatccttgatcatatttataatagtcgtataggccttctttgcctattttatcatttcttatttttggatcagtttctgtactgttttatatttggaatctgtagagtcatgaatcttgggttacacaggtttataaaatacctcttcaaacaacttctttttggcctcctcttttctctttttatttatattattttttgttgttcctcactggttcacattcatcttatattttttctgtttttaagactctagttacacatgttagaccacttgaactacgtaatcacccaggctcatcagtcttattgttgctgcataagtgcttgttacattaagaaaagtatgtaaaaacatacatgtatataataatataatacaaagtaatttaaacatattaaaatgtatttgtagttttttatttatcccttttgaaatacattatattgaactgactgaaaaagggagaaaaacatgtttcagtggttgaagaacatggtagatgaagtagttcattttgaatggctttagttccttaacaaaaaagtcagtggtgaagttgcatattttagtataatatttaggagctgcagttggggaatttgaaatggcttttgtgaattatttattaaaatcctatcctacaagaggaatcctggtaatggcagtctgaaaatgttgcaaggacctagttcaagtgatacatgtatgcttaattttgtgcggcatgaatgtaggtaacagcggggaagccaagcagaatgtggattttaggtaggggcatgaagggagaatgttatactacctgatacacggagatggatgctctctaaccacaattggacctttgctgcctgctgttcttagaataaaatgaacagttttttttttttaaagaaattcattatgatggggatggaattgggcgaagcaatcgtagattcattcatcaaaaataattattttgaggaaaaaaattccattggaatacttatatagttcattatagttcatagaagccagcaagccaggaatgagggaaataaggagcttgacacttgttgttggtatgagatgtaacattttaacattgcttgtttttgcttaggaagttaggctgcttaataaatgtggtgcagtgaaggatctttacagtcaagataaacttttagctgatttacttttgtttaatcctcattattttggggctaattcacagtatctttagtatagtttttcctccttattgttctatatcacttgttaaccaaaaagtggcaggtctcaatccatagaggtttacttagtcaagggtttagtatgtgcctgggaaaaacaagccacaggaacagttgtgacctgtgcttttctagaggggttttgggaatttcggtgtttaaacggggaaagggcaagcacaggttaaaaaagagggaaaggtaggcagtgaggcaaatggttgcattcttgtgaggctctgactagcctcaataaatctacactttacatgtgaaaagagggagtagaggaaaaagtcatttgggttggttccaagtctttgctattgtgaatagtgccgctataaacatacatgtgcatgtgtctttatagcagcatgatttataatactttgggtatatacccagtaatgggatggctgggtcaaatggtatttctagttctagatccctgaggaatcgccacactgacttccacaatggttgaactagtttacagtcccgccaacagtgtaaaagtgttcctatttctccacatcctctccagcacctgctgtttcctgactttttaatgatcaccattctaactggtgtgagatggtatctcattgtggaaccaacccaaatgtccaacaatgatagactggattaagaaaatgtggcacatatacaccatggaatactatgcagccataaaaatgatgagttcatgtcctttgtagggacatggatgaagctggaaaccatcattctcagcaaactatcgcaaggacaaaaaaccaaacaccgcatgttctcactcataggtgggaattgaactatgagaacacatggacacaggaagggaaacatcacacaccggggcatgttgtgaggtggggggaggggggagggatagcattaggagatatacctaatgttaaatgatgagttaatggatgcagcacaccaacatggcacatatatacgtatgtaacaaacctgcacgttgtgcacttgtaccctaaaacttaaagtatagtaaaaaaaagaataaaaaaaaaggaagtcaattatgcattcgtcttagtgtaggtgaagggacgatttctggtcttgtcctgtgtctgtgaagataagctgataattgacattgtgaggatgagatttgacagaactcagctttagagctagtttatagggaggatacatatcttaaatgatttaggggctcacacggaaattccttgtgagtaatctgtgagggaagccatctggggagatatgtgcccttctatcgttgtgggaacctggcatatggataaggctatgacacagggttgtgaatttacagctatctgggaacaaaaagaaggcagtatggtgtgactcggttcccaagcttatcttttgctttggcatagtcagtttggagaccagaggttctgttgttcttttacatacttgtactctatctttttgagttttttttaatataaagcttaaattttttctctcatctgaagaacttacagctaagtaagataatattttgagagattcaaaagtatgaaatggctggctctggaactctgacataagatttaggattataaaatcctagaatcctagattttaaatcctaaaattttaaaatataaaaggagtgaaaatacagagagacctagattttgtttgaaatatttcatttctttttgggcattggcaagattataatgatggtggagttttgcaatgacttttgagtgtttctttttttgtttcttcagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgaggtaagctctaatttgtttttctttagacacatattaagtcttttgggtggtggtgaagatgttatagcatcatcaggtgtagaacttactgtgaactcacactgtagacatgcagagtaaacatgtttaggcttagactgtgttcattgtttgaaaggggcatttgaacaattgtattagtctattcttgcactgcaataaagaaatatctgagattggataattgataaagagaagaggtttaactggctcttggttctgcagggtgtataggaaacatgatgctggccatctgctcagcttctgggagggaggcctcaggaggggaggcctcaggaaacttaaaatcatggcagaaggcaaggggaagcagaattgtcttacgtggcaggagcaggagcaagagcgagaagggggaggtgccacacgcttttaaacaaccaggtttcatgagaacagctatcatgagaacagcaccgaggggatggtgctaaaccattcataagaaattgttcccatgatccaatcacctttcaccagccccacctccaacattggagattacaatttgacatgagatttagacggagccgcagatccaaacccatatcaacaattacgcttagaatattataaatagaaataaaacggtaaaaatacttgtaatatttatttctctatcctgaatgagcataaaaatctgccttcagcttctgaagtaatagtggttgaaagaaactggagtgagccatagattttaagttatttacattagactggaaagaagcaaaatggctttttcctcttatgcttaattaggaataatacattacctcagctgaacctttagtttctttaaatgtaagtcagggccaggtgtggtggctcacacctgcaatcccagcactttgggaggctgaggtgggtgaatcacttgaggtcaggagttcgaaaccagcctgggcaaaataatacaaaaatttgccacgtgtggtggcacacgcctgtaatcccagctgcttgggaggctgaggcaggagaatcgctcaaactcgggagatggaggttgcggtgagccgagatcatgccactgcactccagtctgggtgacagagacccccatctcaattaaaaaaaaaaaaaagtggccgggcgcggtggctcaagcctgtaatcccagcactttggaaggccgaggtgggtggatcacgaggtcaggagatcgagaccatcctggctaacacggtgaaaccccgtctctactaaaaatacaaaaaattagctgggcatggtggcgggcgcctgtagtcccagctactcgggaggttgaggcaggagaatggtgtgaacccaagagatcgtgccactgcgctccagcctgggcgacagagcaagacgccatctcaaaaaaaaaaaaaaataagtcagataatgttattctcctacattcggcctttccctcagtcacacttgtggttatatttgaaatccttatcatggttaggcactgttgacctactgctccaacttgttcttcccctcttcgtccttccttcttttcttcttagcctgtttgggctgctgtaacaaactgccatagactggtggtttacatacaacagataattatttttcacagttctcgtggttgggagttcctagatcaaagctccagcatatttggtgtctggtgagggcctgcttcctggttcatgtgttcttacatggtggaagagagtgtaagagctctctggggtttcttttataaggatactactcttattcaagaggactcccttctctctctctttctgtccttctgtctccctcctcccttctctctcttcattcatcaaaagaagatgcagatttgtgtgtatgtgtgtaagatgtgcaagaatatgaagataatttttttttttattatactttaagttttagggtacatgtgcacattgtgcaggttagttacatatgtatacatgtgccatgctggtgcactgcacccactaactcgtcatctagcattaggtatatatcccaatgctatccctcccccctccccccaccccacaacagtccccagagtgtgatattccccttcctgtgtccatgtgatctcattgttcacttcccacctatgagtgagaatatgcggtgtttggttttttgttcttgcgatagtttactgagaatgatgatttccaatttcatccatgcccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcatttgggtatataccgagtaatgggatggctgggtcaaatggtatttctagttctagatccctgaggaatcgccacactgacttccacaatggttgaactagtttacagtcccaccgacagtgtaaaagtgttcctatttctccacatcctctccagcacctgttgtttcctgactttttaatgattgccattctgactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagatgagtaggttgtgaaaattttcttccattttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctatccagttttcccagcaccatttattaaatagggaatcctttccccattgcttctttttctcaggtttgtcaaagatcagatagttgtaggtatgcggcattatttctgagggctcttttctgttccattgatctatatctctgttttggtaccagtgccatgctgttttggttactgtagccttgtagtatagtttgaagtcaggtagtgtgatgcctccagctttgctcttttggcttaggattgacttggcaatgcgggctcttttttggttccatatgaactttaaagtggttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaggaggtccttcacatcccttgtaagttggattcctaggtattttattctctttgaagcaattgtgaatgggagttcactcatgatttggctctctgtttgtttgttgttggtgtataagaatgcttgtgatttttgtacattgattttgtatcctgagactttgctgaagttgcttatcagcttaaggagattttgggctgagacaatggggttttctagatatacaatcatgttgtctgcaaacagggacaatttgacttcctcttttcctaattgaataccctttatttccttctcctgcctgattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaatttggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgagtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacagtgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtgattttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgtctttttttgttttccatttgcttggtagatcttcctccatccttttatttttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctgtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttactagattggggaaattctcctggataatatcctgcagagtgttttccaacttggttccattctccccatcactttcaggtacaccaatcagacgtagatttggtcttttcacgtagtcccatatttcttggaggctttgctcatttctttttattcttttttctctaaacttcccttctcacttcatttcattcatttcatcttccattgctgataccctttcttccagttgatcgcatcggctcctgaggcttctgcattattcacgtagttctcgagccttggttttcagctccatcagctcctttaggcacttctctgtattggttattctagttatacattcttctaaatttttttcaaagttttcaacttctttgcctttggtttgaatgtcctcccgtagctcagagtaatttgatcgtctgaagccttcttctctcagctcgtcagtcattctccatccaggtttgttccgttgccggtgaggaactgcgttcctttggaggaggagagacgctctgcgttttagagtttccagtttttctgttctgttttttccccatctttgtggttttatctacttttggtctttgatgatggtgatgtacagatgggtttttggtgtggatgtcctttctgtttttagttttccttctaatagacaggaccctcagctgcaggtctgttggaataccctgcagtgtgaggtgtcagtgtgcctctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcccggctgctttgtttacctaagcaagcctgggcaatggcgggcgcccctcccccagccttgctgccgccttgcagtttgatctcagactgctgtgctagcaatcagcgagattccgttggcgtaggaccctccaagccaggtgtgggatatagtctcgtggtgcgcccttttttaagccggtctgaaaagcgcaatattcgggtgggagtgacccgattttccaggtgtgtccgtcacccctttctttgactcagatagggaactccctgcccccttgcgcttcccaggtgaggcaatgcctcgccctgcttcggctcgcgcaccgtgcgcgcaccaactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcttcgataatttgtttacttgcattgttagtaccactttcctctccctttctctgtcttcattcactacattccagttatactagcctctgtattcattcttataggacttaccagtcatatttcccgccccaggaccttggcatattatctttatactccctaagtaaatctttccctgattttccaatgctttttgtttcatcttagtaaacattttatcataagaagccttccttggttatatcatgtaactctctttcctcatactgggccatttttttttccttcgtagcacttttctttgaattgatattatatttatttgcttattggtttattggatatcttcctcactagattataagcttgtgagaatagtttctttatatttttccctgctgtagcttcagtggctagggaagtaagtgattcattgtaagattttagcaaatatttgctgaatgaacaaataagcagaccaggtcaaggaaatgaggttgaatttgtctggagcctggaatattctctgaaagttgctttaatcttttaaaaaccctttctgatttgcctcattctctaaagtttagaatgtgggaaaacttttgctaaattccaagtaccaaaatattggcaatataaatttagaaaattttggtaaaaatgctttgaatttttcaggaaagggtttgcatgtatattgtttatatgttatcgtctaaaaatgtcaaaatgtctttttaaagaaaaattgttttcaaagtgtcttctatgctatctgtttagcttcaatttgccaaacacaccttgacagagatttagtgttttgacttgcctctttattcctggggttgtccccttaccctcagtttctaaatttgagatcttgaaggggtcttgaatgtgtagatcagtccaggacttaggatttgttttgttttgttttgtttttgtttttgtgtttgtttttgtttttgagacacagtttcactctgttccccaggctggagtgcagtggcacgatcttggtgcactgaaacatctgcctcctgggttcaagcgattctcatacctcggcctcctgaatagctgggaataccggttcccaccgccatgcctggctgatttttgtatttatcagaagagatgggatttcaccgtgttggtcagactggtcttgaactcctgacctcaagtgatccacccatctcgacctcctaaagtgttgggattacaggcgtgagccactgcgcccaaccaggacttaggatttgtgtagggaaagtcagataattatttgcttccaaatcccagactcctttcagcttttgtattccgttgttgaattcatctttggaaccacctgaccttttctgtggtagaaagggcctcagttgaacaatgaattagggcttagataaactaataggtgctgctctgtatagaagtgggctctccaggaatagtctatactattctagattggcattccttttgccataattgaaaaagactagatttagggatgggtgatagagatgttaccaggcacgtatacttagctttggagtaaatgagttggttcataggaaacacaagaatgaagaaattgtgagaagataataaagaatttatgtgtatgtgtgtgtttgtgtgtgtgtgtgtgtgtgttgtgaatatgaagacaagttgttctctcttgcattgttagttccagtttatttttgtgatttttaagatagttatgtttggccagatgcgggggctcacgcctgtaatcctagcactttgggaggccaacgcggggggtcacctgtggtcaggagttcaaggctagcctggctaacatggcaaaaccctgtctctacaagaaatacaaaaattagccgggtgtgatggcaggcacctgttatcccaggtacttgggaggctgaagcaggagaatcgcttgaactcgggaggtggaggttgcaatgagccaagatggggccacttcactccagcctgggggaaagagcaaaactctgtttcaaacaaaacaaaacaaaacaaaaaagatagttattttatatatcatatattgtcatagtaaaactatttgttctttttttttaaaaaaaaaaacctaactggaaatatgtctttgttcttcgagaattaatattttatctaacttttcattactgttctacagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagtataatatagtatagcaatttgctatagagatgaattagggtaatatttttgagctctaatttcactgttgtataaatatgttacataaatttggagtatgtttctaaagacaaaattaatatttgtaatgacatagaactgaatgtggaaagccaagtctggtatatctgcataggtagggcactctcacagcttagcagttgtcgtagaaaaatacaactggatgagttgcctttccaccttaccatggtagtaaattgcttatgctcagaagggagactatttttgcagctctcttattattttgccctagtagattggtccatgtgattttaaaaagtgcctataacgatacctgtttctctgatgggcttgatagttgcatattgctttcatttagatattgcattaagattattttatcaatctctgtggttttcattgatgattatttgttttgtgctttcttgctcagaggctatattttgctccagagaactggcttaaataaaattacaaatgctcacttaaagcaggtataacaacttgtagtcctttgaaaatgctagtaagtttttttatagaaattactaattggtagattattgttaggagaaatggtttagattaaatgcagttaattacatagggaaatcttttctacatctattgaattatccccaattttaaaatgttgcactgttagacacttagtacttaaaaccatttcaaaggcattcataaatgggtgtggatggcaatgtctcaggtatgtttgcttgtgacaaaataaattatcagcagaaaatgctgaaagcaatagttattctagcctctatcatgaaacatgaataaatcattctattaacaggagttttgagtttatttctggcgacaaaatgggaattaatggaaatatggatttctgtgagtttgatacaaagcatgatggctatgtcagttcttgtgccctggtgatcagtttgctttacactaaactgaacatgcacagacacatataatttagattgtaactgtagaaattctctatcagaacccatgccttctgaaagaagttgaagttttgtgttttgttttttagataaggctttatctatttttttcccagcacttacatatctatgtgtatactgacttcttgttcaaaatggtctgatagacaggagagtgaatgagtataagtatgctgctagtgtgcctagcatatagtagacagtgaatataaatatgctgaaggaatatgtatgtttctgtgaatgaggggggctatttctgatccttacgaactccactacagaggtggggaagcagatggtagaatcctggcatttcatgttggcagccatcatttaacccacctgtgtgatttccgaatcactggagctcaacagcaaggaaatgagctttgaagacctggaaaatctgctgcttggagagagagaaatgctgctgcagaaggatactgaattgctgcaagaagtttccataactaatggtatgaaactgtcttttggattgtagcattcacttgggtttagagtaggggaagtgtttatttttgagagcttatcatggtaggtaagtagtggaagaaaccctgggaagttcttggccagaccattttggatatagtattaaataaatgctgtttctatagagcatattttttccattgcacgttgtaagaaagttatctccatctattatttaattttttgagtgcattttagaaagtattacattatgggggcattagtggtaaaatatattgtttgaaggagaaatacatgacagtggtcattaaaccttattatgagacattatttctttttaaaaaaaattttaaaaatcctcctccaggtaatgaatgacacatcagttctaaatgaggaataacccaatataaatagagagcttatgccaggcactgtgctaagcgttcatttgatactcataacagcccgtgaccaggttggacttattagacaagtgactttatgtttctctttgcctggagcagttctattttatgcttattgtccaggtttttactaataccctcatttttattctcaaaagtgttgtggtttggatgataaattgtttggttaccctttgtttatcctgtggctaagagactgggtgatagagctgggttttaagttgaagtctttgactttgaagagccatacagttttcagtaacaactttcctgttgcttacatattataaaacacaaatgtggatttttgtattttagttatgttttataaagggatttattggtaacatagcttgcattccatttacgttttgtattttacctggcccttttgcagaagatgtccaacatcttcctctctgccctacaaaataattatggttgtaattaatctgaagtcttctagttacatttactggtcatccggttgtctggttcccagaagttttctgttctttgataaacacctttagtcgttagtatttgagtgcctcttgatgggcacaaacagttggcagatagttcaggaaccagctgacaaacattcttactgcttaagtatgtactgtgcagcaatgccacaaatttattttttatttttattttcgcagagttcgtggatgagagctgaagaggtttgtcgttaaaggaagatttctgaagcaggagtagcagcatggctgccactactgtcactgtgatgcttatttcactataaaatccctcaaactgcaggcatcaacaatggtagaagggaatcccagtgagggtgatggccctcttgaacacctgtgacacaaggattgggaggtcccacagaagggttaggacacatttgacttgcaacacttggatgtgcttctgcaggactgtgctttagtagatttcaataatctatggcaaaagagttggacaatccaaccagaagtatcttgaggtcaatgatctttgtataaggagaatgatatgctaggcttctgctgaagaattgcagaccaagcaaggtatcagaaagtgtagtgaaaaaaatacaaggaggcacctgttcttgtcacatctttttggatatattatataaaactttcaaaagatacttttaaagtgttaattgagtctttctaagattttatttctactagccagtgtaaccattctatgcaaagcagattttgatgatatttgtgtgttttaggatactattcagtattagaaactctgttacattatggaagcatgttttttgtcatctggtgttaaaggcattcagagatacttcttgataaatatcaagggcatcattgggaagatacttattcttattgcattgttttttcttggggttgcagatatgacactgtataaaagaaaacgtgttccttgcatgggaaaatttctttttctttgagatggagtttcactcttgttgtcaaggctggagtgcaatggcgtgatctcggcttactgcaacctacacctcttgggttcaagtgattctccagcctcagcttcccaagtagttgggattacaagcatgcatcaccacacctggataattttgtatttttagtagagacagggttgcaccatgttggtcaggctgctctcaaactcctgacctcaggtgatccacctgcctgggcttcccaaagtgctgggattacaggcgtgagccaccacacccagtggagaatatcatttctaaacaagtatttatttaattgttatgttagctaaatgcctcattttggaagataattcgaagttatcttgttagtgttttccttaaatcaattgatttttatgattttaaaaaagtttcctggtagtgtgcctcttattttagctccttcccatgaataatgtatttgagctagctgttttaaaaattttaatacatacctttcaaggtgcctttcatagaatgatttttcacatttatttcttgggtgaactttttatttttttttttgaggcagagtctcactgtctcccaggctggagtgcagtggcgtgatctcggctcactatgatctccacctcctgggttcaaacgattcttctgcctcagcctcctgagtagctgggattacaggcacatgccaccacgcctggctaatttttgcgtttttaatagagacggggtttcaccatgttggccaggctggtcttgaactcttgacctcaaatgatccacctgcctcagcctcccaaagtgctgggattacaggtgtgagccaccatgcctggccttgggtgaacattttcttgatatatggtgtttccaaaagagtgagttatctttcaccagtattaatgaaaagacttcatcttggagaaactagctatgttatttattttaaataaatacctttgttacttaataacagtgtttggacttttaagatgtaatacatatttgagaatttggaaaatattgaaataaaaaagaaaataaaaggtgcttaaaattccgccgcagttaagattttggtgtatctccattccagatatctacatgtgctctcctccctgcctcttcaaaaacaacagcaacaaactcaaacagatatacagttttgtgtttagtattttctatagatactgttttctggagaaagattgtattatttatcaataaaccttttccttctgcaaagaaatgcccattcaagactatttgtgtgtatgtgttttaataagtgtgacatgtattgaagtgtttgccatggtatgtgtttttaatttcctttcttgatgtacagttagcccactatatttgtggattctacatccatggagtcaactaaccatggctttaaaatatttgataaaaatgtatggtttcatctgtactgaatatctatagccttttttccttgtcattagtccctaaaagatacagtataaaaaccattcacatagcatttatattctattaggtattataagtaatttagagattaaagtatatggaaagatgtgtgtaggctatatggaatattacacagttttatataagggacttaaacatctatgcattttggtatctgggagttttggggggtcctagaaacaattccccatgggtaccaaaggacaactgtaattggttatccagtttgttataagatactgatagtcattgtttctgaagtttatcttgttaattcttggattactgtttcagcttattcacagactctagaattcacaatatattttaactcttttggtagaaatggcagcttgtaagacatagtattaaatgcaatttgattgctgttaatgaaattaatgtactgtcgtgttctttctccaaaagagagatagatggaatcttatttttttttctccatcattctgtatcactctggctcagctccatacgcttaacctttctataaagaattttttgaagccttgccagatgctttagaatttgccaagttctttgactttttttgatatggccttctgatgtgacaagctggctgatctgacataaagaatgtgaaaaagaagagatgagaaaggggaaaaaagaataaatatggctggggtttaactaccaatgtatgcaaaattacatacaggtgttctcctgttttcacatacagtgctttcttaaaaatacgcttaagtccgggagtagccagaaagagtcatggcccaaaaccccctaacagcagttagtgtggcatctccacagtggggaatgttgtaggagttattaagaaattattttaggcatatagagatgaaaagggatccttgggaaattttcattttttaaagcatctctggaaaagtttcttgtaaagccccagctcttagagccaggccagcaacctataatatacaaatggtagccattagaaaccgggtccacccaacatggcaattcccagggccttcttgcccttgccccacatgttcctggcaacatggctgcccacacatatccttgcgtgtggagagcatcatggtgccctgcatttgcatatgaaaagctagggtgggagggccagctttttccacctgctacgtgaattgcatgcctagtcaaacccatcccatgagccctatgcaaatcagacatcacgtcctccagcctctgcatatatacctggttagtatgcatggcaggtggtgttctgtctcttggctttggagcccctctccctctgtctctgtatggggagccgctttttttttgcccttgtttcttgcctattaaactccctgctccttaaaacaaaactaaatatacactgaagttaaatgtataaaaatcagacagtagactttatatttcatttaggagtaggaagtggagaatacccagagaactaaaagtagtttaaagtctctatttacacttgaccttgtaggcatagtcttcaatgacatatttctagcatattctttggttctgttttcctctataaacacttgaattattgggctaaatccagtaactatccagctgaggctgaacctttctgtttttagcttatctaatgattccctctcatccatccccaagcacattcaacttaatatttgctggagtacaggctgtatgttctctcttgtatttctggcacctagactaatacttggtatgcagaaggtgctcaaataatatttgttgaatgaatgagtttattgtcttaattatataagttttgaggcctacagttcttattagcatcaatcttttgctgcttttttaatttttactcatataagattaaaatggggatagcatggtaaaataatgaagaaattttgggaacattatgatataaatatggtgctactgcagaagttgaactttagactggcaggtaggatttctgtatagttgttaaaagttaaaactgttaatttggcattgagaaggcactttagggtaatcattggttaatgggtataaatgtggcattcggaagtttttgaatgtgttagactgtgtgtgcttgtacaagaaaaagtggcagaatatgtgaataaaacaaaggaaaacagaagacctcatactttaacagactcttctgttatagggagtattcctgtttcaagcaagttacaaatattgtattcctagactaatacagttcaagaagtactttgaattcactttatctaaagtgagggatttattaatgttcacagcattcttcttatctgtacttcccaatgtgacacattgaaaatatttttttaacccttcacatttcaccttgttttctttgtcaacctatgcgtgggctgagagatttggagaatctttggtgcttcaagctcacaagtttgtgatgatctgatgcttcttttggaaccaagaagtagaataacttctggagaagtgttggatttagagtacttcttcactttaaggaaagaatatgagctatacacacaaatacacacacatatgtatatacatatatatgtatatatgtatgtataaaagtagtcactagagtggcctaataccaatagaatagataagaataagaccatttcagcattcattctgggaacccaacacttatagcacaacaacattgagtaaaaatactggtagctctttatgttactgactgtattgctaaagccagtatttgccttattctatggttctgtatctagcccctgaggctgagggaagtgaagagagaacttggagacttggccaaaaccttgtttgtgagagtgtgttgggaagattcagataccaatatcattttagtaaattatcttaggatacattcaatttcttgtatattttgaagcctagaaatatctataaataaatacagtttattttgtgaacttaaattagttcaatatctttatcaccatgtttaaatgtcagagttgtgagaagcaaatatttgaaagatagctttttttttttttaaagtaaaaggaattccttctttctttctttctttcttttttttttttggagacagagtcttgctctgtcacccaggctggagtgcggtggtgcaatggctcactgcaacctccacctgccaggttcaagcaattctcctgcttcagcctcccgagtagctaggattacaggtgtgcaccaccatgccctgctaattttttgtatttttagtagagatggggtttcaccatgctggccagtctggtcttgaactcctgaccttgtgatctgcctgccttggcctcccaaagtgctgggattacaggcatggagccactgtgcccggccctcttgcccttcttcattcttaagatgctcagatcctagttgcagctcctaaatcatagttctcttctggtctccagtatgtatgctggtggtgcttagtgttgaactttatctgtatatatttgaaaaccctcctcagatttgaacttaagtttccatgaagtgaaatgtaccccattattaatttcaaagtaaaaaattctgttaatttacttcttaagcgatatttcttcaatatttcccttcttggacttcacattgatgatagtttttaggttgtaataatttagagtttggatggtctacatttaccatctacagttgtttactccctctttttttaatgcacaagtgatgaaaatgttgtcatgtaatatctaaacaatgataaatacttagactatatataaaaatatatattctgccaaagaaaattgtcatggaaaattgtagattcaagagttaggagagaaggatatcagaatgcaattaaaacctttgcctaatggtatttccttttttattcttttaggtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttaggtgaggcatttggaaagattaaaaattcgcattgtatctggagtataatataggcgcatataaagtttcaagaaactatacagtgttggcataaagcctcaaactgataaatatttggctggtgaattaatattttttattcttgtgcttgtcagatatttctttccttttttttttgagatggagtttcgctcttgtcacccaggctggagtgtgcatgtgcaatggcacgatctcgactcactgccatctctgcctcctgggttccagtgattctcctgcctcggcctcctaagtagctgggattacaggcgcctgccaccatgcctggctcatttttgtatttttaggagagacggggtttcaccccgttggccaggcttgtctcgaactcctgacctcaggtgatctgccttccttggcctcccaaagtgctgggattataagtgtgagccaccgcgcttggtcagatacttattttcttaatgatttaaaaaatactgatactgtagaaaatttagtaaaataataaaagtagaataaaaactacgatcttgtcagccacagtcacttttaacatttggtctcttccctttgtttatttctaggggaatttttacacaattgtatatatataccttttttttttctttatgttaagtgttctaatcaaaattgtttttaacagtaactgataatatatggtttgaccaccacttaattaaccatttcttttttttttgtacatttagaatgttttcctccagttcagatatagacagttaataggaaacagttatattatttaatgctcaactttgttccttagctgtgcctttaattctaagagtagttgctagctaggtattttatctgtagttttacagacattgaaattgaggtcatgtaaaagttgctcaagatattttttctttttagataagacaagccatattttatacattgattattttaatgaattaatttgtaagaatagtctagcctaggctagaatttgattaacttgtccctgttatgtatctctttgtccatcttttgtttatatattcatggatacatcacagtcatctcaaattctatgtgtctaaaagtatgctcttctcacttcctttgctttggatttcactgttttacaggcacttatgaccacccaaccagctaaaccagacatgtgacagtcttaagaacttcaagtaaacattattcctaaatttgttttaaaactgaaatttatcatgttgtcattttttttttttttttggagatagagtcttgctctgtcgcccaggcaagattgcagcagtgcaatcttggctcactgcaacctctgcctcctgggttcaaccaattctcctgcctcagcctccccagtagctgggactacaagcatgcaccaccactcagctaatttttgtatttttagtagagatggggttttaccatgttggccaggctggcctcaaactcttgatctcaagtgatcagcctgccttggcctcccaaagtgctgggattacaggcgtaagccaccgtgcttggccatgttgtcttttttaagatcttgcttttaactttggttagcagacaaaatataaggctcttgtaaactcaatttagaaattaataatgactgtgttgctgactataaagtttatagtcaaataaaattaatagtttgctgcctgtggcaaggtgagagtttagtatatcttaagaataagggtgttgttgcttaaatactttgttgttttgttctaaccttggaataggttattttatcattttattagattattggtaattcctattccttttgaatatttcagccctgtgcctaaggatagagataaattttatttcaaattaaagcaaggaatagagaagaaggttgtgattacagtgcagcaactttctaacaaagaattagctattgaaaggtaagcagcttgctcctaaatgctaccaaaaacttgtattgacattgttactgtctcagatgcattgctcagtgtggcttttcactatacttcattttctccaattaaaaatgaggataattaataatactttctctactttaacttagatgtaactggtttcattgaaaatcaattgctggggtaagtaaacatgaaatggttttagtttttcagtcataactgctacaactgggtttgttcacatctttttttcttgttccttatttacatacagcataaatacttttaacttttcaatcactttcgattactcttccacttagctgctggaatttcagaaactttaaaagatagatacatatttttaaaatatataaatacatacacatatacttgtgtgtcaattcacaggaaaactattcagaaaacaaaggaatggtaggacaaaagatataaataaagtcaacaagaaatgatagttctggaaaaaatattcgtaatgtagatgacaggaaaaggtaatgtctacaatatacataaatttcttaacaattggcagaaagcagaggagaaaaacaggtcagagtataaacagatcagaggaaagctactggatggctaagaaacatatgtaaagaggtcctgattcacaaaaagacagggaaatgcgaattatagtaaccttaagatatcagattgcaaaaatatgtagtgatggtgggggtatggggcaaagggaattctcatactgttaatggaaatgtaaaatgtacgtatgtcctttttgaaaaccaattaggcaacatatataaagattttaatacctataattggacacataagtcttattctagggaatctgtgctattcaaaataaaagtatcactatttaaggacatttgtaaggatgtttattaataaacttaattcaaagttaattcaatacctagtacttctttgtctttgttgctacatatttgttaaattgaaagttgctttgttatgccaaaaaggaagtgctcaaaaaaatgatgggggcatatgctaaagatagggtttgaaggggcttcaactggttacttcttgggcaatctgaacaacaaaataattaggtacttcagtcaattatcagtcagtactgaagtcaatcagtacttcagtcaaacaacaaaggatgtttattaatttaactttgaagtattatttttagtggcaaaaactggaaatacagatgcctatttggcttcaaggagcaagggaagttggtgatgctcaagagaaataaaagcctcttcatcaagactgctgtatactatgtcttattctagggaatctgtgctattggaaataaaattccaataataaatagattccctctgtcttccctccagtctctagactgggatgagggtgggaggcaattgaggcgctggctgatggcatcatggccacttctgttcctcttaaatataggagaaggtatctggcccccagttatctgctgtttttttttttagaaggtaggctatctagctccactttgttcccatctttgaatcctgccaggcaacaggaaaagttttattcagcatcttggtacagtgatgcatgcatgtgtttttaattgcttgcaaagtttggccatatgtaaaaaccatcttttataaattttaagatgcatgtgttttcatattgaacatctctgaaattgtagtttgtcttataattgatggcattttttaaatactttaagttctgggatacatgtgcagaacatgcaggtttgttacgtaggtatacctgtgccatggtggtttactgtacccatcagcccatcatctaggttttaagccacacatgcattacctatttgtcctaatgctctcccttcccttgcccccgaaccctgacaggccccggtgtatgatgttaccctccttgtgtccatgtgttctcatcgttcagctcccacttatgagtgagaacatgcagtgtttggttttttgttcctgtgttagtttgctgagaatgatggtttccagcttcatctatgtccctgcaaaggacatgaactcattcttttttatggctgcatagtattccgtggtgtatatgtgccacattttctttatccagtctgtcattgatggacatttgggttggttccaagtctttgctattgtgaatagtgctgcagtaaacatacgtgtacatgggtctttatagtagaatgatttataatccttcaggtatatacgcagtaatgggattgctgggtcaaatggtatttctggttccagatctttgaggaatcaccacactgtcttccacaatggttgaactaatttgcactcctgccagcagtgtaaaagtgttcctatttctccacattctctccagcatctgttgtttcttgactttttaatgattgccattctaactggtgtgagatggtatctcattgtagttttgatttgcatttctctgatgaccagtgatgatgagctttttttcatatgtttgttggccgcataaatgtcttcttttgagaggcatcttataattatagttgtcacctttttttcatgagatacaaaaaataatggtgagtcttaaaattgatggctttcttaaaattgatgaaaaagagctgaagatatcgtatttttgatgttgaatattacagttccaaaagaatatgattatattttgcatacaggaaccttttagtttttaggggtaagcattatatatagcagtgttttaaactttttatttggaagtaatttcaaacttacagaagagttaaaaacaatacaactagtagagagaagacctgtatactctttaccaagattgttaccaatatctcagtgttaccagtgttaccaaaatctcagatattgatgacattttacctaatttgctttgcattctctttctttttttgagacaaagtctcgctctgtcagccaggctggagtgccatggcctgatcttggctcactgcaacctccacctcctaggttccagctattctcctgcctcagccttctgtgtagctgagattacaggtgtgccctacaacgcctggctaattttgtatatttttagtagtgatggggtttcaccatgttggtcaggctggccttgaactcctgacctcaaatgatctgcctgcctcagcctcccaaagtgctgggattacaggcataagccactgtgcccagcttgcactctctttctcttctccctgctactcgctatacacacacagttgttttcctgaacacttttaagagtgagttaaatacatcgtggccctttcctccaagtgctttagtgtatgttttccaagaatagggatatcgcttacatcaccacagtatacttatcaacatacgtgaatttagcattcatacacaacttttaatctaacctgccatttgccttcctattttgccagttaacctaataatatcctttcccccactccagttcagaattcattccaggattagatattgcatttagttaccatatgtctttagctttctttaacctggaacatttccacagccttcctctgtctcttaagacttggacgtttttggagaatacatccatttttcctctttttaatataacattgcccatttttggctttgtttaatatttgtgactaaattcagattatatattgctgcatagtttatatgtccttcacagagtatcacatctggaggcagatggctatcacagagatagccatctgtcccttgatgatgatgatgttaattctgattacatagttaagatgtctgatttcttcccactatgattactttttttcttccttgcaaccagtaagcagtctgtgaggaaacacattaagaccatgaaaatatgctgggcgcggtggctcacgcctgtaatcccagcagattgggaggccgaggcgggcagatcacgaggtcaagagatcgagaccatcctgaccaacatggtgaaaccccgtctctactaaaaatataaaaattagctgggcgtggtggcgggtgccagtggtcccagctacttgggaggctgaggcaggagaatcccttgaacccgggaagtggtggtcgcagtgagccaagatcacgccattgcactccagccttgtgacagagggagactccgtctcaacaaaacaaaacaaaacaaaacaaccaaccacgaaaatatatcctgctcctcatcaaaatatcctccttaatttaacattcttgtatgattcttgttggatctagtctgtactatgatgattgcaaaatgattaatttctcaactcttgccttctctctacattttgtattcagtccttggcattctgatgtaaaccagagctttcccttttcttccatttaactacttgttattgatatagattcctaaatttaaccccacctcctccccccagtactatataattgactgaagtacctgattattttggtgttcaaattgccctagaatcaaccagttggagccccttcgaaccctatctttatgacatgcctgcatcatttttttgagcacttcctttttagcataacaaagcatctttcaatttaaaaagtctgtagcaacacagacaaagaagtactaggtattgagttaatttaactttgaataagcgttattttaaaatcttggacttttatgattaagtggtatattatgcctgaactgtgcctaaatgtaaaggaatgcaatccttccttttctcagtaagttccatgtttgatcaacttgaatatagaaacctagacaaatataggtgaaatagttgaatgcctaattatatatatgttctttgctaactgggtagaacatttgcacacacatttaaatatattacacaaaacaataacttagaaatgttactttttgcccacccttatattcatacaacaattttatcagactctcataatctttaatattgatatcttcatcatccttaaaactactttttgaataattttaaggcattttttccagagcacattatgtcaacttctgcctgagttgagagaaaatgccttttgaatcagtatatgctactaacattggatattttaccaaaaacacgagtacacatttgtacacattaggacaattgtttttaaagttactttgaatacataaatgctatattggttttatttctttgttaattgacacagaagagttgtattattgtgtacatgttttgagatatgtatacttgtggaatggctaaattacattgtttttattttaacaactattttgctgatgctaatatctaacacttgcaaccttggactcatatatccaacagtaattactgaatccatgttaaatttcattgcttccttttccactgattctgtcagataatctctgtaaacatccaaatgttaattgactaagatttcttcaggtgaatgactcttccctaaacaatactttgttcagcataacagaccaaattacctgtgatacagaagatttagtaaattcttggatttttctatattggtaaaagaaacatttgcatttcattggattaaatgtggtatttaatatgtttaaatcagactgtaaacagtggaatttaaggtagtccagcaggtggcagccttaccaagaaaattcttaacacctctgaatcttttttgttagactgggtctcactctgtcacccagcctggagtgcagtggtgtgatcatggcttactacatctttcattgcctaggctcaagcgatcctcccatctcagcctcctgaggagctgagactacaggcacatgccatcattcttagctaattaaacatcttttttttggagagatgggggtctccctatgctgcccaggctggtcttgaactcctgagttcaagtgatcttgacttggcttcctaaagtgcttggcttcccaaagtgctgggattataggcgtgagccactgtgcctgacccaaatctttaataactgctgctgacaaagttaatttgtaatataaaagcattggtgtgaaagaaaatccttcaaattacataatttttatcttctgaacgagaaaataaaatttatcattaaaaaatttttaaaatcattatttaaattatgtaaaattatcaacattctgggtttttttttgtttgtttttggtgacaggacctcgctgtgttgcccagactggagtgcagtgatgtgatcatagctcactgcagccttgaactcctggggtcaggctatcctcctgcctcagcctcccaagtagctgggactacaggtgtccaccactactctgggctaattttatgttgtcttatttatctttcatagagacggggtctcgcttagttgtctgggctggtcccaaactcctggcttcaagtgatcttcttgcctcagcctcccaaagtgctgggattacaagtgtgagccaccatgcctggccaatattctgtttttttttttgaaaaatatattatgaaagaagccatttctgtgtgcatccaagggtttaagggttgtttatatctagatattttgcaaattatactgcagttgtctgtcttgacccttttgataacaagcactatgttgtttatcccagaatccccagcatctactatagtgcttggaatacagagctttatacttagctacttactccttacttagcactttctcagtgccaggcactgttctaggtggtatttctgaggtataggtactattatcttcatttttcagttgaggaaactgaggtacaaaagttacataacttgaccaaggctataaaattactttttaactaagtacatctagtactagaacacatattcttactctctactgcttctttttaaatacttgactaaatcaataaaaagtatataaaagtttataaagttagagcattggctaaatttgttgtaatatggaattaataactgcacattgcaccaataaaatcctatgtattttaaagaatgtatgaaaactgttctcaagtcatgaaaacttttaatattcttttccttttcttgattacccatgttggatatcacatattaagctttatttaataactggatataaaagagcaataataatggccaacatttaatgaacacttactatttggtggccattgaacaacttttcttaacatatgaggaaggtactgttattattactgcatttttttttttttttgagacagagtctcactctgtcacccaggctggagtgcagtggtgtgatcttggctcactgcaacctctgcctcccgggttcaagcaattcttctgcctcagcctcctgagtagctgggactataggcatgcgccactacacccggctaatttttgtatgtttagtaaagatggggtttcaccatattggtcaggctggtcttgaactcctgacctcgtgatctgcccgcctcagcctcccaaagtgctgggattacaggtgtaagccaccacgcctggcctattactccattttatagatgatgaaacagaggtttaatcaggttaagtaactttggttacttggccagaaactggtagagccaggatttaaaccagggtcatctgatttctgactgtgtactcttaaaggctaaacccaattaattcttgattatatactaggtttaaaattaagccagtttgaagataaatgaattggtattctttggtatcttttcagcagaatttaaaagtgcgaacttagatgttagggcattcaagtgattgctcagaaatttcaaaccctcagtgccttgggagaaaagccaatttgtagaagagaaagctgacattaacaactaagaggagaaagcaagatcattgtatatgaaatgtgtgaggagtggtagggcaaagcttacttattgagggtctccagctgagatgttaaagtgtgtgtacatgaggtcaggctcttctggtgttcccaaagcagaaatggtgatcatttctctctctgactagctgccattattatgggttttggtatcaccacatacagaaatattgcaaaagatttcttgcatactaacacattgatatgtatttttaaagccttgatagtgtttaaaatacactattactagcactgttacctaaatgcactattactagcactattacttagcacctacttggatgctttgaatagtttgctatgctcaatattccaaaggtgagagaaggggaaattttttcagtctttgccattagtgctctgtctagttgatttttttttttgccaagtattacttcttatttcatgataaaatgattcaagacaaataataccatatacatttagaaaatgggcctctttattattccttaacatgaagaggttccaataatggtagtttcaggccttggggaagggtaatcaggaagcgatttttggcaccaggttttatgtctgtcctatcactcttctcaggggtctgccctcatattaatacttgtgctaaccagaatgaagtagtgatacagcaagcagaatataatgattagagttgttataagcacacaactcaatttgcagtgagtaacatgggccaacactgttggaaaataaggatttccatgagccacttctatctcacattgatttggggggatacaatcattatatatacattagaaaaacatcacttctaaatgacagtgatcatatcagatcatgtagtttgatcatttggagagttcagtgatgtgcctcttttggtagcaattttgcttcagttttcaatttgtgcttgccggcttgcagcacaaactatataatgagaaactgaagtgataagaaccatactgtgtagcatgggtgattgatagtacctttccttgtgttattttcttgaggaaaagatatcctagacaaggagtactgaaaaaatcacccagggactctcttcttctcatgaaacagttttttagtgtgagttgacatcactaaatttgatggacagtagaatttgaattgtttattattttttgactgctctaacttgatgttagaccattctgagggtcttttgctggatttacttagtacttatttttacttttgccttagcaagttgttacagttttatttaggtaaaaactcaagttactatcttgaagttgcctagatgtcagtctgatttggatgttttattctcttatgtgaattagtacgtttatgaacttttacagcaaaataaagaattttagatgttataataatttctcttagaggatatcattcctccctttcctgaaaatgggaatagattagtgggatgacccatattctgcataacattttaaaagctaccctgtgagcttactcacttgtcctttttgtgttttcttttaaggcagtagaaggataactctctttttccataggaaaacaggtattacttacttatacaaaagtactttcattattctctgttaatgatttcatgtgacaattgatagaaagctattggcattttcaggtgaataatttggggagtggataactggaagcttctatctgactctcagcctttgaactgaaacttgtaatcaggacagaattttcagcatcttttcattgctggcttctgttggcacccagtggggagaggcggcatcatggtttaagtattaaatgtggatgtagtactattacgtttttagcattgtattttaagaaatacttttaaaatatgagcaatgaaaacatatattgttgtctgtaatgtgttctcataagttgattgattctagatgttttggagctcattaaaaaaaattccagtttgaagtaattgtagatgcacaggaaattgcaataatagtatagagatgctctatgtgtgcttccccatttccccctatggtaacatcttacataaccatagtacagtatcacagctaggaaactggcattggtacaatttgcagacctctattgcagctctttttgaatccttttataaatcacagtatacttctataatataaacatttaatttattggtttaagaaatttggatatgtagcctggctgctaattagaagagattgggtattttaaccatatcctatccagttaccaggttattgccccttggctccaaatctgtcctcttagctgatctgcattaatggagctttaaacatttcttctttgcagcaagcacaatattaaattatgccagtagagggtgttgcagggacactgcaggaagatggggtttcttttgtttctgatgtgttacatttattgttttcttgctcttgcttattgtaagatccagggacatccagtgatgctgtgcttttgctgatgtttggttcaacccagctgtgcactcacatgcagtccctccgtgagctcatagctttggttctgtctcagtgaggccctcctacagccttcctgacacagacactgtgtgccccaggcctcgtaccaccctgccagtgagctgactctggaagccctgatttcctttgcccacctgcctgccagcctttgctggctgcagcccagagggtttcctgcgtgcctgtggtctagctttgcctgggcagtccaacaaacttctttgctattcattgggctgtaatcctgccttctccagtgaggtctgaataccacctttggtgaaaggacccaacttccacgttagttcttcttgtggtactctcccttagctttagggttaaattctctttgtagttactctactatgacagttaataattctttatagtaaattttccctgtttaaattactgtgttttctgtcctaatcaaatgctgacttacagtatctaattgaattaatatctaatgatattaagcagtccataaagtttctgatatttttccaggaaaaacaaaacaaaaaagtggttattttagataatctttttactgtcacagtaatggcaaggaaaaaacaactattatttctaccgtatgtttatttccattccacgcacagcctttttcttactaaagcaagaaaccctgcaaagtagattatcttttatttacttttttttttttaacggggagtagggagctaaagcattttattttgccttgctatgagatctagcttataattggcaacacaagtatttgaatcaagaccatcttgctattcttcctaaagccttttcatttgactcttctgtatgactttctttcttttttggggggccgggggatgtttacaggggtcagtattaagtacctataaataggatatgattattttatttctttagtaaatattgtttagttactaatattttatccgtatttgtaatagtagcatagttgttttattcccttttcaagatctttggatcatttgaagggaagagggaggaagacttaaaaatgttattttttttttagtaggactttaagcaattaattaaaagttaaatatgtcttataggtgaaattttgtatttgtgctttaaatatttgatttttaaaattttcagcatattttaataaatttactcattctttttatttccctggtattttttaaattttgaagttttatatatttaggtgaattatttcattattccactgtactacaagaaacttaattcttttataatatgaaatgtccctgcttttaaggctaattttctacttgtatactctattttattccattttgacatctcaaagacattgtttaagcagtctttcttctaccacacttgcttgttagattagcccatccagtctcatgactttaaatatatctatgactggatgattccaaatgtttttctctgacctgaggtctccaaacttatatattcaacaacttcagatcttcatctggcatctcaaagttaatatgttcaaaaatcaaactaaaaaatcaagtttgacactgtcccaaacttgttcctcctgtaatttctcacagtctttttaatttgtaacttgatctttccaattattgtagatgaaaaacttggcattttcaactccattttctctcactctacatctaattcttcattaaatcatattagttctacttccaactatgtaaagaaagaaaaaccctagaggaaagggattaaagaaaaaatacgaatagaaatgggaaaaaatatagactgtagataaaagaaaaaaattagaaaaaaaaacaaaagaaatgacaatcgagagaaaaagaaataggaactccaagtctaatcactagttttcttattttatcaaaagttaatgtaggtacttttgctataaattttctcataaaattgaattcatcattttttgcccatgttttgttcaaccctatctacatgtgttttatgagtgataatcaggaatcagtagcctgcaaaatgagcctttatgaaggagaaaaatggacttttgttaatcagctgtagctgtacaggggaagatattccttttctttatgcttttagatgtttttgaattgtgtttacaaatacattcaattgtaaaaatacttgtaaattagcacccgtttattttgatgcatatagctagtatctgcaaaagcccaaataatgtatcactatctgaatgtcctgtattagtcttactgaatggaaaagcaaaataattgattttaaatgttttaagcagggattaaaccatgtcagactttgaaatttattggttttcttgttataatcatttttaatatattttaaaatctgactgtagctaagttctcattttgtatttgaagggagttagtaaaagtactcatatttggtgggaggatggcttgaatcaggaagtggaggttgcagagctgagattgtgccactgcactccagcctgggtgacagagctggagcctgtcttgaaaaaaaaaaaaaaaaaagtgaagaaggaaagcactcatatttgagttattctgcattttaaattttgaccctttattaatgtgagaattaatgggaacattattgctaaggatggtatggagggtttttttgtttttatttttgaaatttattcaatgaaaaattttaagaacattgacctaaaaatattcttctttctgtatgttattttctctgtactggtatttttttttgtttttgaaatttgttggttgaaaatttaaaaaaagtggacctaagatattcttcttttatagcctatctgcatgttaaattctctgtactggtagcagctctatggcagtcctaagatctatttaggttatttttttcttggtgatttttcctagtgttctaggaaatctaagatagatagttagttacatagacagatagatagataaaacgatttcctacctgatgaatgaaaagagtaaccaatttttaaatctggagagactccttcttcctattactgatatcactgaagttactagagtgaaatttttaggataaatagctatagagtaccctcatctgggtttgaatcttggctttacagtgatcttggtcaagttatttaacttctctgtgcttcagtttgcaatttgtaaattgtgaataaaacttacctcttaagattgtggggagaagattagctagtaactgtaaagtgttcacaataatgcttaataaatgcatgctattattactattagtggtactattacaacaaccacagttaagattttaagactattggtcttttttgagtgataatcagaagtaagtaacctgcaaaatctgagtagactgctaccactggaaggcaaaatcttggctagagttctttagaacctatgtgtgtatatacaggcagtccttgctttgtagttatggtatacattattttctcttaccgtggttcagttacaacactagtctcccaaacacatggttcaaatttctgttaccatagtatattaacagagtaattgcaaaacaaactctgctgttcagtccacaagtcactatatacatacatgattagtgaccaatcatgtcgcttcttccaaagtctgttggtgattggtcactgtgtatctgttattcactttacttacagatagcaaagtatgtggttgtgttgcctctttgtctctggtaataaatccatttgacattttacaaaaatggataatccaaagaggaaattggccaacaaagctaacagtgctacaaagaaatgaaaagtcataatgctgaaagtgaaattgcatgtaattttagaagatgcacagtcttagaagattttaaaatggcaacagcaaaatgaagacagaatgagacctaggcctgtataaagttgtgatatgaaccatattgaaaaagtatgataaatttaaaaaaatgataaaatcactccaacatcctttagtttaagtttcactaggaacagaaagctgcttatggtttaactggagcatatacttctgctttggattaagactgtaataaacaaaaattccaatcagttttgctagcatgtcagccaaaatactgaagttagatgccacatcaaaaggaaatagtaattataaggagactggagattatgcaatttctttatctcaattttgggagaaatatgacataaagcatgcagttgaagacatcatttcagggagcaacaatgaatattatgtctgtagtatagcaaacttttacttcgctatagaagtaactttgaaggatatgaataggacacttatggagatgtagaataaatagctgtctgtgggagtgttgacactgttgctattcagtggactctagatatgcagccagatgaactttgtgaagatgaacttatcagtgtaaataaggaaagtggttgtgatgaaaagcatgaatgttccaggggaaatgactctggcaaatttttcacattaaaggaactcttggagatacttcacaacattgaacatgcaaaggataaagtttggaagttaatccaaacttagaaaggaatatgacagtttgccaagatagaaaaaatactttgtattgtaaattatatgagaaggcagcaagcactgttcaatatattcttgataagtttttttaaataattaaaatactttaatttttgtgcttcaaacaacgaagtgctaaataaacaatagttttactttttaacaattgtcctatatatttataactgaaagtaagagagtttttgaagtttggacaaaaatttttaaaggttactgaagaatcataatttttccttttgaaaaatatcattttatatgcagttttgcttatatggttatttttgtggttccacaccactgtacatagtgacaaatgcctgtgtatctttctctacttcagtctttttagtaagggaaataacagtctcattgacacaatagaagatttgcccaattatctttttgctttagcccctttggggagactgactgagattccaacttttatgaaattatttagttttagtgttttgcataaagttttgaaaaactgtgattgcattatagattttcttatttgcagttctgtttttccctttctattatgctgtcactttttcatttttttttttttttgagacggagtcttgctctgttgcccaggctggagtgcactggtgcaatctcggctcactgtaagctctgcctcccgggttcacgccattctcctgcctcagcctcctcggtagctgggattacaggtgcccgccactacgcccggctaattttttttgtattttttagtagagacggaggtttcaccatgttagccaggatggtctcgatctcctgaccttgtgatctgcccacctcggcctcccaaagtgttgggattacaagcgtgagccactgcgcccagccactttttcatttttaataataaaagtttagtacagcaagagagcgtgttcttttcctctctctccttccctaccttccatttttatcttcatggagatatatgtaattcctaatgatttgatagactaaaggtaaaagtttttaaaaaattagtttcatattgcaggacattaatacaacatctgtttttctcactttttcctgcagttaagtctaaagccgtattagtgatacagagtttttggtatttgttctagaggttaacttggtgttaaaagctgcttaaagttctattttgagtaaacactaagtattactatgaaagggagagctttctcttcttaatggtaatggtaattataataatttataattatcaactgttttatagtttacagtgccctttcatcatgagttttttcttttctttttcttttttttctgagacggagtcttgctctgttgcccacgctggagtgcagtggcgcagtctcggctcacacaagcttcggctcacacaagctctgcctccccggttcacgccattctctcgtctaagcctcccgagtagctgggactacatgcgcccgccaccaggcccggctaatttttttgtatttttagtagagacggggtttcatcttgttagccaggatggtctcaatctcccgacctcgtgatccgcccacctcggcctcccaaagtgctgggatttacaggcgtgagccactgcgccaccgcgcccggccaggagttttttcatgtcgagtttacgttgacgtaatgaacatgaaagcaagtatttgtacttcagaaatgtggaaagtgagactttgaggtttgtgatttgcccagggtctctcagggagcttatagtcttttactgacagtccttggcaggctgtaatgtaaaagaccatatagttttgtagtgatagacatgggcatgaatcccggtcgtgtaacttagtagctatgtggctttgggcaaaaccattgtttttgaaaatcagttttatcgtttgttgtatgaaggttgctttgaaatttaaatgtaacagtatagtagagcctggcttaaagttaagacattcaataaacaatatctattattatgataataattgatataatagcatcatcagctcattctcaggaggttgatttcaatttttcagtgaagtcagctattcactatattataaattatgttggatgtctcttctatactttgttgatattatgtacttacaggtattttagaacgaatgatatcagattctaattgcctgtttacttattttcccccccactatactgtaaactccttgagaaaataggtgggatagcaatttgctttttaccttatctatagagttaataagagactgttgaatgctttgaactccccagtgaaacactgaatactcctattaggtgttaatgttactaataatatctatctaatttctgacacattattcctaatagatcttgctggcctccataggaatcctggtgtgctttaatgaagtgtaattttgaaaatgactaatacagcttgacagaaaataattatgtaatttaagtgcttaaagttcatgtattatacctttcctgtttgctagaagagggagcagagtcccagggggttaggtgctttctctaaggtcatgctggttggtggcagggctttttttttttttccaggccaggaaaagattagtgcattaaagattatcaaaataaggtgatgagtattgctacttaagaaaaatccaaacctctaaggctccttttgcagtacaatgtaatatagaaatattatgctgagaaaatgtgaaatttcatctattttatcattcacctggaagtgcttgagaaacaaatgacattaaactttaacttttattatagccatcagagattacaaaaggtaggagggtgggagagcggggtgaaggttgaaagattacctattggttacaatgttcagtctttggttgatgggtactctaaaagcccagacagactttatctctacataatgcatacatgtaagaaatctgcacttgtaatccttatgcctataaaaataaaaattaaaaaaaatctttttctgccttaaaaaataaaaaaatcctttaaattttcaaaaagaacaaaaagaaagagagtatactttccaaactgttagcattatttcctaaggaggctgacagaagggagaaattattttttctttacatactttggtatttgttaacttattatggtgactatataatgggtttgtaatttaaaccctataatatagaacattgttcttaaaacaaaaaaccattagagatgcaagctgaagcaaagtatgtagggatgtgtgagataaatctgttctcattgacctaattttttagagagtcaaattttatttctaaaaaagaattaaatcttttattcttccttagcaagaatttagggcagtagtataagaaatagtacagtgaattgcatgattgattattatttaatttgtgtagacagtgtttattacaagaattcataggagagagatcatagcagtatataggtgaaattatgaatactagagtataattatttctcttgtagattatattttgttctctgtatttgaaaagttatcctcagagcttaccaactttagctttgctatgtacgtgatcatttttgggtgccagaaggaagccttgaacaagtgatcctcaagaacttataggaagtatacatttactccttactaagcttacatttggacaggaccagtgatcttgctcatgtcagcattagccatgatactaggagagtaaacctttgaaaaacaacaaggatgagaataacggttgagtggttagctgccactattttgaaattgaaaaaatcttatgtttaatatagttatattctttaccctttctataaattgttacatagcatatcttgaagttttgggaaactacaataaaaacattcttgtgtgtgggtatgtgttgttggcagagggaccctgtggacagattacattgcttctcaagttacgagacctataatatagcagtatgaatttgggtaaattgcttaacttctctggactttactttgcttacatgtaaagtggagttaataatagcctaacaaacataaaaatcttcgagttagctgaattttagagcttatgcaaatcctttacaaataaagtggcagtgttgatgggattcctaaagcttctctggcatcaggaagcacagaacaatattaaatagttaacagtaaattaataatatgttggatataatatcttcactaatagcccatttagtaataaagtttgcataactttttttttttaaaactgaggatatagtattaacatgctacttagtgaacatgactgtggagggccagggtaacaacagtttgctttctttttaatctggtttgatgcaaagagagcatagtgtcatcttcttatttttaaaaacctcgtttttggtttaactgggttaatggattttgacctatatgtttggaataagtctaaggcaaataaaatctcttatctccctagaaactaatttgtatctcagtaccatattttctttcaattaacaacttatggccacttttatggtagtttcttattggtaatattttacatgcaaataaagatctggaaatttagatgacttatttctgtgtgattttattatctatcttcataaatacttatttctggtgtttttagaaaaaaaactaaagcttataaatacagagctcagattgtatagttattgtaaaaaggctttatgctcactgggcttctatatattcttgataccttatttctcctttttttcccccaatattttcagatgttttggaatgttattaagcccaggtcgaaacgtgaagaacagtgacatgcatttactggatatggtaatgataatcttaagcaccttaaccaagtatagatgatagttattttatatttgacaagtattttctatttacaaattttgtcatattgtcaaaattatttcttgcagctgtgtgatagtaataattaaatttggaaacgcaaacttaaaattacttgtgaaagaggaattcaggacaatttccaccaaaacagtcatatgcaacaaataaaaggattgtgttatgataatgtccatttatttttttggcttcttagaaagatatcttttctttgaacctgtagtaacaagtacatgattataacaagcatctccagagtgaatatggtgcctttcatttattttaatgcactgctattaatttgagtttgtgatgggtacttttgttttctttaaagcgtttccctttctgaatttcttcttgattacctgtccttagcaaagtacacttatactaggagtaatatttatttaaggaatgtccttaaaggttaatatatattcaacagttgatatttagtgtaaaagtagcaagctattttaactttcaaatagaaataccttctaatattgcagttagtgaaaacatttaatttgtgatttggagacgttataggaaaataatcatcttagagtaagtataaagtttcttagtgaactgaaattcttatatttagtgataataagcactatatgctttcttctttttagctgtgttttgcaaatatcagttaaacattactaattaggtcaacttttttttgagtaatttcatggtaatatcaatactgattttatagcagtacaggaatggtttattcaggcttttgggtacctgtttgtctgctaagtgttgtgtgaagtgatgaggttatgcatatgagtaaaatatagctcttaccatctgtgggttcatggtcttgtgggaaacaaactttttagtatctggtggtacttcaagccacagaaatatagaggaagcactgcctgaataggtcaggtaaggaaaaccagttaaattgattattaaaacataaattagctattgatctatgtctcttacatcttttttttttttcttgaccacatatcagtaatgaaagtggttttacctaaggcaagccattagcattttggagccctgaaaattccatgaggaagtaaattaggaggattgaggtaatgaaaacttttaagatcctaggtcctaattaatcatggtctttcagagtttaaaagactaagatgaattactgcagagatttgtccataaaacctaaattcagattacagaattatagaactggtataaacttctgaggccccttcactatgtctctctaactttcagaacagtcctccccacctttgagtccatatctaaatcaaaagagttgtgagcattcatgctctcagacagagaaggggcttacttgcaacaaatagttgggcaaatgagaggcttgtatttgcaatgattagcagttgtgatttgttattacccagtgttgttaatcttcatagtggacattgaacctcagctagactacttctaatgaagagaaactcattaccttatgttaaagtctaagggacagttctggttattacaaagttatttttttataatcacctgaaatcatagttcttgtaacttggcctaattagtcttaattctgcactctagaacaagatattaatacttttactccttctatgacactcccaaatatcatgtgatcctcatgacaggaaagtcctatttataaatgaagatatatttttcagtgaaatagccagattacttatatataacagtcatatgctgagtaagaaaatttccgtgaatgatggacccatactttaaggtcgtcccgtaagattataatgtatttttactgtaccttttctgtgtttaggtacacaaatggtattgttatagttgctatagtatttggtacagtaacgtgctgtacaagtttgtagccttggagcaacagcctagttgtgtagcccctataccatctaggtttttataagtacggtgtattctatttgcataaagaaatcacttaatgacacataacttagaacataaccctatcattaagcaacaggtgactctgtgtgtgtgtgtgtgtgtgtgtgtgtgtgtgtagaggagagaaagagaccattatcatatgagtgtgttggggctgctgagagggtttcgtttacaagtgaccttgagtgtatttcatctctggaatgcatggtccctgcgctcaagctacacaatctgattagtgaagtattactaatacactagaaaaatatacatagtaattaccaaatgactgacacaattttatagggggttcagagaaacatctgtgaatgggtaataatgaaaaaagaaaagtttttctctttgttttagtctgacccttttaacagtctctattcataatgtgaggaaatcgctacaaaaactgaaatattgtagatactgttcatttgcatatggaaatacttgtatgctgtgtgttgttctttcatgggacaaactctacccctcctctctccacacacatatacacaagctataagtagcctagctttcgccataggagttgctggcttttttagtgagagtcaagagctggcttggtaaagtcttaaagaatggagaagaggaggaaggagagaagggaagaaagagggagtaagtgtaacagtagagggagagagttaatacacttggatgctgcttacaaaccaaaaattagtctcctaatactaatttatgattgtaagaaagtatataaatatctgacatatagaaaatagacaagtgttaattttaaaggtattaattgctacaaactaaattaatattttaagaattcattaaaaattagaatattagaagaaaaatattaactttccctactgtgattagctactagttcagtttaactgtcttcagctaattctatattattgttttaatagaaaccatatacattcttatgtgtatatgagatttggacaattggtgtcaagatcaagttaaatacaactttgtaacaatattatgtttttttgattcagcatgtaagtatatgcctccttttatccaagggtacatgtctttaaatagaaactgtgcttgaagaaagctgtagaagaatttaatatttaaataaatgcttttgtaggatgaaaagaatttacagtgaatataaagctcctgcttgactgttaatctaaattttaataatttgtattgcttaaagtaagatgtaatttaaagtagtgatttttttgatgtcttttatcagtaattactgtttgaatttttataggaatccatgggaaagagctatgatgggagagcttatgtcatcactggcatgtggaaccccaatgcaccagtatttctggcacttaacgaggaaaccccaaaaggtgacttttcttaaaagatcccttattgtttgctttacattttatattatgaacaatgttgcttgtcatgttttaaaaaaaatttggaactcaaagtggacttattctttcattgagaatttgaggttcatttttattctttatgcttctatgggggaaatctccactatttaaaaaaatcctccccaaaagatatgtgaattattattattgttattattttaagagacagggtctcactctgttgcccagggtagagtataggggcattatagctcactgtaacctcaaactgtcatgctcaagcaatcctcccacctcagcctcctgagtagctattaaatagaactacaggtgtgtgctgccatgcatggctaatttttaaattttatttttgtagcgatggggtcatgctttgttgcccaggcttgtcttgaacctttgacctcaactgatcttcttgccttccaaagcactgggattacagatgtgagccactgcacctggcctgaattaattttattagattatagagaaagcatttgggctttgtttttcatataccactatagagttatttcatttgtggagactagtgatggagaaatattaaagaaaatgatgaaaaggaaatattttagaattttgaatatttttaaattattaactatttttgcattatagtttacttatagtttttcatttattaattattggctccagtcttttggccttcgggatgcttgtaatatatattaaatatttcagttgtagcaaatagttttttcttagttttttaacttttcatattatttatcatgtctagtattgaacagaatgtataaatgttgaatagtcacatttttcgttgttccattgtgttttttcattcctacttcatccagatagctgttaattgcctgttttttgccccttcattatctacttttaaactaaatttaaagttttacctgccgagttatatgcctaccctaagtgctttactgtcattaaaccattaattcatatttagaatataatggatcagtttgttttatcattaatttttatattatttagtttatacccacagtagacttttggttactgacaggaagcattcgtgaatactgatatgaaaatataatatgttaatgaagggcattaaaatgataattattctttcatttccttaaagagagtattcaccatttatataaatcacatacattgatcacatattaagctgtctaaaaataaaggctaaacagaaaaaaagattatataaaatttaacttttcatttattagcagtaaataatttttagacccacaatttgttatttctggagacaggcttgcaaatacctgtaacttctttcttatacttgttcagaaggaagccacaaaaatgataaaaataagccagttgacagttttgaagaacaaaatataagaattttgcatatcaagttataaaaatagtttttatgtttttaatgtaacacctagtttagttttattttgcaataaaatatatatttggtccacaaaagaaaatttatttataatttattctattaaactatataatagtatattataatattctgattcaaagtatacattttaaatttaacattatctcatatgccacacaaaaatgttgccctgatttttaaaatttctaaattatgtccttgaaattacacattactcagagaatgtgtgatcaaataaagtttgatttttatggaagaagtttagaacctgagagatgaaaagtcttggatctttccactgcactaagatccagttgaatgttatattctgtcttgtgttattactccttactcctttctctaaggtcctccaggtcaagtataatgtctaacaaattttagtttctcttgaattggcaggtgtatttagtaagactgtatttagtaagaatgtaataaaattgttattgaatttgagaagtagttgatgaatctgaatgttatataatatttaaaaacactattgagggtttcttctagtggtggccttggttatttggactttcctttaacagagaactaaaaattgtaaagaaaataaattttaaaaaatatttaaaaaggaatgaggaaattacaaaatggtatggaatgaccaggccatagattcaaaaacctcaatgaggccaggtgtggtggctcacgcttgtaatcccagcactttgggaggctgatgggggtggatcaccagaggtcaggagtttgagaccagcctggccaacatggtgaaaccccgtctgtagtaaaaatattttaaaaatcagctgggtgttgtggcgggcacctgtaatcccagctacttgggaggctgaggcaggagaattgcttgagccctggaggcggaggttgcagtgagccaagatcgctccattgtactccagcctgggtgagactctgtctcaaaacaacaaacacttaggattattagttcctaagaaacatgcttggagtacttgcatacttatttaatcaaaatgtgaatagaacagttaaaaataaacatagaaggtattacaattgtaaagaactttaattctttcataagtgaggaaactttgtttaaagtagacaaggaataataaagctcgcataaaacccagaaaatttctactacagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacaggtaggacctttttgttctcttcatatatagtaacaaacatttttctttccacacttcttttttaatgccaagataattcctgaagttgcaaaacaatacaattcctcaaagaaatcaaatgatatttgaagtcaaccaatagagtgtttgaaaaagtcacatctaggtaatattagctaaaaaaacccagcaagtttaataattacatactttttccctagaaacctgtaatgtatgaaccttcttaacagaaatattgactgcatataaaacaacgtttctgccttttataaacaattacttaaaaccaaaaaggcagtgcacagaaatatcatatgcttataaaattttaatgaaaatgtttctaagaaatacctaatttctatagttatttctgcctgtaatattagatagacaatattatatgaacatcttgtttgactcatcagtgaggttataaaattattttaatattaaatgaacaaaattatggtttctatgatatcctcaaattaggcagtattagtagataaaatatgtaacttttgtattatagcaaaggaagcagataataatgaaaaataacttgaatgctaattgtgtgagtttttaaaaaatcaggataaaaatgctctattagaataatgaacatcttttatatgctgtttttgttagtactttcattctcccaagttttaaaatgcttgctgcttcatatactataatatgtggactgctgtgtgataaaagcaggcaccagtacaggaaacaaatatagaagcctcttacccattttcatattaaaaaaactgccatggcgcatctcggctttatatactatgtacttggaaattattgtggttttaaaaaaatctttcataaaattattatggctgttatttgactcagtttttattactgtgtgaactgcttttatagcatattctaatgaaggttatgtgagcaatattcaaacttcagtctcctgagcatcttttaatattttattatgagacttttttcctgtcttccttcctccccatccttcttttttaaaaaaatagcttagttatgactatccaataattcttcattttgagccaaagaattattcatagttgcataatcgtgaataaaggagctggagctgtatagaaagttgtcattcttctaatgatgataaattataatgtaaattatacctcctagagatctgagaaaatgttaggtttttcccagttctagtacttttgactgtctgtctgcctggagagagagagagagagagagagagagagagagagagagagagacattaaagtaattgttaaaattcatgtaagtaattattgcaagacctgagactataactccttaccttaagccagaatatgctgctgtaaggccagactagcttctttctacacctccaaaaggtgggttggtttggggtggttgatggtaatctggagatgttggtctacactatacaacattggtagaaagaatgaattaggtgattacctaatgcaattcaaagtaacctttgaaaatctgggtccaggccattactactttaaagaaataaagagagaatgcattgatttcagttctaagtgatttagacacctagaactttttctttcattctgagagtgttgaacttattgaatgaaaccagaacttgtcctgtacccagacaggattagaccagactcctgggggcaacaccaaagtacatgagatgccctgttcccaaactattttttcttggcaactttcttctctcaaatatagcagaactttatgtgtgggcagtggggatgtatgaaagtctgctttgttcctgtttactgtccactcagggccaaatggcatttcatttcattcattgtccatttactgggagcaaggagagcacttaacaagaggatggaaactagagtctgggaaagtaaactagaggctgggaaagtaaactagagaaagtccttttgtgtccggaattggttcctttcagtgggttcttggtcttgctgacttcaagaatgaagccgcggacccttgcggtgagtgttacagttcttaaagatggtgtgtccagagtttgttccttcagatgtacagatgtgtctggagtttcttccttctggtgggttaatggtctcactgacttcaagagtgaagccgcagacctttgcagtgagtgttacagctcttaaaggtggcgtgtctggagttgtttgatcctcccggtgggttcgtgatcttgctggcttcaggagtgaagctgcagaccttcgcggtgagtgttacagctcataaaggtagtgcggacccaaagagtgagcaacagcaagatttactgtgaagagcaaaagaacaaagcttccacagagtggaagaggacccgagcgggttgctgctgctggcttaggtggccagcttttattcccttatttggcccagcctgcgccctgctgattggtccattttacagagcactgattggtccattttacagagcgctgattggtccattttacagagtgctgattggcctgtttttacagagtgctgtttggtgtgtttacaaaccattagctagacacagagcactgactggtgcgtttttacagagtgctgattggtgtgtttacaaacctttagctagacagagtgctgattggtgcgtttacgctcctttagctggacagaaaagttctccaagtcccacccgacccagaagcccagccggattcgcctctcaccttgacctgagtctaaggggagtagacattaattaggtgtaagtgggaaacaccaagtataaatgcccagagaactagaaagactgggaagcacagtagctgatgatgaaaggcaagtaggcccctggccatgtgaaactttggagtccacgttcagagttcttttctaaatcaactttattgaggtagttagcatacagtaatatgcacccatttaatagtacattttgatgagttttgacaaatttatacacatgaataattaccaccaaaattaagatccctcactcttaaaagttctatagtgtccatgccagctaatctttctcaccttcagcctcaggcaatgactgatgtgctgtcattacagtaactggaatcatatgcttcttttatgtaaaagctttcttcatgtaacaatgcctttgagatccatccatgttgtatgtcagttgttaatctttttattgttgaatgttattcctttgtatagctgtaccataatttattagatcatatgttggcaatttgagttgtttccatttttggttcatgtggttaattaaagctgctgtatctttctgtggacatagattttcatttcttttgggttgataccaagaaatggaattgctgtgtggtatggtaagtagaaactgccaaactgttttctacagtgcttgaccactttattttccctccagcagtatatgtgtgtcccaatttctcctcatccttgccagcacttagtatcgtcagtcttttaaattgtagctattcttaggggtgtgtagatgtatctcattgcaatgtcaatttacatttcacattgagtaatgattttgagcatttttttcttatggttattaatcattcatatatcttctttataaaatgtctaaaatttttgtccactttttgtttgtcttactgagttgcaagagttgtttatattttctgaatatattttcttttgtcagatacacatatttcaaatagtttcttcctgacagtggcttgcctttttattttcataatgtctcttgaagaactgaagttttacatttcgatgaagtcatattaatattttattttattgtttttgctttttttgtgtcctatctaaggaaattttgcctacctcaaggttgtgaagatgttctttatgttttcctgtaaagactttatagtttcaggcctattacctattttctgttaatttgtatgtatggcatgaaggcttgaggtcatcttcccacacctctctcatgtgggtatacagttgttccagcatcatttgttgaaaagactcttttatctatagaattagtttgtctaaaattaattgactgtagatgtataagtctgtttctgggacactatttctcttccattgaactctatgtgagtaccacacagtcttgctcattataactttatattatgtattaaagtctgtgttgtaagcttcccaacctttctcattcttagttttatttgttgcgagttctttgcatttccatctgaattttaggattagtttgtcagtttgtagaaaaatgcatgcccaggctggacgcagtggctcacactggtagtcccagtactttgggaggttgaggcaggaggatcacttgaggccaggagtttgagaccagcctaggcaacatagcaagactcagtttgtaaaaaaaagtaaaataaaattacccaagcgtggtggtgtgcacctgtggtcccagcttctcaggaggctgaggtgggaggattgcttgagcccaggaggttgaggcttcagtgagccgtgatcatgccacttgcactccagcctgggccacagagtgacaccccatctctaaaaaataataataaaaaaaagaaaaatgcattcccagattttgactgagaatgcctgaatatgtaaatgattttgggaagagttgctgttttttttgtttgtttgtttgtttttttgagacggagtctcaacttgttgcccaggctggagtgcagtggcaccatcccagctcactgcaacctctgcctcccaggttccagtgattctcctgcctcagcctcccgagtagctgggactacaggtacccaccaccacgcctgtctaatttttgtatttttagtagagacgaggttttggcatgttggccaagctggtcttgaattcctgacctcaagtgatccaccctcctcggcctcccaaagtgttgggattataggcgtgagccactgcacctgtcctttaggagttgctgtcttaagagtgagtcttcaataaacatggcctgtctcatggagtatcacttcatttatttagctcttctttaatttatctcagcagttatgtcacttttagtatacaggttttacacatactttaatttatctctacctagttcatgaatttttcatctcagggtataattgaaaaaacggaatagacttaaggtgtacaatgtgatgatttgatacatatatattgtgaaatgattaccgaaatcaagttagttaacacatctgtcacctcacgtaagttacctttttgtgtgtgtgtagaacacttaagatctactactgtcttagcaaatttcaagtacacaatacaatattgttaactatagtcaccatggaacatattcatcttataactgaaagtttttaccctttgatcagcatctcactttttcccccaaaccccatctcctggcaaccaccattctactctgtttctatgagtttaacttttttagactagttaaaaatgagatcatacagtatttgtctttctagtctagctttttttacttagcataatgctctccacctttacccatgttactgcaaatggcagaattttcttcttctttatggctgagtcatattccattatgtgcaagtatgtgtgtatatattcattcattcattgacagacatgtttccatgtctagtgaataatgttgcaatgaacatggagtgcagatatgtcaagatactgattttgtttccttcagatatatacccagcagtgtgatagctagatcatgtggtagctctatttttaattttttgagtactctttgtactgtttttcatactggctataccagtttacattcctaccatcagtgtgcaagggttctgttctcaccaacatttgttatttcttgtcttttttttttttttttttttttttttgtgatggggtctcattatgttgcccaggctggtctccagcttttttttcccccaagattgctatggatattcgggttctatatgaattttaggattgtgaaaaatgccattgggatttcgatagggatcacattgaatctatagatttctttggatagtatggacatttcaacaatatttttccaatccatgaacatgagataactttccatctatttgtgtcattttcagtttccttcatcaatgtcttacagttttgttttttgttgttttgtgatggagtgttgctcttgttgcccaggctggagtgcagtggtatgatcttggctcactgcaacctctgcctcccgggttcaagctattctcctgcttcagcctcctgagtagctgggattacaggtgcttgccaccacgcccggctaatttttgtacttttagtagagatggggttttgccatgttggccaggctggtctcgaactcctgacttcaggtgatctgcctgccttggcctcccaaagtgctaggattaccggcatgagccaccatgcccagccaatgtcttacagtttttagtgtatggatctttcactgccttggttaaatttatttgtaagggatttttttgtttggtatgctactgtaaatgggattttttttacatttatttttcagatagtttgtcgatttcgtatagaaatacaagcaaattttgaatgttaagtttgtaccctgtaactttactgaatttgttctaaccgtttttttttttttggtggagtcatcagaattttctatgtaataagatcatgccatctacaaacaatttaactttttcatttccaatttggatgccttatcttgcccagttgctcctgctaggactttcagtactatgttgaatagatgtggtgagagtgggcacccttgttactattcacctttgagaatgatgttagctgtgggcttgtcatatatggtctttcttattttttggggtacattccttctatacccaatttattgggcatttttatcatgaaaggatgttgaattttgtctttttctgaatctattgagaagatcatatgatttttatgttttattaatgtggtttatcacatttattgatttgtgtacggtgaatcatcttgcaccccagggatgaataccatttgatcatgtgtatgatctttttactctgctgttgatttcagcttgctagtgttttgttgagaacttttgcatctgtgttcatttggattactggcctatagttttcttgtgatgtcttcgtctggctttggtatcagggtaatgctggccccatgaaatgagtttgcaagtatttcctcctcctcaattttttttggaggaatttgtgaaggattggcattaaatgtttggtggaattcagtggtgaaaccatcaggtcctgggctttgctttgctgggagactttttattgctgattcagtcttattattctttattggtctgttcagattttctgtttcttcattattttatcttggtaggtcatatgtttccaggaatttatttattattctaggttatccattttgttgccatatagttgttcataatagtctcttatgatctgttgtatttctgtggtatcagttataatgcctcttctttcatttgtaattttatttatttgagtcctctctctttttttcttggctattctagttaaagttttgtttatctttccaaaaaaccaggttttagttttgtccatcttttctgttgttttactcttctctatttcatttatttctgctccagtctttactattttttccatatgctaatttgggtccagttttttttcccctagtttgctgagatgtaaagttaagttgtttgaggtcttttttttccccataatttagacatttatcaatataaactttcccacttagaacttcttttgctttatcccataagttttggtatgttgtatttccattttgttttgtcttagatgtattttaaatttccttttgacccattgattgctcaggaatgtgttctttagtttctatatatctgaattttccatttttccctctgtttttatttctagttttataccattgtggtcagaaaagatacatgatatgattttaattttcttgaatttaagactttttttgtgtgtcttaacatatttattctaaagaatgttctgtgtgtgtgtgacaagaatgtgtattttgctgctgttggataggatgttctttatatgtctattaggtccattttttctatagtgttgttcaaatctgttgattccttatgattttctgcctgcatgatctatctactgtcaagagtggcataataaagtcccctttattattatattgtcatttatttctccttgcagttctcttaatacttgttttataatgaggtaccctgatgttagatgtattactatttacaatagttaaatcttcttgatgaattgacccctctgtcattatataatgatcttctttgtctcttctgacagtttttgacttaaagtctactttgtctgatataaatatagccactctgttctcttttggttaacatttgcatggaatatctttttccatcccttcattttcagcctgtgtgttctcaaagctaaagtgagtctcttgtaggtagcatattcttggatcttaattttatatccattcagtcactctatatctttgtttttgttttgagaaggagtcttactttgttgcccagattggagtacactggtgacttgatcttggctcattgcaaccaccatctcctgggttcaagtgattctccaacctcagccccccgagtagctgggattacaggtgtgcaccaccacacttagctgatttttgcttttttattacagacagggtttcactgtgttggccagactggtcttgaactcctgacctcaagtaatctgcccgcctcagcctcccaaagtgctgagattacaggtgtgagccatagcacccagcctactctatatcttttgattgaataatccttttacatttaattattggtaggtaaggacttattattgtcattttattaatttttaaaatggtttgtagtcctttgttcctttctttctcttttgctgtctttctttataatttggtgactttttgtgatggcaggcttttatttctttctattaatcttttgtgtatctactgcaggattttgctttgtaattaccatgaggcttacataaaatataattattacatgttattttaagccagtaacaactcaactgtgtttgcatacaaaaattctacacttttactcccccatctctcatattttaggttattgatgttacagcttttaatattgtgtgcccattaaaattattttagctataattatttttaatatgtttgtttttaacttttatactagagttgaaagtgatatacataccaccacaagaatattagagaattctgattttgactatctatttgcttttaccagtgagttttatacatttatatgtttttacattgttaattagtatcctttcatttcaacttgaagaactttggcatttcttataaggcagatctttgtgatgatgaactcctttagtttttgtttgttggggaaagtctttctctctttcatttctgctgtacagctttgccaggtatagtattcttggttgaggatttcttttctctttcaatatattgaatatattattccactgtttcctctcctgcaaggtatctgctgaggaatccacttacagtcttacaagggctcttttgtatgtgacaaggtgcttttctcctgccattttcataattctctctttgtctttgacttttgacaatttaattatactatgtcctggtgtagacttttcagcctgtttggaaatctatgggtctcataactttgactgtcctcttcttttcctaaatttgggatcttttcagccattatttctttatatagatttttcagtctctttatctgtctcttttccttcggatacttctggaatgcttatgttgttttgctcgatggtgttccaggtatcctgtagactttcttcactctttgtttgtttgtttttgcttctctaactggataattttaagtgactcatctttgagttcactgattttttattcttctgcttggccaagtctgctgttgaagcatgctattaaatttttaaattcagtcattgtattcttcagctttatgattttttgtaaagagggtgcagggtctcactgtgtcacccagcctggaatgcagtggcacaatcatagttcactgtaacttcgaactccagggctcaagtgatgatcccaccttagcctcccaaatagctagaaaaacaggcatgggccaccacacccacctaattttttaaaaataacttttgtagagacagggtcttgctgttttgcttaggcttgtcttgaattcctggtctcaagagatcttctcgcctggcctcccaaagtggtaggattataggcataagccactgtgcctagctggattttaaaaatggtttttattactttgttgaacttattttgttaatgtattgtttttctgattagttgtctgtgttttcttgtagttcactgatttttaagagtattattctaaattctttgttagttacatatcttcatttgtttagggtcagttattacagctttattagtttccattagtggtatcatgtttccctgattctttgtgatcctcatatcattgtattagtgtctgcacaatttaggaagtgatcacctcttctagcctttacatgttcactttggcaaggaaagatctttactagtctgccaagcctgggcttctggttgggccagctggtagcatatgcaggtaagtgaggctggggtctctgatctggtggggctgctgccgttgctctaaggttgggtggagctctcttgttgggcaggccccctgactggtatctgaggtcaagtgggactgttggttgggctttgtaattgcctctggttgggtgaggctgcaggctgtgccccaaagttaggcggggttgctggctgggctctacagctggatggcattacagtcaggtagggatactgattggactccctgattggttggggctggaagctgtgccccactgtttgatgtagtcattggctaggctccctggttgggtgggattgcaggttatactctgggctgctggcttggttccctgcctgggcatggttgccatctgtgctttgcagctgggctggattgctgactgggaaacctagacacccagtactgccaaccatactccctggccagactgggtgccaggattgctttgcaggtgggaggagctgctgcctgggctccttgtcaggtgaagctgtcagcagggatgtgtggtgccattgccaagatacatgtgcttgttgcatgtggtctagtcctgacaattctcaatattctgtaggagaagagatataatttggccttttgggaagcatgctggaatattgggaaagctagatgttcaccttgtgctgctggtgaaaccatagactcagcaaatctctcttggcatgaggctgttttggcctggggtagtggcaacatcatcaaattgaaattgctccacttatacttccaatacaacttttctaagttttgtgcttctggaatttttgcaaagatgttcttgtatgtagatagttgctagttggtatttctgtgatggggactagagcttgggacctcctattctgccatcttgctgatgtcattcctcagaacacacatgtttttgatattactataaattgtattctttaaattttaattttttattgtttatttttagaatacataaagacttgatttttgtatattagccatatttcccgcaactttgctaaattaacttgttttctttttcttggttttttttttttttgagactgagtttcgctcctgttgcccaggctgaagtgcaatggcgagatctcggctcactgcagcctctgcctcctggtttcaagtgattctcctgcatcagcctcccgagtagctgggactacaagcatgtgccaccacacctggctaagttttaattttttgtagagatggctcttgctatgttgcccaggctggtcttgaactcttggactcaagcaagcctcccactgcagccttttaaaatgctgggattacaggcatgagccactgtgcccagctcttttagattcttaatgctttctctatatattatcatgttgtctgccaataaaggtagttttctatctgaatgcctataaattctttttcttctcttgcttagtttttttcttccccctgtgaacagtgttgaaactctatcaaatatttttctgcatctttgtggtttttccccctttttttcttatcaatatattgaattacattgattttttttaaacattaagccaaccttgcattccttaggaaaagtcacccttggtgatgatggtattctttttatatatcactttattgacccagtaatacattttaaaaataatttttatgtctatttttatgagacattggtttatagttttcttataatgtctttgttggattttagtgttcatgtagtatggtacctcaaaaaatgagttggaaattgtttcttcctatatttgctgggagaatttttataagatttgtattatttcttccttaattgttggatagagttcaccagtgaaaccatctgggcctatagtttactttatgggaagccttttaaatcacgaatttaatttctttagtaaatattggatttattccacttattattttttaaatttcttgaaatgttggtgatttgtctttcaaggaatgtttcaattttatttggtctattgcacaaaatattgacctattttttttaaacatctatagggtttgtaggatcttcctttattcctgacattggttaatttatttgttttctccctttgttttaatcagtctaggtagaagtctgtaacttattgacattttccctccaaagagccagatttcgggtggtttgattttcttatttttttttctgttttctcttcagtttattccctttgttgtttcattatttttcctgctttgggtttcacttgtgtttctttttctggcttcatgtgaagattagatcatttattattattattattattattattattattattattgacagggtcttgctctgtcacccaggctggagtgcagtggcacgaccatagttcactgtagtgttgaactcctgggctcaagcgagtctcccatctctgcctcctgagtagctaggactacaggtacatccatcatgcttggctttttatttttgtatggatggggtgttgctatgttgctcaggctggtctcaaattgctcaagcagttctcctgccttggcctcccaaagtgctaggattacaggtgtgggccattgcacctacctaatcttttttttttttttttttttttttttttactgcttttttcctaatacttttgtatttctaaggtttaaaccttccctctaaccactgctttagctgcattccatgaaccttaatatattgtgtgttcattttaattatatttgaaatattttctaatttcccttgttatttcttttgtgtcctatgggtcattcagaagcatattgtttgattttccaatatttttagattttccttttttttgctattgacttctgatttagtttcattttggtcacagagtatactctatatgatttgaattcttttaaactgttcagacttattttatgactcagcatatggtctactgtgaatttttcaagagtacttgtaagggatgtgtgctctgcagttgttgagtggagtatcctataaatgtccattatgtcaagttctataataagattttcctgtgatctttactcagtagatcaacaatttctatgactattactgtaagcaacagtagtaatagccactactaattattttttaattagtttactacataccataccctcttctaagcactttacatggattaatttgtgtaatcttcagtaatctctattgaggtgtaagtgccattattacctccattctctggatttgtacttaggcacaggtaggttattaggtggtggaccaggaattgaatctaagcagtttgaccctaaaacttacacataaaatgtttatggaaagtggaaaattatgataatctaacactaaaattaggatttttttttttcctgaaaactttttttcatgaacagtagttttttttggttatattcttcttcaatttggtttttccttacttgcaccatcttgatgctggtatcactatttaaattagttatatgaagagtttgtaaagaaaatctaaggacttgtaacattggaaacattgacagtgtacttgcccttactcctttaacaaaataggctcttggctggtaaaattcagtgatttatgatcctgatccatgaagagcactctgctcatatggggttatttgaaaactgtttgccaaaaagatttctgctctaaaagcctttctaaatgaatgaacatttggtattttcttgttacatgctaactccactggcttaaagctttactggttgttaaaatgtcaacatctccaggaaataggtcataataacttttactagttgtattgtccttattggtagtgactttaataagattctttcctttagtctaggttttattaggggtcaaggtaaagaaatgaagagggcatttctacttgaagtgtcactatattgagcaggaaaggccaaagtcctgtatcacttacaatttcactgagatgccggtattcattttagaaatgattttcaatgtttagtttagtttattaaacacttattgagtgcctacagtgtggtaggcattatgcattatgtgataggcattatgctatgttggggatatttgaatgagtattatctattctctgttctaaaacagtaaacaatatactggtaaaaatgttacaatactagatgataatggaacaatagaagtatatacatagttcagaagcagcactcactcatcacccttatcacccttattggagttcagttagacatcctaggtttgtatccagtttactctggtgtatgtttcacagctgtataaccttaggcaagatattagtagtctctgaaatggggattataattatgccaccccaaaagattgtcatagtgaataaatactaattcatttaagacccttagaacaatgcttgctacctgataaacaacaaatatgagttattattgttgttagtattattaattgactacctgtttgtcttctatctagtctgtattccttttgggcagagtcctttgtgtagtcagcctaacataaatgaattaatgaatcaatgaattgaagaactaattctggtggataggtcaggtgtttgaagtgtgacaaagcaaagaaggggatttcagtcagagacaatagttggttaacttcataaatctctgatccaacattgtatattcaggatttgtgggaaatcagatattgatggagcatcagtggacttgggtgggcaattactctgaacagatagataggtcattaccatgtcaggaatttagagactatcctcaggtacggaggaaccactgaagggttttaacttctgaatgactctagatttttaattgagaaaggtcactgttactacagtgaaaaggatatcgagactggtaaataaaaagtaagaaggctattgtggccaagataagaaatgatgatagcctcaagaaaggcagtggcagtgaggatggtggaaaagacaaatttgagagatgttagggaagtaaagataaacaagatttggtgtctgatttcatgtgaggttgagggaaaggaagaaaggtgtgattattttcaggtgactgggtggttgttgatgctcttgattgagatagagttcctgaaagaaaagttttgaggtgatgaaaggtagtgaagtttttgatacattgaatttttttttttttcttgagacagagtctccctctgtagcccaggctgcagtgcagtagtgtgctcttggctcactgcaacctctgtttcccaggttcaggtgattctcctgcctcagcctcctgggtagctgggactacaggtgcgtgccaccatgcccggctaatttttgtatttttagtagagatggggtttcaccgtgttagccaagatgggctcgatgtcctgacctcatgatccgcccaccttggcctcccaaaatgctgggattgcaggcatgagccactgcgcccggacttttttttttttttttggagacaaagtctcactgttgtacatgctggagtggtgtggcgcagtcatagctaactgcagccttgaactcctggtctcaagcagtccttctgcctagcttcccaagttgctgggactacaggtgtgtgccaccacacctggctagtttttctttctttcttttttttgaaatggagtctcactctgtcacccaggtcagagtgcagtggcgccatctcagctcaccgcaacctcctcctcatgggttcaagcgattctcttgcctcagcctcccagcagctgggactacaggtggccaccaccaggcctggctaattttttttgtatttttagtagagacggggtttcactatgttggccaggctggtctcaaactcctgacattgtgatgcacctgcctcggcctcccaaagtgctgggattacaggcatgagccaccgcagccagcctttttttttttttttggtagcagtggggtctcactatgttgtccagtctagtctcaaacacctgagctcaagtgatcctcccaccttggcctctcaaagtcctgggactataggtgtgagctaccacaagtggcctgataatgttgaatttattgttcctgtgtgactcccaggtagagatgtttagcaagcagttggatatttgtaacctaagcttgggaaataaagatttaaaaagtggtcagtgttgagaatgatgaaaagcagtagatgaaatcacccagagcctaagtattgaatgaggagtgaaggctaagccttgggaaacacagacgtttaaaaaattggagaggaggaggattgagccaaataaatatagaaggataacacagatctgggggtaaaatcataagaacatgatgtcaggaaaggcaagagaggaaatagtttccagcaggagagaatgcctaaagtatcagttactgcaaggagcttatttagggatttaattggtaaataagagacagtgttcttaaactcttaagacttggacaatttctgaggaatagtgggacagaagtcagattgcagttgatttagcgttagttgatttaactcccagccctctgtgcatctggagacaaaagagatgctgggtacaaatccaaagtattaggatagattttactttattttatgtaatttactctcttcttgtacttttcctgagtttggaagccaaactcttctgctagtgatactactgaatgaacattccattaaaatatggactcaagtgtaaaaactgcttgtcgccaacatttataggaattgcgtaacagatattttagaagttaatttcttcggcagatttggtgtaattcagaaattatgcatcacttggtattttctttttttgtaatttattgaaggtatttgaagacagctgaaagaaaaatgagaatttcggaaagttcccttgctttcagttttatgtgcttaacatgtcaattcaaagtttttttaatgagtttttaaggaccccaatatagaattcatattggaaatactcataactttatgttgataccagctgttgctactctgataaattgcttaagaaatgatttaatgggctattatttcttctcctgttactggaaataaatgtcatgcatctttatccataaggtgtttagtgacaggattctttgatagggaactgattataatacaaataaaaaacaagtacctttttaagtatttgttttgttttggtttgctttgttttaccttgcataattttttgaattatggaataattctgtattctgctggtgatgtttaggcaaaacaatgataagacaccaggcacatttaggtgctactacttatttctgagtatgtactatattgtattgaagtgagttgtaagggagaaaacatttcttagtgtcttaggtttatggctaagactccctataacaaaagacagaataacaagagaaaaacatagaaatttatttaagttttacatgacatagtgttgcaggttttctttagttcagctaaagacggggtccttgtctgtcccacgccacagaaatttcggcttgcagatggtttgaagggtgagtaaagcaggattttattgggtgaaaaggaagaaaagggggaagcagggactctcgctaggccagagtgctagagcgcctcccgccggctcttcaaattccaggttccacacaggaagaggaagggccaggttcctcctgctgcaaacagggcgaacttctcgagttccactccaatgagcattacggttggagtttttctggggcggcccttgcacctggctgtctcattcccctctctaaagaagtatatctaactgctgttagattaaggataaggactaagaccgatcttaactgcttcctgctgatagggggtgctgttttgggggaaatggcagagctccctcagagacctatctaagggtttccagcagaaggggccatcgtcagaggctctggttgcatgattgtttggagtttgatggcctgaaggcaagaatagacaaaccgggttattagaagacatatataaaaatgaaacaagggcacaggtaagggcagctcaaaaatcccaaggccggagggcaaaagcctgactggcaaaaacactttacccttttgctggcatgttgggtttttgggttccctttccctgaggccaatcctaagccaaccagtgtaagggctgggaaattaactctttccagtttggaggatgcatccgagggacgtgtcccatagtacagagacacagtcacctatcagtgaagagaggacagaggagaaaaaaggaaaaaagagggtgccttttaaaggactcctaggggtccagggtgtattttaaaggggaacagactgaagataaatggctacccatctagaaagaggggagcaggcgtccctggttcccttctcttcctagcagatacccagggtacctgagggagagagggaagagcgtcctctttccgtcttctgtccttgcatccccgagttctggtgaccttggcaggtgccaccatgagtaccaaagctgcttgcactcatgaagcagggggacctgagaattggaattatctgctctcacctatgtctctttctcacctactgtcagtagccttggagttccctagacctgatttatgccatggatactgatgtggcctttatccaaataggaagcttgggcttggcttaataggaaggaatcagccacactcacctgcgctgtgccttttaacttcccttattgtctgcctttggatccttcagatccaattttctttcctatggctttgacccaaaatttggaattgagtctggggcagaaatgtgtcttaagggggttgaatggactccttatcataagccaaatgctaaggtgaaactgtggaactgagtcctcctccaacaagggagaggaaaggatgtcttgtgacacacccagataactggtgctaagatctgggtacatggtgcctggctttgtttacctcccttggtcttactttcccaaaaggaaacctctgagtgatgatcatcctatttattcccatcatctggcaggatttgcaggataattgctcagaactagaatattgatccagacttgtacattacccatcccttttgttctttctgagctgcagccagaaattgctggttagttcacaggaacaagcagggttagtctaaaatgtaggtgaaaacttaaaaacaacgaatcagtttagaatttaatggcaaatataagttttgaaacgtgatttctctctgtctagtcctcatgttaaaaaacaaatcgtcataggactgagtggtttgcaaaatagactttagttttatacttggcctgattatttgcataaagtgcagcaagaataattatttctacataggccttttggattggttttgatggaagtttgttccataaggaatctcagataagaccttttaagtctgagcctaatcatgggtttgtatcctcaaacacttgtgagttgggtgattctctcctcttagggtcccaagataaacttggagctcctggacctgttagcaagtgacattctttactgaccacaggtcaggaactctgtacagggactgtgtagacaagggtaggtggccagtttctcactgggcttttatgggctctgcaatttgagattgactcagcctcagtaaaataaccactttctccaattgtgctctgttgcaaaagaaaaatgaattcttactgcactgatgcaaacagctatattgccataagaaggctcacagatagttttcaaattctggcggaaccaggcagagagaaacaaacatgctccaaatcttgatcataggaatataccttactcaattattaaaggccataaatagttcaaaataagtttccttgactctgaaaaacaaagcaaggatcagcagtattccaagtaaaagtcaaaaaggttgctttggctttctgagttcagtgcatttagttaactcttgttttgcttgatattcatgaatatttcagctcttcatgagtcctgtacattttcctttattaaaatgttacagtctccaaagttatcagaagtctgtgtttgagagcgactgttaaagttctatagcttattataaaccatcttttgaaaaggattaaaataagacaacaattgtctgtgagtagcaaaatacccagggtggttacagttagaaacacaattgacaaataagtgtggttatttctgtggtttatgataacttaacattgattatggttgacagcatatacttagacattagaattttagaaatcccgtatgatttttgaacatatattatcattattcacaaaaatataacctaaagaagacagaacatcattttggcaatcccatatacctaaacatgtcaaataatcctgtttacctctctttttctggacacttcagggtcccctgaagtatttgaaaagccaggtgctggctgggagtggtggctcatgcctgtaatcccagcactttgggaggccgaggctggtgaatctcctgaggtcgggagtttgagaccagcctggccaacgtggagaaactccatctctactaaaaatacaaaattagcaggttgtggtggcgcatgcctgtaatcccagctacttgggaggctgaggcaggagaatcccttgaactcggtggtggggtggaggttgcagtgagccgagaatgtgccattgcactccaccctgggtaacaagagtgaaactccatctcaaaaaaaaaaaaaaaaaaagtgaggtgccagggaacacggttttgaaactgaagtttgattttgggaaggctgttaaatgttcaaggtttaaaatacttgaagccaggcctggtggcttatgcctgtattcctagcactttgggaggccaaggtgggtgaaaccccatctctactaaaaatacaaaaattagctaggcatggtggtgggtgcctgtaatcatagctacttgggaggctgaggcagagaattgcttcaacctgggaggaagaggtttcagtgagccaaggtggcgccactgcactccagcctgggtgacagagtgagactctatctcaaatgaatgaatgaatgaatgaatcaatgtctgagaactgaatgacaagaaggaactcaccatagtgacacaggatttttcttggtcactttgccagtcggagacctctggttggtaacacccctgtccgggttttgctgggcctgggttcatcacaggagatgccccacacttggcctgccagttcatgcccggtctgcagtttgtcatggatcccacggccactgtgactgtgtattcaacctctggttggaggtggggtgtgagcaagcaagtgtggggtctggccagttgttccaagtgctgacacagaagcaggctttgtgcagtgcttgttgctggactaggcatgtctcaagcccactcctgtgatggtctctgatgtccagatagaggacacagcacccaggcaggggtgctgtgactccgaagcccctgagggggtgttacagcatgctaattagctcaaggggctgaaagagctgttaacacaccgccatctggaatggatggcggtgtgttaaccactctttcagccccttgccccagtttggcctgtggctgcaggcctggctcagccccattgctgctttctgttgtgtggggcagctgccctctgccagcagagggcagagggccacaatgttacagccttctgtgtacccagtttcagtgggtcctgagttcttgtcccatgaccaagaagaataggatcacgctgagaattgaagagtgaggaaggtggagaatttaattgagcaatgaaacagatctcagcagagaggggacacaagggtggtcccctacccaaagtcaggtggcctctctcccattgtggctgggtccagggcttttatgggctcagattggggagtgtatgctgattggtttgtgagtatgcaaaaagattaaaacaaaggcaacactcaaagttgggcatgacagtgtaaaatgttaattagggaaggggaggtatatgtaaaataggcgaaggctggggatcaatcagaggaaagtgtgccaaatgggaagacagattctcagtccggttggtggatttgacttgtaacttgtctttcaggctttaaactgccttttggcttgaaggtggggtttcactggggacctgcccctgtctgcctaggatttgtctgcctcctgccactgtcaatataaagatccagggaaagacttttcaaaggatcagctaatgtaaaagttctaagatacggacaagcttggattgttgttaggattgaattcttgctatccttattgttattaccatagtaattattttttcaggatttccagagtagtggtagattaggacacagaagccacttttgctgcttcattattcctgaacattacttgcatattgtactataggttagactctctcatgcctcatagtgttacatcaacagcacaaaatgataacaagaaataacacttgttattactgtgtactgagcatttttctaaatactttacttgctttttgtgtctggcttgggacagaatttggattcagaaaagagagaggtctcaagaaacaagagaggaaggaaagttagaatgaattgagaggagccataatggtaaaaagacatgaaatggtacttcaggtgaagagttaaggaggagcagaaacttttctcttgataaatctgttttccacatgccaacttcctgttttttattttcaggcaagagatagtttggagagaagaggcttgcccataagaaaaggataggcttcaggtcaggacaggagttagctgttctcagaagtttctatgacttgactttcgatacagggaagtaagctacttttttgatctgtgctaagtgtaggtttgatattaaaatatcaaatgttttcttgccctctcctccaaatatcttctttgcttttgagtgccttgacattcctttaagttggagacaaaacttttaatcaactattaaagttaaaaagcataaaaggaaaattcctatttgaagatgcatgttggtttaaacctacttaaatcaaagtatgatcagtcagtaaataaccaaaagtaaccaaataataagaataactattctaactgcagaaagatgaaaattaacaaggttgtggagtacttataaagttgtgagaaaatatctgttgggggcattttctttttttttttaacttagtgcttctgattagcattggcgttctttagtgtcacctctgcagaggtaaatagaagctgcttggacatgtattttttttcatgtgatttaatgtatctgtagcttagtgagaatatttgattctgttacatgttttatatagacattcttgttgaaaataacaggtcttgtaggcaatggttctcaattcagctttgcatcagattaacttgtgaaccttaaaaaaaaaaatccagattcctaaatcctgccctaaggattaggcattagtgtttaaaatataaaaagcctcaggtctggtttcctcatttatagccactgttgagacttgtaactttagagaatttatagagatatcagcatattgtactttgtatttaatatttgatgatggcatgccatattgaaaaaggttttagaatttatttgcataaatgtgatgaatctttgtaatgtgacttagccaacgcacatttattgagctcctgtttacatgttgctaagctgtaatgaatgctaatatgaaccaggcaattttctttacaaatacagattgattttttagttatctaaaatatgtgaatattgggaacaagtagtgtattttaataaaaatacacttatttgaaactcagtttttaggtgcaatatttagattctatatgagatcaaagtagttcagattctgcttgtataggaaactaagtgcagatgaaatattttaccactattgtacaattttgtactacaacatcagagttgagttgtttatacaaaacatttgtcaacttctgagaaagacagttatattgtttgtaaataagaacagttttatttccaatctgtatactttttcttgccgtaatgcactggacagggcttccatgggatgttgaatgagagtggtgacagtggactttcttccttctttctccatctcagggggaaattattcagccttttacctttaaacatagtgttacttgtagatttttcttagatactctttatcaggttgaggaaacgtgcttgtattacttgtttactgagcatttttaacatgaatgaatgctgaattttctcaaatgccctttattttgattatgacattaattgatatgaacataaggtctttcttctttagtctattaatatagtggattatgctgattgatttttccaatgttgaaccagcttggcattccccaactaaatcctattggttgtgatgtattttgtatgtgtatatgtataaaatttgtaatttggtttatatatatttgatttgaaatatatttgaatatatatttatttgaaattgttttatgtatatgtataaaatgattcgatttgctaatatatataatttataatttgattagcaaattaaatccatatatatttatatatgtaacccacatatatatttttatacatatagcaaatatatctttaacaaaaaatataacaactatatctgtggctacctatcagggatgggtataatataggaaggcatattggtatgcatgtggttccccaactgtatacagttgtaaaaattctttgagctatatactttaggttcgtgtaaggtagtcagttaagagtctagcatcacttgcttatctgtctgtcctagaacctctggtgtctcaggtttttctgatgaaaagaaattgagttctccaaaaataattagtaggtttcatcatattagttaaaaataatactagaggaacataaatttagaatatcctgtgaaggacagtgcaccttaaaagttttcagaacctcagacatgctgtagatcaaacacaacacgccattcttcattgcagctcttttgaatgcattatttaaatactatctttcaatgtttccttcagatttctaatacttaaatatactgttatatttttctcagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagagggtaagaagttggacttactcagtttattctgtctgtatagctgctttacttacaatcttcagaggaggtgtgtgtgttgtgggtagaagtggtggttattcctaacctctgttaccattaggccaaattctacaaggtgcagaaaagaatttggttcatttggttcctaagttgcatagtctccagtgccacttttgcaactatttaaatttgacagcatcacttggctgctgttgttttctattttatttcaattatttttattttttattttcttgagatagagtctcccctgtcacccaggttggagtgcagtggaaaatctcggctccctgcaacctctgcctcccgggttcaaacaattctcctgcctcagcctcctgagtagccagatacaggtgtgcgccaccatgcttggctacttttttttgtatttttagtagagatggggtttcgccatgttggccaggcttgtctcaaactcctgacctcaagtaatctgcccgcctcagcctaccaaagtgctgggattacaggcgtgagccactgcacctgccctcaattaattttttaaattttttagttgtaattatagccttttttttctattttattttttctattttattctttgcatatatatatatatttttaatactttaagttctagggtacatgtgcacaacgtgcaggtttgttacatatgtatacatgtgccatgttggtgtgctgcacccattaactcgtcatttatattaggtatctctcctaatgctatccctcccccctcctcccaccctataacaggccgcagtgtgtgatgttcccttcctgtgtccaagtgttctcattgttcacttctcacctatgagtgagaacatgcggtgtttggttttttgcccttgcaatagtttgctgagaatgatggtttccagcttcatccatgtccctacaaaggacatgaactcatcattttttatggctgcatagtattccgtggtgtatatgtgccacattttcgtaatccagtctatcattgttggacatttgggttggttccaagtctttgctattgtgagtagtgctgcaataaacgtacgtgtgcacgtgtctttatagcagcatgatttataatcctttgggtatatacccagtaattggatggctgggtcaaatggtatttctagttctagatccttgaggaatcaccacactgtcttccacaatggttgaactagtttacagtgccaccaacagtgtaaaagtgttcctatttctccacatcctctccagcacctgttgtttcctgactttttaacgatcgccattctaactggtgtgagatggtatctcattgtggttttgatttgcatttctctgatggccagtgatgatgagcattttttcatgtgtctgttggctgcagaaatatcttcttgaagtatcttatgagaagtttcaaatgatctcctgtgactttagaattttcatgattgttacgtcatgtcctgtttctcatttgacatcattcaattcttgtttttttttgttgctgtaccccttaccactgcttttttttggaaatagtggggtatctgctctatttactacatggttgctgctgagcaataactgacctcacaaaaagcacatatcatatggctctgtgctcaatactctttttatacaaactagagctaaatgacagatgtttacttttaagaccttgtatcatgtgcttctagggtatggtttattaatagtaaatttcttaatttttattatctttgaaaaaagcatcttagaattctcagtcttgcttctgtatgaaactgtttttttctatgattgccataaacataataattatttttagctaatatttatttagtgcttactatatgctaagaacattccaagtatttcaaatatgttaacttatttgagtcttacaatcccatgaatactcttattaacttggttttaaggatgagaaactgagacacagagagcatcatcacttgctaagctcactcagcttaaagtgacaaagctgagatctgagtccaggctatctgactttaagatttgtacttgtaactatgacattattcggtcaagttagtcagttgactaaaacatgagaacagctcacttttaaaactaaggtaaaattcacataacatgaaaataacatgaaaacttaaacatgtacaactcagtggcattttagtacattcacaattttgggcaaccatcacctctatctagttcttaaacattttcgtcatccaagaggaaatattatacctattaagcagtcactctctgttctcccctttcccttccccctggcagccactaatctgctttctatctctatggctttacctattttgcataattcatataaatggaatcatacaaaatgtgactttttgtgtctggcttctttcacttagcacagtgttttctgagcatattgtttcatctacattgatacatgatatagcaggtgtcagtatttcattccattttatgactgaataataattgtttagataaagcacattttgtttatccattcatctttcagtggacactggttggttccatattttggctattgtgaataatgctgcagtacacatgggagtgcagctgtccctttgacatactggttcatttcctttggatatatatgcagtagtaggattgctagattatatggtagttctatttttaattttttgaggaaccaccatagtgtttttcatagtggttgtaccaatttgtatatctaccaatagtgttcaagggttcccttttctccacatccttggaaacacttacttttgctttttggtaatagccgttttaatgggtgtgagatgatatctcattgtagttgtgatttccatttcccttatgattagtgatgttgagtacctttgcatatacctgttagtcatttgcatgtcttcttttgagaaatgtctatttaggtcccctgtccatttaaatttttttttctttttgctattgagttgtgcaaaattcacatatatatgtgtatttacatatgtatgtgtatatgtatacaggctgtatacatatctgtatatatacacacacatatacatatatgcatatatgttatgagatgtgtgatttgcgaaatactttctctcattctgtaggttgccctttcatactgttgattgtttcctttgttttgcagatgttttttagtttgatgtaatcccatttatctatttttgcttttgttccttttgcttttggggttttatccaaaaaatcattgcccaaaccagtgtcatggagctgctcccctttgttttcttctagtagtttaatttaagtctttaatccatttttagtttatttttatgtatggtggtgtgagataaaagtctaatctctaatttcattcttctgcatgttgtggatatccagtttttccaaaaccatttatttgaagagactgttctttccccattgtatgttcttggcacctttgttgaatgccagttggctctaaatacatggaattatttctgttctgtttatcccattggtctatatgtctgtttttatgctgatctcatgttgttttggttactttagcattgcactagattttgaagtcagatagtgtaatgcttccagctttgatctttttgctcaagattgcttcacctatttgggatcctttgtggctctatatgaatcttaggatttttttttctattactgtgaagaatgtcattggaattttgttagggattgtgttgtgatctgtagatttctttgagtagtatagacatttaaacatattaattcttccaatccatgtacacagtatatcactccacttatttgtatcttcttaaatttctgtcatcaatgtcttatagttttcagtggagagatctttcacctcatgggttaaatttatttctaagtatttatcttttgtagctaatgggatttaaatggggtttaaaaaattagttttcagatagtttgctgttactctgtaggaattctactgatttttgtatcctgcaactttactgaatttatgtattaattctaacagtttttcgatggagtgtttagggtttgctataaataagataatgtcatctgcaaaccaggacaatttgatttcttctccaatttgtataccttttatttctttctcttgcctaattgctttggccaggactcattactattttgaatagaagtggcaagaataggcatccttgtcttgttctgaatcttagaggaaaagcttttagcctttccccattcagtataatgttagctatgggtttgacatatatggccttattttatccaggtatatcccttctatacttaatatgttgagagtttttcacatgaaaggatgttgaattgtgtcaaatgcttcttctgtattagttgaaattatcatgtgatttttatccttcattctgttcatgtgatgcattacatttacagatttgcatatgttaactcattcttgcatctcctggatgaatcccacttgatcatgatgaataatctttttaatgtgctgttgtgtttggtattctagtgttctgttgaggttttttgcatctgtgttcttcagaaatattggcctgtagttttcattttttgtagtatccttgtctgtgtctggctttgatattagtgtaatgctggcctcataaaatgagattggaattactctgttctcttgaaatttttggaaaagtttgagaacagttggtattaattcatctttcagtctttgttagaattcagcgatggagccatcaggtcctgagcttcctttttttgctgggagactgtttattactgatccagtgttattactcattattggtttgttcagattttctatttcttgataattcaatcttggtaggttgtatgtgtcaaggaattattcatgtcttctaggttgtttaactgtttgaatataacggtctataacagtattttatgattctttgtatttctgttgtatcagttgaaatgtctccttggtgttcaggagcatattgtttaatttccatgtatttgtgaattttccgaagctttttctgttattaatttgttgttttatactattgtggttgaaaaagatacttgatactatttcagtcttcttaaatttgttaagacttgttttgtggcctaacatatgatctgttctagagaatgtttcatacacagttgaggagaatgtatattgtgcagttgttagatggaatgtcttatatattatttagtctagagtgtacattaagtctgatgttcctttattgatattctgtctggatgatctgtccattgctgaaagtgggttgttgaaatctcttactgttttttgtattgcagaatatctcttcagatctattaatgtctgctttatatataggtactttgatgttgagtgcatatatttacaattgttatagtctcttgctgaattgacctttttattatataatcaccttctttgtctctgaatttttttaattttattttttgtggacacatagtaggtgtatatatttatggggtacatgaggtattttggtaaagaatgcagtgtgaaataagcacatcatggagaatggagtatttattctctcatactctttgagagtattctctcatactcatattctctcatactcattctctcatataactctttgagttacacacaatccagttatatttttaagttattttaaattgtacaattaagttattattgactatagtcatcctgtgtgctgtcaaatactaggtcttattcattctttcaattttttttgtacctattaaccatccccgcctccccctgcaacccatcactactattcccagcccctggtaaccatctgtattagtctgttctcacactgctgtaagggtactacccaagattgggtaatttataaacaaaggaggtttaattgactcacagttttgcatggctggggaggcctcaggaaatttacaatcatggcggaaagggaagcaggtactttcttcacaaggcggcaggagagagagtgagagagagaaaagggaagagcccccttataaaaccatcagatgtcatgagaattcattcactatcatgagaatagtatgggggaaactgcccccatgatccagtcaccttctactaggtctgtccctcaacaactggggactacaattcaagatgagatttgggtgggggatgcaaagcctaaccgtatcatcatccttctactctctgtgtccatgacttcaattgttttgatttttagattccacaaataagtgagaacatacaatgtttgtctttctgtgcctggcttatttcacttaacataatgatctccagttcaatccatgttgttgcaaatgactggatctttatttttatttttttgagatggagtttcactcttgttgcccaggctggagtgcagtggtgcgatctcagctcactgcaacctccgcctcttgggttcaagcgattctcttgcctcagccttctgagtagctgggattatgggtgtccagcaccatgcctggctaattttttgtattttagtagagacagggtttcgccgtgttggccaggcttgtctcaaactcctgacctcaggtgatccacccaccttggcctctcaaagtgctgggattacaggcatgagccaccatgcccagctgacagatgactggatcttattcttttttatgattgaatagtcctccgttgcatgtaagtatcacattttctttatccatttatctgttgatggacacttgggttgcttccaaatcttagtgattgtaaacagtgttgcaacaaacacaggagtacacatatctttttgctacactgatttcctttcttgttggaaatatacccagcagtgggattgctggatcatatggtagcttaatttttagttttttgaggaacctccaaactgttctatatagtggttgtactaatttacatttccaccaacagtgtacaagggttcttttatctctacatcactagcatttgtgattgcctgccttttggatgtaagctattttaactggggtgagatgatatctcattgtagttttgatttgcatttccctgatgatcaaagatgttgagcatcttttcatatgcctgtttgccatttgtatgtctttttttttcttgagaaatgtctattcaaatcttttgcccgtgtgttaatcagattattcgatttttttcctacagagatgtttgagctgttccttatattttctggttattaatcccttgtcagataggtagtttacaaatattttctcccatcctgtgagttatctcttcactttgttaattgcatcctttgctgtgcagaagctttctaacttgatacggtctcatttgttcatgtttgctttgggtgcctgtgtttgtagggtattacccatgaaatttttgcctagaccaatgtcctggagattttccccagtgtttcttatagtagttttatagtttgaggtcttatacttgagtctttaatccgttttgttttgatttttgtatatggtgagaggggattagtttcatccttctggatatggatattcagttttcccagaaccatttattgaagagactgttctttctccaatgtctgtttttggcacctttgtcaaaaaatatttcactgtagacgtatggatttatttctgggttctctcttcagttccattggtctatgtgtctgtttttatgccagtcccatgctgttttggttactatagctctgtagtatagtttgaagtcagttgtgattcttgaactgcctcagcctcccgagtagctgggactacaggtgcccaccaccacgcctggctaattttttgtagttttagtagagacgaggtttcaccgtgctaggcaggatggtcttgatctgaccttgtgatctgcccgcctcggcctcccaaagtgctgggattacaggcatgagccaccaccacacctggccataaatgggattattttttaaaaattcttttccacgttgttgacaattggcatatgtaaatgctaccaatttttgtattgtaatttggtatcctgtaactttattgaatttgttgatgagttttaatagttttgtggtggagcctttagggttttccaaatataagattatgtcatctgcaaaaaaggataatttgacttctttctttccaatttggatgccctttatatctttgtcctgtctcattgctctagctaggacttgcagtactgtgttgattaacagtggtaacagtgctctagctaggacttctggtgctatattgaataacagtggtgatagtgggcatcctggttgtgttccagatcttagaggaaaggctttcagtttttctccattcagtatggtactagctgttggtctgtcatatatggcttttattatgttgaggtatgttccttctatctcaagcttttttgagggtttttaatcatgaagggatgtggaattttatcaaatgctttttcagtatcaattcaaatgatcatagtttttttccttcattctgttgatacgatgtatcacattgatagatttgaaccatccctgcatcccagggataaatctcaattggtcatcatgaatgatctttctataatgtattgttgaattctgtttgctggtattttgttgatgatttttgcgtgagtatttatcagagatattggcctatacttttcttttttttgatatgcgtttgtctggttttggtatcagggtaatactggccttgtagaatgagtctggacatttggaagagttccctcgtcctctgttttgcagtagttcgatttggattggtgttagttctttaaatgtttgatagaattcaacagtgaagtcatcggttcctgggcttttctttagtgggagacttcttattattgcttcaatctcagtacttgttattagtctattcaggtcttggatttcttcatggttcaatcttggtaggttgtatgtgtctaggaatgtgttctattcttctagattttccaattcattggcatacagttgcgcatagtaaccactgatgatcctttgaatttctgccatctcagtgataatgtctctgttttcctttctgatcttatttatctgtatctttttgctttttttcttagtctggctaaaggtttgtcaattttgttgaacttttcaagaaaccagtggtttgtttcattgattgttcattttttaaagtttcaatttatttgttctctgatctttattagctctttccttcaactaattttgggtttggtttgcttctgcttttctcatttttttaagatgcatcattagaaggtttatttgaagttcttcctttttttgatgtagacagttatagctataaacttccctctttgtactgcttttgctgggtttcggtatgttgtgtttccttaatcatttatttcacgaaatttttcaatttccttctcaatttcttcattgacccactggtcgttcaggagcgtattgtttaatttctctgtatttgtatagtttccaaaattcctctttttaacaatttctagttttattccactgtggtcgagaagatgcttgatattatttcagtttttttggaatgttttaaaacttattttgtgacctaaaatatggtctgtccttgagaatcatctgtgttctgaggaaaagaatatgtattctgcagccattggatgaaatattctgtaaatatctatgaggtccattaggtctatgatgcagattaagtctgatgtttctttgttgatttttttgtctagaaggtctgtccagtgctcacagtgggggtttgaaggtattattgtgttggggtttatctttctctttagctctaataatatttgctttgtatatcttgatgttccagtgttgagggcagatatatttaaaattgttgtatctttttgccgaattgatccctttatcattatatggtgactttctttgtctctcagagttttctgtcttgaagtctatttttccactataagtatagctattcctgctcttttttgtttgttttcttgtttcagttggcatggaatatctttttccatctctttattctccgtctatatgtgtccgtgtaggtgaagtttgtttcttgtaggcaacagatcaatgggttttgctttttcattcatttagccagtctgtgtcttttgattggagagtttagtccatttacattcattgttatcatttctaagtgaggatgtacttctgccattttgtaatttgttttctgatcttctttcttcccttcctgtctttctatagtgaagatgattttctctgttgctatgatttcatttcttgcctttttttttttttttgagacatggttttgccatgttgcccatgctgtaggatcttttctttatccttagcctttgggagtttgattatcaaatgccttgacatagtcttctttgggttaaatgtgcttggtgttctataaccttcttgtacttgaatattggtatctttctctaggtttgggaatccatttcaatacattttctaccctatctctttctctacctcctctttaaggccaataatgcttagattcgcacctttgagcctttttaaagatcctgtaggcatgcttcattgtttcttattctttttctttttggcttctctgactgtattttcatataacctgcctttaggctcactaattctttcttctgcctcatcaattttgctattaaaggactctgatctgttccttagctccaattgcatttttcagctccagcgtttctgcttaatctgaaaaaattatttcaatctctgttatatttctatgatagatttgtgaattccttctttgtgttatcttgaatttctttgatttttctgaacacagttattttgaattctctttctgaagtttcacatatctctgtttcttcaggaatggtccctggtgtcttattgagttcatttggtgaggtcatattttcctggatggtgttgatgctagtagatgtttttcggtgtctgagcatcaaagagttaggtatttactgtagttttcactgtctgggcttattagtacctgtcctttttgggaatgcttttcagatatttgaaaggacttgggtgttaatctaagctgtatctactttaggggcaagctcctcaagcccagtaatgctgtggttcttgcagactcatagaggtactgccttgatggtcttggataagatctgggagaattctctggattaccatgcagagactcttgttctcttttcttactttctcccaaacaaacattctctctctctctgtcctgagtttctcctaaacaaacagtctctctctgtcaccactccctggctactgcctatgttcactcaggctctggagctgtaccatcagcaggtggcaaagccagccatgcctgtgtccttccctttagggtggggaggtccctcagaccccagggttggaggttcagaggtgccatccaggagtcagggaccttagaattctacctgttgttctgtcatactgcccctgagctggcagttgaaccacaagacacagttcttcccactgttctctccactttccaaaggcagaggaacctcaccccataactaccacccacccaggctacgaggagtactgccagactaccataatattcctttaaggtccaagggctctgaagtcagcttgtgatgaatgcttcctggcctgggactcaggcttcagggcagtgggctccccatttggccagggcaggtttagaagtgctgtccaagagtcaagttctggaatcagggactataagagcccacttagtgctctacttccctgtggacatgctagaacctaaggtgcaagacaaagtcccctttacttttttctctgtttttctcaagcagaaggagttttttcccatagccactacagctagtaatgtgctgagtttcatcggaagccagcaagtctcaggggctcacccaaggcccttgatgtagtacctgggtatcactgctggttatttcatgtccaaggctcttcagatagcaggtgatgaacgctgctgggattgggttttttccttcaaggcagtgggttcccttttggctcaggttgtatctagaaatgtctaggagctatggcctggaatggggacctcatgattctgatggtgccctatcttgctttggcagagctggtatccaagatgtaagacaaagtcttccctactcttcctctcctctcctccagtggaaggaagggtgtcttttggagctgtgagctatgcagactggggttaggggaggggtgatactagcacacccctggctgccccagctgatgtctcagtatgtcatgtttccccccagtccactgtctctgggcctagttcatcactatgacttgcctaagagttgcagtccttatggtctagactgcctttcacatttacttgtacatagcactgtagcccttggtggcaaggtctgcaggaactcaaatttgtaccgctggggtcagggatttccctttggccagggctggtttaaatgctccctccatgggcgggcatcagcaggagttgggtcaggttttgctatctcctctaacaggacagcactaagttcagtgccccacagttgctgtgttctccctccccctgtgcccagtgatgcttaccccaccatgtcactgatgccaggggttatagaggggtggtattggcagttcaggactgtttttttttttttctatctcttcagtgcctctttcagcaataagaagttaaaaccaggactatgagtgttcgcttgatttttggttcttacaaaggttttctttttctgtgtagatagttgttaaattgatgttcttgcacaggggacaattggtgaagctttctattccctatcttcctccacctacctctccccttgtctctttttacacttttgaacttaaagtctgtgttgtctgatataaaaatagctactcctgctctgctttggtttttatttgcatgggataacttttctcttcactacatttttaggtaaagtgagtctcaggtgagtttcaggtaaacttttctccttactggtaaagtgagtctcttgtagggagctataattggggcgttgtgtttttgttttgttttgttttgtttttcttccattcagccactctatgtcttttgattgaaatactcaatccatttatattcgagatatttatctttagataaagactttttactgccatttggtgattgttttctttctttctttctttctttctttctttctttctttctttctttctttctttttctttcttttttgtagactttttgttcctgtcttactctcttttaatcttcctttgtgattaataatattttataatggcatactttatttccttactttttatcttttatgtatttgctatacttttgcattgtgattaccatgaggcttatgaaaaacatcttataaaggctgttttaacctgccaacagcttaactaactgcattaaaaaaaactttacacttcatctccttctcccatatttacaatttttgatactacagtttatatctttttaacctgtgtattcttttaaaaattattatacctattattgtttttaatagttttgtcttttaaccttcatactgaagatgtaagtgatttacatactgccattacagtattgcatattttgtatattttacatatttgcatatttgtacttacttttttcagtaacttttatactttcagatcagtatgttttatactttcaaatgtttttcttactaattaacattcttttctttcaggttgaagaactctttagcatttcttgtaagacagatctggtgacatgatattctttgatttttttccatcagttttataattttcctcatagatcatgtacatattttattggattaattttaagtacttcttgttattaatatgaatgatactgagttttaaatttaaaatttcaatggcttatttgtggtatgtagaaaagcagttgacgtcttgtatattgactttgtatacaggtaaccttactattcttggttattaattctaagaagcttttgtttgttttatcaaatctttggaaatttctgcatatgtcattatgtcacctgaaaataaagacagttttatttcttccttctcaatctgcatagctttcattttattttctaagtgtcttattgcatttactaggactttctgtacaatgctcaataggaatggtgagaagggacattcttgttctcttcctgatcttagcaaaaaagcatctagtttcttactattaacatgaagatgttagttgtaggtctttgtaggtgttctttatcaaggtgaggaagttcttttctattcttagtctgctgggagtttttatcatgaataagtattggattttgttaattgcttttattgatacgatcttaggatttttcttctttagctgttgatgtgatagagtaattaattgatttttgaatgttcctctgcggttatttagttagcactctttactttctcgtgccttgccattttgcttcatctattccctaataaaaatcttcgatcactatgtttttgcatctttaatatatgaaccaccagttgaagtccctgccttcagcttgctcactcttcaaaaacaggacatttgactgatttttgtctaaaaattttgatgtgggttttgatacagaaccattgaaaataaacggtatgaaggcataaattatatacaacagaatgaacgtattttgagtggtagttcaccaggtttgaaaagtgttatacatccacataatcaccaccagaattatgatatgaaacattttcatcaccccagaaactttctcttatgccctttataactcatcgtttcccctcacttgtggttcctggcaaccagtgatctattttctgtcattatagttttaccttttcttcagtttcatatacatggaatcacttagtacatagtcttttgtatctggcttctttacgtagcataatgccttttagatttatgtacatcatgttagcagttggttcttttttattgctgagtagcaatctgttgtatagatatgctgcagtttagtcatgagttaatggatgtttgggttatttctagctactggctatcgtgaattgttgcgggaagtcagggaccctgaatggagggaccagctgaagccatggcagaagaacataaattgtgaagatttcatggacatacattagttccccaaattaatacttttataatttcttatgcctgtctttactgcagtctctgaacataaattgtgaagatttcatggacatttatcacttccccagtcaatactcttgggatttcctatgcctgtctttaatctcttaatcccatcatcttcgtaagctgagggtgtatgtcgcctcaggaccctgtgatgattgtgttaactgcacaaactgttcgtaaagcatgtgtgtttaaacaatatgaaatctgggcgccttgaaacaagaacagggtaacagtgatgttcagggaacaagggagataaccattaggtctgactgcctgggagtcgggtggaacagagccatgtttctcttcttacaaaagtgaataggagaaatattgctgaactctttttctcagcaaggaacagccctgtgaaagagaatgcgttcctagggggaggtctctaaaatggctgctctaggaatgtctgaattatatggttgttgataagggataaaataagccccagtctcctgtagcactcccaggcctattaggatgaggaaattcctgcctagtaaattttagtcagactgattgtctgccttcaaactctgtctcctgataagatgttatcaatgacaatgtgtgcccagtggggcatgaaacttcattagcaattttaatttcgccctggtcctgtgatctcgctctgcccccatttggcttgtgatattttgttccccttgaagcatgtgatctctgtacccacaccctattcgtacactccctcccctttgaaaattgctaataaaaacttgctggttttgtggcttggggggcatcatggaaactgccgacatgtgatgtctgccccggactcccagcttttaaatatctctcttttgtactctttccctttatttctcagaccggccaacacgtagggaaatagaaaagaacctacattgaaatattgggggtggttcctctgataatgaataatgaatttgattacaatttttttggcaaatatatgctcccatttcacttggaaaaatacctacgaataggttcgctgggttgaaattaccaagctacttttccatccctaccagcaatagatgaatcagttgctctatacccttgttagcatttggccttactagtttaaaaaaatttagctattctagtgtgtgtgtgttgtggtatattgcagtattaatttgcatttccctaatgactaatgtttttgtgtatcttttcatgtgattatttaccatttgtatatcttcttggtcaagtgtctatttgaatatgttgctcatttgtaaattctgttacttgtcttactgatttattagagttctttatatatattagacaatttttttatcagatgtgttttgcacatatttctttcattctgtaatttgttttcattttctgaaaaatgtcttttgaagagtaaaagtttaattttatgaagtctaatttggcaattcttttcctttatgatttatatcttttgtgtcgtaataaatccttgcctaactcaatgtcacaaagatttttttcctttgctcctttagatgttttatagtttagattttacatataggtctgttatctatttgtttttatctataattgcaggtagaggttaaagttcctgttttttggcttaaaaaacagaaaacatttattttatggtttctgcaggttaggaattaaggagtggcttgtctgggcagttctggctaagactttctcatgaagaatcagatactgtctgggcatgtagtcacctgaacacttgactgggtggggcaagaatctccaaaagcgctcactcatatagcagtcaaaatgatgctgttgttggaaagtaacatcagtttctcttcacataagtttctttagagaggctgcttggttgtccttatgatataatgtctagcttttgccagagagagcaacccaagagaccaaggtgaaagtttcagtgccttatatttcctagccttagagtcatacagtattacttacacagtattctgtaagtcacagagttaagcccttatttacattgtgtgattctactgtattctatagaagacttccaagaacagtgatggggtcatctctatctcagctgacatgaatggataaagagaagagatcacatgcaggagattttgggggcagatctagaagctgtgcacattattttctgctaagcaagaaccacaggggcagttggggaatgtaattgagctgtgtgctcaaggagaagaataaataggtgtgagaagcatctaacagaaagttacttgaaaacaagatttcaggtaatgtcatccaaaaatgccattttttttagaaatgaaaaatacgtgtaactagaactgagagagaataaaattggtaaaatgacaggtgctactccataagaatatattatacacttcagtgtcacatcatttggccttttgctctaatttagtgaaaaacagttttcacgtctgtcctactatgtttgaagaaagataactgatttggtttaagaatctgttttgtggcatatatattagatatttagtatacgtagatttatattttactcattttagccctgagaaataactattatcatctgtatattatatataaggaagaagattcaaaaaaatttaagtaaatcatttgagatcatagggataataaacaaaattcaaatctatgtaaatctcacctgaaagcccatgatttttcatgataaacaaaataaagatactctcctttaaatcactgaatctatataactacactcttaattgcttaaaagatagtatttttaatgttccctttccagatgagacattctagatcttatatattcttaatattctggatctgtctgaaattgcagacttctgatagaaagatataattgaatataatatgaaaatagaacatgaaactgtatcttccactattgtttagggagctttcatcatatttggaagcatttttgcaaagtggtttcaagcatgcaaataaactagtatgttatcaatgaactctaggtatagattattttaaattatgtcatccagtagccacatatacttctttaaaggatcagttgtagaaaaatctacaactggaaaccaaaatattctcttcaaaatgtcttttagacaacaaatacacctttagtttattcaccatgcattttttatgataaattactcaatgttattaaaggcttgaaaaggtattttatgatccagtgataattactttagtggtgaagaaatctgaaagttgtgtggatatgctctataatggaagagtcatttacttatgaaaaacaacattactagtaaactgataaactaagaagtaaatggcaagccaaatgaccccacagttttggcgtgttattaacctgcaaattatccagaaacatcaactgctaggatcttaaaatcatgtaggcgaatcattggaaagtcatttttttttagtcttagtaaagagctaaattagatcaatattcattttttctcatggccattttgacagttgtcttgaaacagttatactgaaatgactacctcaaaatgtaagaaatgaggggtgcagaagagatagattagagatattctggagataaaattagtgaggcttataaatgaattggatactatagatggcagaagaaagagaggagaaagactcaaaggttataatgcaatttttggtttaggtaactggatgatcttgatgccagcaaatgagataggaaacacaggggggaggaagtgtgggtttggaggtgggaggaaaatgtattcagttttaaatattgatgagtttgagttcactgtggaacactgaaatggaactatttttcagttattagaaatagtcttaaactgtgagaaaaactttacaactggagataaagtcttcagagtcatcagtatgaagcaatgagaatggctgaaattatctttgaggaaaatgtgggagaggtgggttaaaagtagatgttaggacatcactaacatttaaggggtaggtccaggaagagaaagccctagctaaaggatctgcagaaaaatgatgacaatatgagagccaagacagggatagaataagggatggagattgtcaaagaagaagtgatattcggtgttgtcaaataaacaaggaggtttaataagataaagaccaaaatctgttcttacaagttcattagtttggggggattatggaacctctacaagggtgattttaataaaactgggaaagaaacctcattgtagtgcattgaggattgactaaagataaggaaggagagaacagtgtttaagtaactcttttaagaaatataagaagaggaaagagattagattgagaatactgaattatttctggccaagagaggacaattttagggtgtaaaagacttgagcttctatgtggttagaaaggaagaactaaaaatagagagaagttcacccatcctgcacttaaccatacagtttcctgacatgcttctgtgtcttagcaaatgctatttactctgcttagagttttttcaacaaaggcatgttaatagtgggggaaagaaagtaattttagcatcgtggcagtttctcagacatctttcaaaatattttctatgacctttttagtaggttactttggcaaattatatttaaaatgcaatgtggttggaacaagatggcagagtttctttcttcactgatagtacccccacaaaaacatcattttgcacaactatccacatatgaaagtaccttcataaaagctaagggaacctgaacatgcaaccaaggctgtaaagcccccatgaactgcaaagatgaataaactgtagttggaagataagattattggttctctgtgactaagatgcctctttctacaagccattacagtaccacacgtggaagtttctcctggactcatggtttctatattggaaaaaatgagttggagctgcacatttggcttccccacaatcctgggtcccttcacaggaggctcacttctgcactggcccattgggagcaacacaagtcctgatggggcccaaccatctgaggccagctaggaacaaacagaagatgtgggactagcagcagccggtgtgtggaacttggaagtggctcatgatacctgccataggagctgcactaaaggggccgtttatgggcatcatgctgcaagaagcacattccacagatcctctggacttgagggcctgactggctctcccacatggcctaggggcccttcagggaccttccgtgggtctatcctttgcatcagtgacagagccattgtgagactcgtgtctaacctgggcttagggtgccttctagcactgaaatagaatacagcagtcagctcagattcctaaacaagcccactaaaatagactgatcacaaacaaacctagactacaaagactagaataaatatctaatttgttaatgagtagacagagatgcatgtccacaaataataggaatatactaggaaaaatggcctcaccaaaaggacaaagcaaggtcctaacaactgatcctaaaccatgtagatgaatgatctggtggacaaagaattcaaaatagttctttgagtaaaactcagtgaacttctagaaaacagaaacaattcagaaatttatcagagaaatccaacagagaaattgggaatcatataaaaaatcaaatagaaatcctggagttgaaggatataataaacaaaatgaaaaatgcaatagagggcatcaccagcagaattcatcaagcagacgaaaaatcagctcgaagacaggctcttcaaaactatatagttggaggagaaaaatgaaaagtggaattagaaggtatgaagaaaactgttaggatttatggggcaccatcagaagagcaaatctgtgtatcattgatgttcgagagggactggagtaggggaaggggatagaaagctttttcaaagaagcaataaaagaaaatttttgaaaactggagaaatatacaaatatccaggtataacaagactagatttaccaatcaggtttaacccaaataaaacaactataagatatattagaaacaaactgccaaagacaaagagtggatattgaaagcagaaagagaaaagcaaataacaaataagggaatttccatactcctggaagcaggcttctcagcagaaacctgacagatgagaatgagtagaatgatatattcaaagtgctgaagggaaacaatcaaacaaacgagaaacctgtcaaccaagaatactgtacacagtaaagctattttttttaaatgaaggaaatctgaaggcattctcaaacaaaagctgagggaattccctgtaaccagatctgccttgcaaaaaaaggtgaagagagtttgtcatactgagagaaaaggatgctactgggtaacatgaaaaaaatctgaagatataaaacccacaggaaaaagtaagtgtccaggcaaattcaacatactctaatgcagtgattgtgggacataaaccacttatggtttaaccttcgttgttaggaagggttaaaagacaaaacaaaaataatagcaactacaataatttgctaaggtataaaaagatgtaaattatgtatataataaggtataataatataataaggtataaaaagatgtatataaaaagatgtaaattatgatatcaaaatatgaaatatgggagagcaatggagttagtgttttttttgaacaaaattgtcagcttaaaataatataactgtaagatgttttttgtaagtctcatggtaactacaaagcaaaacctttaataaatacaatacaaataaaaagtaagaaatcaaaacatactgatagagaaaacctcctacctggaaaggaagacagtaagaagagaggaacaaaggttctgcaaaacaagcagagaacaagttgataatatggcagcatcaagtctttacctattaataattaacttgagtgtaaattgattaaattcttctttgaaaagacgcagagtggctaatggatagaaaaataagacctaactatatgctgcccccaagagactcacttcacccttaagaacatgtgtagactgaaaatgatggatgggaaaaggtattccacgcaaatataaactaaaagaaagcagaaattcctatatttctatctgataaatggaatacaagtaaaaaattagaaaaagaggcaaacagggccattatgtaatgttaaaggggacagtagagcaaaaggatataacagttgtaaatatatatatatatatatatatacacacacatatatatatatatatatatatatatatatatatatatacccaacatcagagcacttaaatatataaagcaaacattaatagagctaatggaatatattggaatacagtaatagtagggaatttcacctcactttcaacaatggacagatcatccagacagaaaattaacatagaaaaactgaatttaaactgtactctatacccaatggacctaacagacatttatagaacattctgtccaacagcttcagaattcacattcttctcaactgcatatgaaacattctccagaatagatcatatcttaggctacaaaataaggcttaacaaattcaaaaaaagtgaaattatatcaagcgttttttctgactgtaatagaagttgaaatcaacaacaggaggaagtttagaaactgtacagatgcatagaaattaaacaatatactcctgaacaaccaatgagccaatgaagaaattaaaagggaatttaaaaaatttcttggccgggcacgttgtctcatgcctgtaatcctagcactttgggaggccaaggcaggtgaatcatttgaggtcaggagttcaagatcagtctggccaacacagtgaaatcccgtctctactaaaagtataaaaattagctgggtgtagtggcaagcacctgtagtcccagctacttgggaggctgaggcaggagaatcacttgaactgaggaggcggaagttgcagtgagccgagatcatgccactgcactccagcctgggcgacagagcaagactccatctctaaataaatatataaataaaagtttcttaagacaaatgataatggaaatgcagtataccaaaatagcaaaagcagtccttagagggaagtatacagtaataaatgccatcattaaaaaagaagaaagatctcaaataaacaacctaactgtctacctcaaggaactaggaaaactaacacgtctcaaggaactaggaaaacaaaattgagggaaggaaagaaataataaggatcagagcaaatataaatgaaataaagacttaaaaatacaaaaaaaaaaacccaggaaacaaaagtttatttttgaaaagataaaattgacaaacctttatgcagactaagaaaataaaagagactaaataaaattagaaatgaaaaaggaatcattacaactgataccctagaaatgcagtggatcataagaaactgctatgaacaattatatgccaacaagttggataacctaggagaaatggataaatttttgaacgcatacaacctaccaagcttgagtcaagaagaaatagaaaatctgaacagactgatgttgagtagcaagattgaagcagtaataaagcctcccatcaaagaaaattcaaggacctgatggtttcactgctgaattctagaaaacatttgaagaactaatacaaattattcacaaaatattctaagaaactgaaaatgaaggaactctttcaaacccattttatgagaccagcattgtcttgatttgaaaaccaatcaaagacacaacaaaagagaaaactacagactggttttcctgatgagtatagttgtaaaaaaaataaaatactagcaataaagattcaaaagcccattaaaaaggtaattcaccattatctagaaggattcaacccaggaatgtaaagatggtttaacataagcaaatcagtaaatgtgatacatcacattaacagattgaaggataaaactatgtggtcatttcaattgatacagagagagcatgtgacagacttcatctttttgtgataaagcttccagcaaattatgttcagaaggagtatacctcaacataaacaaggctagatatgataaaaccacagctaacatcatattaaacaaggaaaatttcataataataatttttttttaaaaaaagactgatttgaataataataaagctttggtctcctgcaaaaaaaaaaaaattgaaaactttttctctgatttctggaacaagatgtggatgcttacttttaccactgctattcaatatagtcctggaaattctagccagagcagttaagcaagagaaagaaataaaaggcacccaaattaacaaggacgaaatcaagttgtccctgtttgcagacaatatgattatctatacagaaaaccctaaagactccaccaaaaactcttagaactaataaacaaattcagtaaagttgcagaatacaaaaagcaaaatgcaaaaatcagtagcatttctatacaccaataggaaactatttgaaaaatcaagaaagaaatcctatttataagtcagatgcagtggctcatgcctgtaattccaacactttcggaggctgaggcaggaggatctcttgaaggcaagagtttgagactaggctgggcaacattgggagacgttgtctctaccaaaataaaaataaaaaaattaatagggcacagtggcacccacctgtagtcccagctactcaggagactgagggaggaggattgcttgggcccaggagtttggcactggagtgaattgttattgtgccactgcactccaccctgaatgacagagtgagactctgtctttaaacaaacaaacaaacaaacaaaacacctacctaggaatatacttaaggaagtgaaagatctcttcattgaaaattataaaacattggtgaaagaaattgaagacaatataaatgaattgaaagatatatcatgttcatggatggtaagaattaatatttttaaaatgtctatactacccaaagcaatctacagattcagtgcaatttctatcaaaattccaatgacattcttcacagaaatagaaaaaaaaatttaaattcatatggagccacaaaagaccctaaataggccaagcaatcttgagcaaaaagaacaaagctggagacatcatgctacctgattcaaaatctactacaaaggtatattagccaaaacagtatggcattggcataaaaaatagacgcatagacctatggaacaaaatagagagtcccgaaataaattcaggcatttacagccaactgatgtttatgaaaggtgccaagaacacacaatggggaaagaacagttttttcagtaaatggaactgggaaaactggatagctacatgtaaaagaatgaaactaggcccctctctctctctgtatgtaagtcaattcaaaaggattaaatacttaaatgtgagacttgaaactatgaaattgctagaagaaaacacaggagaaacactgtaagtgattggtctggacaaagatttattttagacaagacctcaaaaataagagcaacaaaagcaaacataaatggatctacatcacactaaaaagctcctgcacagcaaggaaaaaatcaacaatgaagagacagcctatgacattagaaaatatttgcacattatgcattcaatagcaaaaaaccccaaatagtctgatttaaaaatgggcaaaagatctgaatagatatttctccaaagatgacatacaaatagtcaacaggtttatgataaaacgctcaacatcactatcagggaaatgcaaatcaaaaccataatgaggtattgccttactgtggttaaaatgtctattatcaaaaacacacaaaaaatgttagtgaggatgtggagaaagaagaactctcttttttttctttttattttattattgttatactttaagttttagggtacacgtgcacaacgtgcaggtttgttacatatgtatacatgtgccatgttggtgtgctgtacccattaactggtcatttagcattaggtatatctcctaatgctatccctccccctccccccaccccacaaccgtccctggtgtgtgatgttccccttcctgtgtccatgtgttctcattgttcagtttccacctatgagtgagaacatgcggtgtttggttttttgtccttgctatagtttgctgagaatgatggagtctcgctctgtctcccaggctggagtgcagtggtgccaaaaactcaaatttcatggattgactttgttcttagtagaaaatctgtttgagaggaaatttgtgaagtagcaagagaaaaaggaaagcatggtaaagttagtatttcattatataggtgtgacagctggcacccagttttctcatttggttatttaagtgagcctaaacaagttgtcagtattcaaggctataattgtacagttgggtattttggcaagtcccaaatgtgtaattcaggctgtcataagtggacaatctaataaagtacatcttaagatcataagaatgttttttatattgcttataagttagttgaggaaggattggtcttcagtgttgtttatactctttgaaggcaattttatctaaatttttatttatttatttatttatttatttattttttgagacggagtctcactgtgttgccaaggctggagtgcagcagcatgatcttggctgactgcaacctctacgtctgggttcaagcgattcccctgcctcagcctcccgagtagctgtgattacagatgtgcaccaccacgcctggctaatttttgtatttttagtagagatggggttttcccattttggccaggctggtctcgtactcttgacctcaagtgattcaccctcctcggccttccaaagtgttgggattacaggcatgagccaccgcgcccggctgagaaacaggaactcttatatgctattggtgagaaggtaagttagtacagctgttgtggaaaacagtgtggaggttccccagaaaattataaaagttaaaaaaaaactgatccggcagtctcactactggagtatttatccaaaggaaatgaaatcagtatgtcaaagagacagctggacttccatgtttatttataatagccaagatatggagtccacctaaatgtccatcagtggatgaatggataaagaaaatgtattatacatacacaataaaatactattcagtcataaaaaggatgaaatcctgttatttgggacaatatggatgagcctggagggcattatgcaaagtgtaataagccaggcagagagacacaaatactgcatgatctcactcatgtgtggaatccaaaaaattgatctcctagaagttgtgagtacaatagtggttaccagaggttggggagaatgaggagagggtagatggggagaggctggtcagtgggtacagtgttacagttaggtaagaggaataaattctgctactccgttttacagtggggtgactgtagctaactgtaacgcatcggatatttcacatagctagaacagaggattttgaatgctttcccaacaaagaaatgataaatgtttaaggtgatcatatgctaattaccgtaatatgatcattacacaatgtatacatacattaaaacatcacattgtactccataaatatgtataattattacatgtcaacaaaaataagtaaaataaaaatgcgtttaatgcagagtggctgagtgaagagctcagcaagtccacttattccaaagtgacgattaaagtggattaaactgtcaaaaacagccatttcaggactttggaaagcgactaaaattatacaacagattgagaagcaattattcacgaaaaactactgaaccttatgtctatcatattttagcccctgaggctgctcccactacgcccattttcaccactgacttactatcatggtagtttttattagggtagggcaacctgtggaaaccagtagctttgctgttgatgctagggaaggctcacttgatctggagcagagcgtggaacaaccctatgtttccacagtattgttagaaacagtagtgatttttgtagcaaaggagtgggaagctcagtcttgcaagtagcatgagattataatcctggttggggaaagctacagattggccaggattttaacatggagatctgaggaattagtggagatcctacaattatcactggtcatctggaaggctctctattatgtgcaaggctctgcacacactcaggagaaaccagagagggcctgcctaactggtcatatgtccatgttgagaccttgcacatgtacaatgcagacatgtttccagaattctgtccctaaatactttcgcttctttcttttctgttgtatgaagggaatctgtgctccaggaaatgacggatacccgattctcccacaaaatctacagtcttttcttgtcagtaagtggcggcttttaggctccaagtataggaatttataatccaacctctgtctgaccctatgttttctgtactggattattgtgatacctcaaactggtcttcctgccttccagccttgtcccctcccctggagtctgtgttccacacaccagccatattcatccttttgaaatgtgtcagatgacattattcctcttctgaaaatcctttggtggcttctcattttacttagccaaagttctgtttaccatgattcacaaaaccatacataatcttgctgtctgagttttacttttctgacctaatgttctaccactctcagcctcataaattatacacttgtccttttgctgttcttccaacaaacaaaccagatgaactgctgcctctgggctattgcacttgctcttccctctctacctggagctctttttttccaccaaataggcacatggttctttctctcccctttttccagtctttctgtgaatgctatcttcttagtgaaatcttgccagctcagtaaatagtatgaataataataaatgaatgaatgaatagcaataaagggatagtaatgtcaatgaatgtttttcttttaaaataccttaaaattattcaataatgagaaagactagaaaagcagagataacatttctggaattgcactttaaaacatcaaaaacataaaatacaattttcaattaattattcttatatatggtccaaacaggagcaagtcactgaatttttgtttttctcttaaaattttttcacttctattcttaacagtttttcactatttgatatgtcaccttgtcttttgaaatatgtattagccatcacctatataaaaaaaagctacgaaaattacagagtaggaagtaatagtttcttttcttttatagatcaggtgtttcatacattttcaatacactttattattagttctgtaattgacattttgtcaacgcaaacatcaaaagttagagctggaggtggcataaaaatgctttcctgctgtggggaattagagtattcttttatttaattattttcaacaatttgcctgtcaaagcaaaagtggaagttcaagtcattctaaattgtcttgccttagcctgtaatttaactaaaaagggatacagatttaaagttgcttttaattttctgggagagatctaaagtaaaatgaattaaggtatctttgcctatctttcaaatgctgttcaaaaaatgaagtgtgttaaagggcattaatttgaataccaataatcttagcagaaagttaagtccaccaatactgttttatgaggattattttaaaattaatttgtcacctgtatatactcccacatgttctggattgcctctgttgaagttagagagctacttggttttgcttcatctgaattttaaactggctttctgtttgttggtctcatacttgcatttatacttgtaacatggatagtaaactgcaggaagaaactatttgaagagaacaaatgtctaatacattgtgctatcctaaaggctcagttctgggttagtgtgccctggaagagggcatatttgtgtattaatttgattcatgtaacaaatatttgtgtacctgctgtatttttagcactatgcttgattctgagagatgacaaaataattctatttctgttgcttaaaagacatatgcccaagtaattttaagtgtccaggttcatggtaacattaggtaagcttaacactttgttgtaccttttaggtttagtaaaatctgcattttttgttgttgtttttgtgtttgtattggctaaaatgctatcttaaaaaaattttccccctgagttgtcatagcttttactatagaaacaagtttgcaaatgaagattcttttttgagacagggtcttactcttttgcctaggctggaatgcagtggtgtgatcatggctcactgtagccttgaactcctgggttcaagtgaacctctcattgaacctcctgcttcagcctcctgagtagttaggaccacaggcatgtgccactaccccaggctaatttttaaattttttgtatagttgagatcttcttgtgttgcccaagctggtctggaactcctgggctcaagtggtcctcctgccttggctttccaatgtgctgggattgcaggtgtgagccaccatccctggctgaaaattgtttatacttggatgaaaaggaactagaggatatagaaaagaaatgaacttttaaagaaaagataatcatatagtgcttatgtgtggcaggcactggttaaggaaatgctttttaaactttaaatgtgcacatgcattacctggagatcttgttaaaacgaagctttattttataggtcaggggtagggcctggtctgctttcctaaaaaatgtctggataccactgctcctggttacaccatggtttgagaaacaagagtttaaattgcctacctatattagctcatttaatcctcttatcaactctatatggtaggtacaattattatatccattttacaaatgaagaaatatgtttccatgcaataatcttggcatgatagatgctgtttctttaccagataatttcagtgtttataaatgtgtgtgtgtgtgtgtgtgtgtgtgtgtgtgagagagagagagaaagagagagaaagaatggaggaggaaggactttaaagtattgttgtattattgcatttttacattatgtattctgacaaattaaaatgattaaaaatatatctgataaggaagaatatttgagaaaaagtggagggagagagtgtatttgtatttgttttctattgctgcataacagattaccaaaaaaaatttagcatcttaaatcatcacacatttactagatcacagtttccatgggtcagaagtctggacatgtcttagttgagtcctctgttcagagttcagatgactgtaatcagttttgtttagggctgtagtctctttgaggcttggggtgctcttcaaagctcacatgattttggcagaattcatttcgttgcggctttagaacccacggtagcttgcatattcaaggtcagcagaaaatctcagggaagagtagaaagtagaaaggataacattttgacatttgtgaaaacaagaattacatgtgcaagcagaatatgaagtatggttatgaggcagtgtttgaggttggagaggcagactgaaagcaggccatgaagagcctccacagaaacatagaacattatggactttaattgtataaagcagtggaaaatcactggagggatttgagctaggacatagcatgagcaaagattttcgtgaggaagattaagctggaagtaagctttgtaaaatgttaacagagaagaacctgtgatatgtaagtctcatttgaggggataaaagcctgaactagggtactggccctagaaatagaaaatgactgattttaagaaaattattgacatgaaaaggtgtctgagtcagacctctctttaattgccatattcaaggactgagttctgggttagcttgccctggaagaggctatatttgtgtattaattaattttattaatttaaaaaatatttgtgtacctgctatatttttagcattatgtttgattctgagatgacaaaaagttcctttaagattgcttatattttaaataggaataaacagtttaaatcattacagaagttaaggaatactgtgaaacattgcagtttgagttgcgtttgactcaaatatagtacatgccaaatgtgtggcttagatcctaagtgctgtgggactaattaagggtattatttgggctcttgacctttttctctacagataaccagtggtatttcaaaaaacaatttaaccatgcttgagtatgatagggtctcatatcaactagactcaagcatttaatgtgaattttctcccctgtgatttgtatttgatttaaagctctgaaatacaaaatagcaatgttaaatttatgattatagtctgttaaggtttaatcttattctagcctcaatcatatgtaatcattatgtattttaaaaatacaacaacagtttcttaagagtggcaattgacagcattcaacgaaagtatcttaaattttcaggtgtctgggttgtatatcttttaccagtaaaaatcctcatgcagttttaaggagtaattgacctttgacaaagaatatattttaatcacctcctgtagcaatgtttttgtcactggagagtttattatcctgtttttaactggtggaaaatttactgaaatgtagtgttttttttttttaagtggtactattcttgaatttggtggattgaaatttgattttaacctatttagtgtatgtgggaatgatttctattatattaaattgtaaggtatatagtctggtattttattatgattaataatatttatttattgctataaatatactctcatttttaatgaaattgttcctttggaaaagtgtaatattgtacacttaaaaattctttcatatttaacatttttgaagcaaataaaatatgaattggtactctgaaaggagcctcaggttgtcaaattaggactcctgagctaagaatgggttttgcacttttaaaaggttgtaataaaaaaagaagaaaagtgtgttacagagctgaaaatatttactatttggttctttacaggaaagctggctgaccccagtagtcacagcatatttgtgaatagatttaagtatgttttatgtaattcctgaaagtctgtgaaatgtactgtatgactatacttttcttgtgtacatatcatgttactttggtacattttattatataatagattttctttggattagtgcttcaaaataaacagttcttatacaactttttacatggatagtatttataatgaagttttagcgtatttctagtagaaaatatctttaaaaaattaaagtttttttttgcattttgaaacatgcagcgcaaaaactcaaatttcatagattgactttgttcttaacagaaaatctctatgaaaggaaatttgtgaagtagcaagagaaaaagaaaagcatggtgaagctagtatttcattatacaggtgtgatggcaggcacccagttttctcatttggtcatttaagtgagcctaaacaagttgtcagtattcagggctataactgtacagttgggtattatggcaagtcccgaatgtctaattcaggctatcataagtggacagtctaataaagtacatcttaaaatcataagaatatttttttatattgcttataagttagttgaggaaggattagtcttcagtgttgttaatactgtttgaaggcaattttatctaattttttttttttgagacggagtctcactctattgcccaggctggagtgcagtggcgtgatctcagctcactgcaacctctgcttcccaggttcaattgattctcctgcctcagcctcccgagtagttgggattacagacgtgcaccaccatgcctggctaatttttgtatttttagtagagatggggttttgctatgttggctatgctgatctcgtactcctgacctcaagtgatccacccacctcagcctcccaaagtgctggaattacaggtgtgagccaccgcacccttgaatgtaaaaatattttatgaagcttaagtttcaactttatagtaaatatgagttgtgactatgactttttgtattgtatgcttttagaaaagagttaataagttttatttttaaatacttctatttggttattaaattttttaggtttagtttttcttggtgacctcttttttcttttggtgtttgcacactaatgtcaaatttagttcacttagtactttgtagatatactatttacatgatatgaaacattattaatgtaaagagacattgccaagaattaagtgaacatgtttctctttatttctttctaatttgtttaaaactcttcctttgagaagttaagaaattagttctgaattagccagtaccccatggaatgttatccttagttcttccttttctttttttcttcaacttttaagttctggggtacatgtgcacatgatttgctgaaaagatcagtctgtcacctggatatgaagcccagcatccattagctattcttcctgatactcccccttccccactccccagacaggccccagtgtgtgtttttccctgccatgtgtccatgtattctcatcgttcagcttccacttatgagaatatgcagtgtttgcttttctgttcctgcattactttgctgaggataatggcttccagctccatccatgttcctacaaaggacatgatcttgttcctttttatggctgcatagtattccatgatgtatatataccacattttatttatttagtctatcttgatgggcatttgggttgattccatgtctttgctaattgtgaatagtggtacaatgaacatacagtgcatgtatctttataatagaatgatttatattcttttgggtatatacccagtaatgggattgctgagtcacatggtatttcttcttctagatctttcgggaattgccacattgtcttccacaatggttgaaataatttctcaacagtgtaaaagcgtctcttttccttcacgaccttgccagcatctgttgtttcttgacttttaaataatcaccattctgagtgacgtgagatgatatctcattgtggttttgatttgcatttctctaatgatcagtgatgttgattttttttttcatgttagttggctgcatgaatgtcttcttttgagaagtgtctgttcatgtcccttgccactttttagtggggttttgttcttgtaaatttctttaagttcctggtagactctggatattagattgttgtcagatggatagatagttctttcttaattcatgttattttcatgtgatgataatgtgtatacaactgtccatcatttttctaacttcagtgtgataagtgcctcacttcgcaactccccaaattctgaatgctaatatgatgcatctttgccatgcttcgtgttacaaaatgttgcttgaaagatgaagattaaaattaatttataatttatcttagagacattggcaccatgctggttgtatgatttctttatcaacacttctgtaagtgttgtagaataggatggcattggataggagagaatattagaagtaggagggaagttcagtttaacaacttggatgaaaacttgaccgcttactcatgtattttattgacattgttcagagtacatgttttgcacagatgttttatttaaaatccctgaagtttgaactgaaatggaacttttcctgtccattaaaatccttttttctacttaatgtaattcatagaataattgggaattgggtgaaaatctttgatttctaaagttttaagctattaaaaaatttcattcttatctttgtttttcaaggcaaataattatcttatgacctgaagatttgttttgcttaatgaaatgtgtttcaaaaggagagaaatcttacatatctacatgcaaagtagtcgtattctgaaaaaagttacacactgatacttatctgaaggttggaaggcttaatttaagtatctttcttgataagtacaaccagcctttaaatgatggataactgaactctgtacttgaagggtcagtggagctggctaaatgttacagtttttcatagaaatttgacttaatttttaaaatctttcaatttatgtgtaagtatattttcctaggtggttcagtaaagcgtgtgttttaaaagattgtctagatgcagcatgctaaaagagggaggtaagaatgtttattcattatggctacagtttaatatgttaatatgtttaatacatattaaacattaacattttaacattttaatcaataacattttaaatggtagcctaataaagagaggggattggtcagaaacaggatagagttcttattgttgttgactaatgataaaccaaatgcaatagaaaatccccaagtggattttctctgagataaactgataatataatagcattttctatttttccctagtaagtattgttgatggttgtcagttcgtttttcccaagcacatgaattagctaacgtgattctctgtactaatcttagtttttgactgagaatatcatgtacttaaccaaatctttgagatatttaaataaattaacaaaactgtaaaaatcatctttgtaaagctagtcactgatttatgatttgggaagataagcagctttgtattacttagaaaacaaagaaaaatatgtagaatttctgttttttcttttttattgtttaaaaatttaaatcaacatcagtgtgcagatgggtagataaaataaaaatttaaatcaacagatgtaaaatggaccattcctcttccctgcccaccaattctaattctcagaagaatttttttttttttttttgagatggagtcttgcttgttgcccaggctggagtgcagtagtgccctctcggctcactgcaacttccgactcctgggttcaagtgattctccttcctcagcctcctgagtagctgggactacaggcacgtgccaccatgcccagctaatttttgtatttttagtagagacagggtttcaccatgttggccaggatggtcttgatcttttgacctcaggtgatctgcctgccttggcctcccaaagtgctgggattacaggcatgagccactgcacctagccagaaattttttttaacagtttatgtattgttttccaagaggaatattctttatatcctgcttggcaacttgtttttcacctcaaacaatgttatgaacactacattaaacgatttctccctctttaattgcacagtattctgtggtgtggatatagcataattttatttttccatttctcttttgagggtcctataatcattttccctttttatttcctgctattacaaatatacaaatagtatgtactctgaaacacaaacacatatctggaattgaaattgttgtggtatggagatctgtttttgtataggtagtaccaaatttctgtccagaaagattgcaaatatatgccctttcctattgtgtatctgagtaccctttgtctcataaatttgccaacagtagatattatgtcttttcaatttttaccactctagttcacaataaatatctcattttgtttacatttccctgattacaagtgaggcttagcaagttttaaatatttatcgggctaatacatttgattttttaggtagcctatatgctgtaaaacctcattaagaactgctctttctgtcagagatttaatttgacaatacctatagtcaaattttaaaaatctgattgggttcattagtctgcctgcatattagtctaaaagaaagtcagaaaagtaggggaagagccatgaaaaatcattccttctttcccttcaaaaggagtgggtactccttttggatttttatctgttaagcagtctatattgttttgggctctcagcacattatagatttacagatcaaaattactaggaaaaccagaaataatccatcctgtttgaggggaggggatttgtgctttcccctagaagtctcttcctttctcttagatgtttattgagtgtcttctctgccagcactgtagctgtgtagctgctggccatttaggcctgtttcatccctgactgacagcagctttacttggtgtggtggcaataaatcaaatcaaaatgtagtgccattagagtaagacatcttaatcatgtttcaactgacctaagaaatttaaatgttctggaggatgatctctagtgagagctggagaccttatagtttgtcaggaatgttaaggtatatagggtgtctaaaagcatatagtacttgaaacttattttcgtggtgatctctggagaatgctctctgtaatgataataacaacaataggagttagcttttattgagcatttacacctgcctgggattactgtcagcattttacatctgttctgcatagtgtgaggaagtactttctggcctttggactttcgttctcataagtagttgtagaaggtctgcggctacacaaagtctacttctttagggaccttgtgtctaggagtgcttgtatagccattttaccctcttttgctgcctatttagtgattaggattcagactaaaaaaatgatttagtgattaccttggtgtgatcattcacacatcatggtgatagtgatacagctgcatattttcagtgaatctttgaattagaagagatagagtcatctactgcttccctttttctgaaatagaatccctataataccttgtgagtgcactggccactgtggaaacaggctgagtgactgattcacaatggaattaattccactttctagttattaataataaggaaaatatgtatgaaacactttgtgaattatccacttaccagaagctttttaacttgatgtgatcccttttgtccatttttgccttggttgcctgtgcttctgggggtattactcaataaattgttgcccagaccaatgtcctcgagagtttccccaatgttttcttattgtagcttcataggttttggtcttagatttaaatctttaatccattttgatttgacttttgtatatggtgagaggtgcctagtttcatccctctgcatatggatattcaattttcccagcaccatttattgaagagactgtcctttcttcaatgtatgttcttggcacctttgtcaaaaaagagttcactatagacatatggatttatttctgtgtcctctcttctgttccattggtctacatgtcttttatttaatgccaaccccatgctgttttggttgctatagctctttagtataatttgaagtcaggtaatgtgattcttccagttttgttctttttgcttaggatggccatggctagtctgagtcttttgtgattccatataaattttaggattgttttttctatttctgtgaagtatgtcattggtattttaaaagggattacattaaatctgtagagtgctttgggtaatatggacattttaacaatattgattcttccagtgcgtgaacgtggaatatctttttattttttggtgtcctctttgatttctttcatcagtattttatagttttcattatagaggtctttcgcttgtttggttaagttaattcataggtatttaattattttttagattgtttgctcttgacttacagaaatgctactgattttttatgttgatttttgcattctgcattttactgaatttatcagtttgaatagtttttttggtagagtctttagtttttccaaatataagatcgtatcatctccaaagaaagataattggcttcttccttttcaatttgagtgccctttatacctttcttttgtgtaattgctctggctaggactttcagtactatgtcgaataactgtggtaaagttgggcttccttgttgtgttccactatcttagaggaaagactttcagttttcacccattcacagtgatactagctgtgggtcttttgtatatggattttattgtgttgagatatgttgcttctgtatccagtttttttttgaggggttttatcatgaagggattttgaagtttatcaaaattttttaagcatcaattgaaatgctcatatggtctttgtccttcattctgttgataatgtatcagattgattgatttgtgtatgttgaatcatacttttatctcgaggataaatcccaattggtcatgatgaatgatctttttaatgtgttgctgagtttggtttgcctagcattttgttgaggatttttgcataattgttcaacaggaatattggcctataattttcttttttaaatgtgtttttggttttggcatcaggacaatactggccttgtagaatgagtttggaagtattcctttctcctcctttttttgaaatagttccaatgggattgatattaattcttctttaaatgttgggtaaagttcagtgatgaagccatcagatcctggacttttctttgctgaagactttttaattacgactttgatctcattacttcttattggtctattcaggttttggatttcttcatggttctatcttggtaagttgtctgtgtctgggaatttatccatttattctaagttttacaatgtattgacacgtagctgctcatagaagtctctaataattcttcaaatatctgcagtattggttgtaatgtcttctttttatctctgatttcatttatttggggcttctctttttttttcttagtctgtataaagttctatcaattttgtttatcttttaaaaaataacttgtcattttgttgatcttttgcatttttttcatttatttctggtgtgatatttattatttcttttttttctcctaattttaggtttgatttgttcttgcttttctagttctttaagttgcatcgttaggttgtttgatgttttttctacttttttgatgtaggtgcttatagctataaactttccttttagtactgcatttgctgtatcccataggttttagtatgttctgttttcattttcatttgtttcaataaattttaaaatttccttcttaatttcttcattgactcactggtcattcaggaggaagttgtctaatttccatgtgtttgtatagttcccaaagttcctcttgatttttagttttatttagttgtgggcagagaagacacttgatataatttcagtttttaaaataaatttaatacttttttttggcctaactgatgacctatccttgtgaatgatccatgagctgaggagaagaatgtatattctgtagccactggatcaaatgttctacaaatgtctgttaggtctatttggactgtggtgcagattaagttccatgtttctttatttactttctgtgtggatgatctgttcattgctgaaagtggagtgttgaagtctctagctattgcattggggctgatctctttctttagttctaatatttggtttatatatctgggtgctccaatgttgggtgcatatatatttacaatcattatattctgttgctgaattgacccctttatcattacatagtgacccctctttgtgtgtgtgtgtgtgtgtgtgtgtgtgtttttttctttgagactgagtcttgctctgtcacccagactggagtgcagtggtgcgatcttggctcactgcaagctccacctgccgggttcacaccattctcctgcctctgcctcctgagtagctgggactacaggcacccgcctccacacctggctaatttttttgtattttttagtggagatgcggtttcaccgtgttagccaggatggtctcgatctcctgacctcatgatctgcccgcctcggcctcccagagtgctaggattacaggcgtgagccatacagtttttctcttgaaatctgttttgtctaattatagctcctcctgttctttgtggcttccatttgcatgggatatcttttctatccctttattttcagtctgttttgtgtttttacaggtgatgtttatttcttgtaggcaacagatcattgggtcttattttttaaatccatttagccactctatgtgtttttattggagagtttagtccatttacattctgtattattattgataaatgaggacttattcctgacattttgttatttgttttcttgttgttttgtagtattctctttcttcctatcttcctttctgtgaaggttattttttttggtggtgtgctttgagtttttgctttttattttttgtgatcttttgtatgttttttgacttgagttaccctgaagcttgtaaataatatcttataacccactattttaaactgatgacagcttaacactgattgcaacaacaaacatactattaggttggtgcaaaagtaatcgcagtttttgccattactttcaatagcaaaaactgtgattacttttgcaccaacctagtaacaaacaagcaaaaagaaaactaataaaaaatccacactttaccttcatttgccccacttctaaactttttgttgtttctatttattttttatttatttatttattttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaagacagaggaatttttcttagtgcagaacaaaatgaaaagtctcccatgtctacctctttctacacagacacggcaaccatccgatttcccaatcctttccccgcctttcccgcctttctattccacaaagccgccattgtcatcctggcccgttctcaatgagctgttgggcacacctcccagacggggtggtggccgggcagaggcgcccctcacctcccggacagggcggctggccgggcggggggggggctgaccccccccacctccctccaagacggggcggctggccgggcggggggctgacacccccacctcccggacggggcggctggccgggcagaggggctcctcacttcccagtaggggcggccgggcagaggcgcccctcacctcccggacggggcggctggccgggcgggggggctgacccctcccacctccctcccggacggggcggctggccgggcagaggggctcctcacttcccagtaggggcggccgggcagaggcgcccctcacctcccggatggggccactggccgggcaggggggctgaccccccccacctccctcccggacggggcggctggccgggtggggggctgacccccccacctccctcccggacgaggcggctggccgggcgtggggctgacccccccacctccctcccagacagggcggctggccgggcagaggggctcctcacttcccagtaggggcggccgggcagaggcgcccctcacctcccggacggggccactggccgggcaggggggctgaccccccccacctccctcccggatggggcggctggccgggtggggggctgacccccccacctccctcccggacgaggcggctggccgggcgtggggctgacacccccacctccctcccggacagggcggctggccgggcggggggctgacccccccacctccctcccagacggggcggctggccgggcagaggggctcctcacttcccagtaggggcggccgggcagaggcgcccctcacctcccagacggggcggctggccgggcggggcgctgacccccccacctccctcctggatggggcggctggccaggtggggggctgacccccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggctgggcggggggctgacccccccacctccctcccggacggcacggctggccgggtgggggggctgaccccccacctccctcccggatggggcggctggccgggcggggggctgaccccccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggctgccgggcagagacgctcctcacttcctagatgtgatggcggctgggaagaggcgctcctcacttcctagatgggatggcggccgggcagagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccagtcaggcgtggcggcgcgtgcctgcaatcgcaggcattcggcagactgaggcaggagaatcaggcagggaggttgcagtgagccgagatggcagcagtacagtccagcttcggctccgcatgagagggagaccgtggggggagggggagggggagggggagggggaggggttgtttctatttatatcttattatcttgtctaactcttgaaaagttgtagttatttttaacaggttcatctttctacccaaaatgtgagtagtttactagtttacaaagcacaattatagtgttatcattttctgtgtttgtgtacttactattactagtgagttttgtatcctcagataatttcttattgttcattaatgtccttttccttcagattgaagaactccctttagcatttcttgtcggacaggtctggtgttgataaaatctctctgtttttgttgatctgtgcaagactttatttctgcttcatgttggaaggctattttcactgaatatactatcctaagattttttttttcctccagcactttaaaatgtcatggcactctctcctgtcctgtaaggtttccactgagaagtctgcttgccagacatattgcagctccattgtatgttgtttctttattcctgctgcatttaggatcctttctttattcttgacctttgggtgttagattgacctctgggtgttatacaaccttgacctttgggtgttttgacctttgggtgttagacaaccttaaggttgtcttctttgagttaaatctgcttggtgttctataacctttttatacttgaatatttttatctttctctacgtttgggaagttctctgtgtgttttttttgttttgttttgttttgttttgtttgagatggagtcttgctctgtggcccaggctggagtgcagtggtgccatctcggctcactgcaagctccacctcccgggttcatgccattctcttgcctcagcctcccaggtagctgggattacaggcgccggccaccacacctggctaatttttttgcttttgtatttttagtagagacagggtttcactgtgttagccaggatggtctcaatctcctgacctcatgatccgcctgcctcggactcccaaagtgctgggattacaggcgtgagccaccacgcccggccgggaagtactctgttattatccctttgaatacacattctgcaactgatctctctctctctctgcctcctctttaaggataattactcttaaatttgcccttttgaagctattttctagaccttgtagttatggtgcattcttttttattctttttttcttttatctcttctaattgtgtgttttcaaataggctgtcttcaaggtgactaattctttcttctgcttgatcaattctggtgttgaaagactatgattcattcttcagtatgtcagttgaatttttcagctccagaatttttgcttgattttaaaaaaataatttcagtctctttgttaaatttatatgatatgattctgaattctttctctttgttatcttgaatttctttgaactttctcagagcagctatttcgaattctctatttgaaaggtcacatatctctgttacttttggattgattgctagtgcttcatttagttcatttgggagttgatgatttcctggatgatcttaattcttgtggatgtttgttgggtgtctgaacattgaagagttaggtatttattgtagtcttcaagtttggatttatttgtaccagttcttcctgggaaggctttccatgtattcaatgggaattgagtgttgtgagttaagtctttggtcactgcaggtatatctgcgttagagggcaccccaagccatgtaatgatccttgtggaattttagaggtacctctttggtggtcttcggtaagatccaggaaaattctttgtattagcaggcagagactcttgttctcttcctttactcttctccaaagagattctctctctgtgtgctgagctacctggtgtttggggaggggtgacacaaccatttctgtggccaccacctttgggactgttctttatcagacctgaagccagcatagcacaggatctcatccatggcctgtggctctattgcctggctactgctgatgtttattttaggcccaagtgctcttcattcagcaggtgatgaatcctaccaagagtggattcccttttcccttttgacctagagtgtgtcgtgaaatgttatctgagagcgagggcctggaatgggggcttcaggactctgcttggtgctttattttactattgctcagctggtatttaagttccaggacaaagtcctctttactctcccctcttatttcctcaaattggaaggagtatccaccaaagctgcaagctgtgctgcctagaattacaggaatggtgacataagcactcccttggctgccctacctagtgtctatctagatcacttgcacctcatgtctccttgctccaagcccagcatagcaccaggacttccccagggattacagtccttgtggcctagactgcttttcaagtttatttaggacccctaataaagtttcaagtttataaggacccagagtgctttagcccgtggtggtgggtctacctggaactcactgactgctgggatttcctcttgctagggctggtctaaatgctccctcctttggcatgggctgaattttgtcctgtgttactttctgctgtaatagggcagcagtgagttccaatgcaaagtttcacagtcactgtgctctgtcttccccaagtacatggattctgtctctgcaacacacaggcactatccagggatgagggagtgatggtgtaggcagttcaagaccatcttttttcctcactgcagtgcctctttctttgatagctactctttctttaccatgtctggtattcgaatttgctcagtaactcattttggttcttttcagcagtacaaatagactttaggaggggattatacaaaaatctgaatggagatatgaatgtggtctcactgttacttccttgactatctgatttcatgttgttgttttggctagtattgtgggcatttctcttttattattgctttgtattcttccttttagaattccatgcttggttgaagacagtgatctgcccagttagagatgggctctaacatctaacatctaacagatgttaacaagcttctttttcatccattagttacgtttgagctatcttgatgggttctttcttctcttccaccactttgcttcttttttttttaaattcaatttaatttttattaattttattaattaattaatttttaccttgcagctccagctcaaaggaagctttgcttctagtcacctccaacacttgcttaatttttttattctaattgattggctgccttataagaagctgttctttgaataatatgtttaaaactaattctttctgtagctatttatgtatgttctttcctatcatctgcaaagtgcttctctcctttgccacttcacaatttactttaaaaaaagagtcatagataataaattcaaatagatattcctaagttactgaatgatagccatatgctacccttatgattaagaaagcattttcctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaaattttgtataaggtgtaaggaagggatccagtttcaactttctacatatggctagccagttttcccagcaccatttattaaatagggactcctttcctcatttcttctttttgtcaggtttgtcaaagatcagatggttgtagataaggatgtggagaaataggaacacttttacactgttggtgggactgtaaactagttcaaccattgtggaagtcagtgtggtgattcctcagggatctagaactagaaataccatttgacccagccatcccattactgggtatatacccagaggattataaatcatactgctataaagacacatgcacatgtatgtttattgcggcactattcacaatagcaaagacttggaaccaacccaaatgtccaaccgctatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacactgcatgttctcactcataggtgggaattgaacaatgagaacacgtggacacaggaaggggaacatcacactctggggactgttgtggggtggggggagtggggagggatagcattaggagatatacctaatgctaaatgacgaattaatgggtgcagcacaccaacatggcacatgtatacatatgtaactaacctgcacattgtgcacatgtaccctaaaacttaaaagtataataataataaaatttaaaaaaaaaagaaagcattttccttaatattgttagctgttcttcagataagatgtttgactgccctaggtctcgagtatttttgacgggtttcaatgattaatgatacgtttttattaatcacttatgcttagcaactgcagggattttttaattaaaaacttgttattagattcagaatgacagtgatgatgcttaagttgggaaagaaatcatttgagttgtggtcttttctaccttgaatcttctctctgtaataaatcaccctgcttttgacagtgggaaatgttataatatttaagaaattaaagatgatttgtgttagctttaatggtttacatttgtatgtcagcttttctgtagaacaagtatagtattctgattctgtcatttgagaaacgagagattatattgcatttaaggtcatacacatgtggttttggtctttcacagttcaggatgacctaatttacatggaggtaatgaaaatagatcacttttatattattctagttagacaagtatcattattaccttttcagatctgtgcttcttcctacaggtttgcatgattaataaggttttgggtttttttcccctggtgtggttagaggaaagtttatagaacctattgttgcctatattattttaagcaaggatttgtttactaaaaacagtaaaattaagagaaaaatctctgaataccttcaatcacaacattttatttgtgttctacttggtagcttttaaagtaattctctggttaaaaaaagaaaaaaaatgagattttgtgtgttttcaccccaattttgtgatttatttttaactttatttgaaaacaaaaaagaattgtgtgtatagatatttcttttataatgtcaattaatactgattctgaaaatttccttttattattaggatgaaaaacattgctaatagaaacacaattttttttttcaaagcagagagtgaccaaagttgagagaaacagccctgaaattattttgattgaagtatcatacatatttattttgtttgatctaaaaatttacatctattgtatcctattttggtgttgcacaattagctactgatctctgcatgttaaaaatcagtggataataagagataaaacaaactgggaatgtgtttttagttacctttgaagtgataggcataaaacagaagactcaataacaataatagtaattcaaagaatgacagctaacacttggtactactgtgtgtcagttactatgtttagtacttcatatatattttcatttaatttttacaacactatgtaattgagagtattatttccattgagcacatgtttagattgaagaaagtggtagtcctactgtatgggtctgatgacatcttgtatactctgtgtagtactggtttttgaaggataacagtaaactgcagtagatgaggaaaatgttcatgaaagggagttgaagttaggcatattaaaggagacttcaccaaattctgctccctaagttaagcgtagtctctcagagatctcttctaatgttaaaatttatagaggaagttgggactgctagttaagaatgttttaacttccattcttaacatcttcatactttcccaaagtctcagtcaaaagataaagtgtcctcttgatcagtcacatccccaaatctgggcactttcatattcttaaggaatgtacacaattctttgtctttgtctctctattgtttttcctcaccctaagcgtgtgaacatattccaaaaataaagcactaataaaaaaattcttttatttatttcacattcgagtgtcatgtactagaagctactatataaagacaaataagatatagtcccagcactcaaagagcctggcttctaggaaagagaaaagacatgtaaacatgaatgttgtagatattaaacacacaagtaaataaaaccaaacatgttttcattaaagttttatatgtattatagtagaagtctacataggagcaaaaaggaaggactggccagttttccaggaaatggaggttgataaagggagcataaggcttgaattgactctgcaattctctttagctatattaacctgtctctcatctttctatatttcctgagttgggtaaagaaaagtatacatttaatgtctccactttcctctcatgtattcctcaaacctgtgccagtaggcattcaagtttgttaaatgataatggcttatgatagctaacatttatagagctcttgccctttgccaggcaccctaataacatgtttcacatatagtaacttgcttatttcttacagccactctctaagataagtactgttatcgtccccatgttagatacagacaactgaagcacagagaggttaaataccttgaccagtatcacaactaataactgttggaactgggcttcaaatctaggccgtttggctttgggacctatgcattatgagtgactggcgaacaaaattctctaaaaaggaattcgaggaaaagagacttttttttttttccagtgaacagtttgcaaaccagggaaacatagccttcggtgtaaaatgaagaatgcatttcagagaacaaagagaaggtttggattttatagaaaaatatgcttcccaaattcccaatcaggtccatttatgcaaatgaaagatttaaattcatgtagttccaaatagttggcacagtggagttctgagtcgttgctacaactgagccctcattggctgtggcaggtgagtcctgattggttgatttccaagctctaaaccagagatctctgtcagatgtttctttcaaatggctggcgggtggtgtagggtttttggtttatttatcttggcacagacatcaggaactggtttggcttgattgtagaaagggagggcctgtgacactttcacatctttctgagaacacagagtacgtgactgcttcttcacccaggatggcctcctggttctgttttactttgagcatctcagccacagggagtccattttgtctgttggataggggtatactttaacagactgaatgaacctagttgccttttacccatgtctgcacacaaatgcttatatactaaagttcatttatttccaaggcatacatttttcctagttttaatggattttcctttgtcctctcccttcactcattcaggaaattttgaatactcttatggccaagtactaatctagcattggaaatacagaaataaaagtggccactactatcacgaagctcatagtatgatgggagaaaatgtagaggaaaattataattataatatgacgtgctaagtgctatgatggtatgggcctaggggggcagtatttaacccagccagaagagggtaacccctaacctgaattatgatggaaaagtaggatttagctaagcctctttctattatttgtcctccctatttttttctatgtataatgggatacagttgctttttcaaaaccttcaattacccctttacgtatctgcacggttgcattgttccttctgttatcttctttgtcatgttctacttgcaagccttctcggtgtgtcttttactgtactttggtctccagtgtctttttcattcttatttcctttttagtttattcatcctatctagaaacttgtcttatctgctacagtaggaaatttaatttacttttcttcagctcctttcttcctctctggcaggctgccaagtgtttaaaacactcatgattattggtttcttcagagaggaagatagatctgggtcatacgcttgatgtcactgggatattcatttcatttttgttctttctgggcatcaaggggaattttaccccttgaagtctctcaattaaatcttgcccccaatttactgtttcttgggcatgttcctttaatgcgcctagcttttctatttttggcatgagtgcccaacatttactggatattggcacttggcacacagactggtgtctgctgaatgccagatatagccttctttacaaaacatgatgggaaaaattatgagggaaggtagtatttgactctggattcaaacacaggttgaattctaaccttttatcatttattagcacggtaaccttgggcaagttacttaacctctctctgcctcaattttctcatttttaaaatgggcaaactaatagtgactacctcattaggtttttagaggattaaatagattaatgcctttaaaattgagaacagtgagtggaatatagataaaaaaggaagacatttcataagtgcctggggttcccagcctctttggccaagtactgtttttccatccaactgtttggcccctgatttgcttttacctctcccttacttgttcatcagggatctggttttacttcaaattgtgcttattatcttttattttcctgtggttctcctctgctaatctaggtttttatagttctaatatccttttgtagtggaaaataatttgggagattgacaggaagacaataattgttgttaacagtgagattttatggcacatcgttggggtttatagtaataggtttttgtttcatatagcaatagggattgttcaaaagttaaaatttttttttgccatgcttatcattatgcatacttataagagattagaatatttcagaaatataaaactcagaaataaaagaagtattctctaagtatttagtgcttgctatgtgataagatactgttggaggtactgaaacataattgctattaatagtttggcattatttcttacagtttttttaaaaagatctgtatagtcataaaagttatgttatttatgaaaataagaatgataatgttttgttttgcaggaaaagtcaacactaataatatgctctagagaaactaacgcttacttagatgtttttaacattatagtaaactaatatgccgagcttcaaaatgacccaacatataacttgtagctgggatattttggtgcatttggcattatactgtaatttacagtatacaacatctgaggacttttagcagtatcttggcacaacagactgactcctcccatcccatcagaggtggagggaggaactcttttctccccataaattcttgatttttaattaattaattaactagtttttctagttttcatctcctctcttaatattggactttgatatttaccttttttattcatttaatttattttttaaaaatgttttggccagatgtggtggctcacgcctgtaatcccagcactttgggaggccaaggcaggtggatcacaaggtcaggagattgaggccatcctggctaacacggtgaaacgccgtctctactaaaaaatacaaaaaattagctgggcatggtggtgagtgcttgtagtcccagctactcgggaggctgaggcaggagaatggcatgaacccgggaggcagagcttgcagtgagccgagatggcaccattgcacacattggtctctgtgtcttttttcatgcaagtcccatgctgttttggttactgtagctctgtggtataatttgaagtcagtaatgtgattgctccagttttgtttttttttttttttgctcagaatggctttgactattctgagtctattgtgatttcatataaattttaacatgttttttctatttctgtgaagaatgtcattggtattttggtagggattacattgaatctgtagattgctttgggtagtctggacatttaaatgatattgattcttccaatccatgaacatgaaatatatttgtattttttggcatccttttcagttttttcattggcattttatagtttttattatagagatctttcacttctttggttaagttaatttgtatgtatttaattttatttgtagctattataaatgggattacttttttgatttcctttttaaattgttcactgttggcatatagaaatgctactgatttttgtatgtttattttgtatcctgaaactttattgaatttatcagttctagtggtttttttagtggagacttcagttttttccaagcataagatcgtatcatctgcaagcaagtttaatgtgacttcttccttttcagtatgaatgccctttatttttacttttttaaaaaatacttttattctaagttctgtggtacatgtgcagattgttacataggtaaatgtgtgtcatgggggtttgttgtacagattatttaatcatccaggtattaagtctagtaccctttaattacttttcctgatcctctgcctcctctcaccctcagccatccgatagaccctagtgtgtattgttcccctctgtgtgcccatgtgttctcaccattcagctcccacttacaagtgagaacatgcactattcagttttctgttcctgcgttagtttgctaaggatgatggtctccatctccatccatgtccctgcaaaggacatgatctcattttttttatggctacatattattccattgtgtgtatgtgccacattttctttatccagtctatcattgatgggcatttaggttgatttcatgtctttgctattgtgaatcgttttgcagtgaacatccgtgtgcatgtgtctttataatagaacaatttatatttctttgggtatacccagtaatgggattgctgggtcaaatggtatttctgtctttaggtctttgaggaatcgccacactgtcttccacaaaggcagaactaacttacactcccaccaacagtgtataagcatttctttttctccacaaccttgccagcatgtgttatttttgactttttaataatagccattctgactggtgtgaaatggtatctcattgtggttttgatttgcatttctctaatgatcagtgttgttgaggtttctttcattgattcttggccccatgtatgtctttttttgagagatgttcgttcatgtcctttgcccactttttaatggggttgtttttctcttgtaaatttatttaagttccttatagatgctggatattagacttttgtcagatgcataaattgcaaaaatgttctcccattctgtaaattgtctgtttactctgttgatagtgttttgttgttgttgtttttgctgtgccagaagctctttagtttaattagataccatttatcaatttttgcttctgttgcagttgcttttggcatcttcatcatgaaatatttgtgccgatgtctcgaatggtattgctgaggttgttttcaaggatttttatagttttgggttttacatttaagtcaataatctatcttgagttgatttttgtgcatggtgtaaggaaggggtccagttttaatcttctgcatatggctagccagttatcccagtgccatttattgaatagggaatcgtttccccattgcttgtttttgtcaggtttgttgcagatagttgtagatgtgtggtcttattcttgggttctctattctgttccattggtctatgtgtctgttcttatatcagtgccatgctgtcttggttaccatagccctgtagtatagtttgaagtaatgtagcatgatgtctccagctttgtttctttttgcttaggattgccttggctattcaagcttttctggggttccatatgaattttaaaatagtttttttgtagttctttgaagaatgtcaatggtagtttaatagaaatagcattgaatatgtaaattgcactgggcagtttggccattttcacaatattgcttcttcctgtatatgagcatggaatgtttttcatttgttttttcatctctgatttctttgagcagtggtttgtagttctccttgtagagatctttcatttccctagttagctgtattcctaggttgaatgtcctttatttctttctcttgtatgactgctttagctagaactttcagtactttgttggttaacagtggtgacagtgggcatccttgttttgttctagatcttagaggaaagactttcagtttttccccattcagtatgatactagctgtgggtctgtcatatttggcttttgttatattgaggtatatttcttctatccccattttttgagggtttttattatgaaggaatgatgaagtttattgagtgctttttcagcattaattgaaatgctcatatggtttttgtacttcattctgttgatatgatggatcacattgatttatttgcatatgtcaaaccattcttacatcccagggataaatcccatttggtcatgatgaatgattcttttaatgtattgttgaattcatgtttgcttgtattttgttgccaattttggatcagtgtacatcactgatattggcctacagtttcccttttttgatatgtcttttggtatcagggtaatactgaccttctagagtaagtctggaagtattccctcttcctctgtttttcagaatagtttgagtaggattggtattagttctttaaatatttgatagagttcaacagtgaagccatcaagtctcaagttattctttacttagaggctttattacgacttcgatcttgttacttattattgttctgttcagcttttggatttcctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggcctggatttcttcatggttcaatgttggtaggttgtatatgtctaggaatttattaatttcttctagatttttccatttattggcatatggttgctcatagtagccacaaatgatcctttgaatttcttcagtatccattgtaatgtctcttttttatctccaattttatttattttggattgtgctgggtcacccctgaaacgagcatgtctcagagcccaaggtcaatggtgtactccatgggtatcagtggtggttgttcagggcccaagagttctttagttggcagatgataaatgcttccaggactgggttcttccctcaaggcagtgggatccttttcggcccagggtgtgtctagaaatgttatccaggagctggggcctggaattgaggcctcacgactctgcccattaccttattctactgtgagtgacctggtgtccaagatgcaagacagagtcctctttactctttgctgtcctctccttaagcagaaagaaggagacactttcatgctgggagcttcactgcctggagttgggggagtggtgacgcaagcactcccttaaccatgctagctggtgacttcgtcctttgttatatgtgagagtgactctttgttttctcaggatcccaaagtgctcattcaaagccatctctgtctgttttccaacactgtttatgtcaaattgtaggagaacacccgttggaactttctttacattctcttgctgccgtgttttaaagaatgaaggtacagcagtatgaattaatcatggtttctcagttgctgggcacctgccaccctatttcactagctctaagccaaggctagtgctaggagttgcctaggaattgcagtctttgcattctagatgcctttcaagtttacctaggatcccagagcatttcagcccgcagtgttgaggcttgctgagcaactcaagttccatctgctgcgatggatgtttccctgctggctagggctggtccaaatgctccctctgtgtgtgggagctagctgaacctaggatggctctatcctccgctgtgacagggcagcagtgaattcaatgtgaagtcccccagttgctgtgttccttatccccaaagtgtacaaattgcctttctgcaccacacggtggctgctgagggatgtgggtggggtggtatcagcaactcatgactgtctctccatccttcctcaatgcctcttttggtaatacaaagttaaaaccatgcgctgtgattgctcacctgatgtttggttcttatgacagtgtttttctttgtgcagatggttgttaaaatttggtgttccagggagtgtgggggtgtgattggtgtaggcttctattctgccatcttactctgccctctgaactttaatttataccataccagaaatcagagtgaaggtaaacaacaaggttacaatgtaactctattataaattttgatttttttttggtgacaaataccagtatatttttgtctttggatctataaattatttaatttagcaaactctaaagcttataaaatttaacttctcaagaagtctagcactttatggctattaattttactatcaaaatatccaggttactgaattcattttaataattataattcttctaaacatcatttgaagaattatttgtggacactagactcaagactacactaaatccaaacagtatacctaggacctgagttttgagtttttcatctcagttatctgtccttcaagttactacttcctcttatgctttcttttactaaccaaattttcagatttttacattggaccttctcctccaaggccctatgggacaactttgtaaatatgcatttacagcctttaaacaccaacattttaaactgagactaattcctgcaaccacatttcttgttaaaagttcagcactaggctgggcacggtggctcatgcctgtaatcccagcactttgggaggctgaggtggacagatcacttgaggtcaggagtttgagacccacctggccaaaatggtgaaacctcatctctactaaaaatataaaaaaaaaattagccgggtttggtggcgggcccctgtagtcccagctacttcggaggctgagacaggagaatcacttgaacccagaaggtgaaggttgcagtgagccgagatggtgccactgcactccagcctgggtgacagagccagactccgtctccaggaaaaaaaaaaaaaaaaaaaaaaaaaaaaagaagtttagcactaacagtatctttctgccattttcttctgctcaaggaactaaagaagtcaaacagataatggttctgcctgagccatttgtgaagtctaagaacagttacgtatactccctgttattctttcagggcattattttatccttttttttaaaccttgaaaaataggtgttacttagccttataaaattttgaagtaaagtttctgaatttctgtgaagaactcttcaagcaattcagcttttcaaacacagtcgtcacacaatagtccctgtaacatgggatttattccacagttaaaaagtgacttcctcctttgttatatgtgagagtggctgtttgttttctcaggatcccaaagtgctcattcaaagccatctctgtctgttttccaacactatttatgtcaaattgtaggggaacacccgttggaactttctttacattctcttgctgccgtgttttaaagaatgaaggtatagcagtatgaattaatcatggtttctcagttgctgggcattgtactgctccagggttatcaatagatacagtcagattcctgcgtttgtgatagatgtctggcattgactagttctctttgctactacatctagcagttgttccgtgttcaactgggcctgaaccttcttcaggcctcttccgaaaagaaaagttacctgtgaagtgtctttctgatggcttaatttatttcctctcctggtaaaactggacataatgttattttttctgtttagctggttaggtctcttgagaactgcaactggtttcctatgcacttcattttgtttcagaaggcttgcctttctttttaacactggaaaatagtgttctgtattcttgtcacttagacgtggacaatacatacataggactaattccttttccaattccagatgattttctaactgcaagtccagtgattatccataaggatgtctctttccaggcattactcttcctctgcagcttagactggttttaccaaaaccagaattctgttggagtacccattgtattctcatcctaaattgctggagtcttctgtttagttttggaaaattctgcttttttcctttctttcaattcagtttgatgacaccagccaaagacataccaattttgtcaaggtgtttgttgctgcgagctttcagcagctgtgacaaggtcactgtggcttctaccaactgggtaccaaactggttcatggctggaaatgtggtgctagaacagtcagtgcggaaggccagagttggaggcctgccatctctcatgcacacacgcaagcagactgccgggcagcatccttgtcctcccacccgtggttgccagcatagaccaatttatcccattcctttaaattacttgatagtgttctctggaatactcttgaatataccataatttagttagtaaaacatattgatggattgctgatagttcagtttcttactattacaagcagtgatacactaagaatcctgttacaaatatgtctttcgagtatgtgtttctggagaataaatttgatcaaatgatatattaacttagcatcttaataaattcaaaaagattgttcttatttaaacatcagccttcttacctgtttccttatgcttttaggaaaactaggtattatcaatttttatactctctgtcaatgtaattggtagatacgtttcattgttttaatttgcatttaaaagattcatgaaatggggttttctataacatttttattttagtcatgttttacatattgtgacctgtactgtgtcgatatccttagctcagttttctattggatttttctttattctattgattagtaagattgtggtatattagtgaaaatagccatttgtcaaatgttggaaatttttttgcttttaaaaaatatacatactctataccgtcatagattttttaaaattataggtagtcagatttttaaatctttttaatggtaacttgattttgttcttatgcttaggaattcctttccctacaagagtattatgaatttgaaagattttctgtcatcagtattattgtctaatttttattataatcaagatttataatatctaggaatgtttatttccttttctcttttttgttttcattgtgttcctagattttggtctctaatttggcatgtacaacataatcaaatagcctgaaaccttggcacattattagttactgtggatcagaatagagtattagatgggatgatcttggatcctgcttaattgaataccaatttataagtacctatacttggtaccaatttataagtgggccaactatcagtccttgtttgcgtgacatagtctaagtttaacctgtcttccagaataatttttttttttgagatgaggtctcactctgtcactcaggctggagtgcagtggcacaatcttggctcactgcaactgtggcctcccaggctcaagtgatcctcccatctcagcctcctgagtagctgggactataggagtacgccaccatgcccagctaattttttgtaattttgatagaaacagggttttaccatgttgcccaggctggtctcaaacccctgagctcaggccctccttggcctcccaaagtgctgggattacaggcctgagccactgcacttgaccaagaataatttttaatagtcctctttcactataaaaagtgcctcagtttaaataaaaaattataaatgttatagaagatagttgtttacatgggatagttcctcagggtattgtaacactaaagctttagttgtttctatttatatcattcagttgtttctatttacattacttctatagtagtaatatttcatttgctttaacttttaaaatatctgttattttcatgatgaacttattacaagcttcatacagttgcttatgtgaggtatttctagaacagtcatgctagtgtgtactctctttgccttcattttaattaacagaatgatgttcactttttgcattaaatgtcccttataattcttatttacctagtattgctttaaagatgatgaaacatttgtctctgtatgtggacatattttggttatattttactaaatgtgtcatcaaatcttttttgtatggctgtgacctaatgttttaacctggccaaataaaccattacttattacattaatgttttctgatgttgcatatacttggatcattggattttgtggtatgctaagtaatactactgttcttaacacagatccccgtgggagccactaaatgccaatccctcttatactgtcacagtgttgataaaactttggtacttgttatctgccagatagattttcagctatcttattttattccgatagtacttctccagccttttcttatgtagtactgtgtcaaagactattttataataggtacattgtgtctattgttctttctttcctttctctactacctctgctactgcttaaaaggtttatagagtttagtattggtcgttttcaccaccgattataaactgtaaatcaacccatattgtttcttaaactattattttacattttgaggtgtttgtaaaattgccatataaaaaggccagtttcaattttcctttagttaaaaataccttttttttttttttttttttttttacaaatacatcttaagaaacctaactttttttttttttttttacatttccggttgtttgtgtgtttatatcataatatgtatgtttctcagtgttatatttaggtatatatgtttggcccttaatttttatgtttgttggtcccattaataaaatttgagaatatctggtgagtagaacaccatatgggaatttccagttgtgctaccattagcctttaaacattagtctttggatacagctatttatttatattttcaatttcatgttatgtaaactgtatatgagattttcataaaagtttgttcttttaaaatatctaggcactgaagataaattaatgaaattcttactgttatttttgcaatgcatgtaataatatgaagagaagctggttttattagacatggagtcatgtttattgtatgatatataaagtatctactgtaatatataaaataatgtttgttggtttttgcgtttcttctgcagagagtgataatgaactctcaagtggaacaggtgatgtgtctaaggattgtcctgagaagatcctgtattcttggggagagttgctaggaaaatggtaaaattttatttttcatactgaaaattctatatttacatagttgatgttaatttgttgtattaaaatctgtgtgttaaaataggttttaaaggattaatattaaaatctatcttaatatcttaatattgtttaaaaacttaaaaattaaaatataatttatagatactctttatgtttggctaggtcttccccccaagtatggttttatttaacttgcttttagaagatgtctttgtcttattatttcactcagaccgtattatttgtcttattatttcacatcatttagcacagtcaattttatgctatattgccaatgcatttaaatgtctactgttaaagggttatgtttttttaaaaccaagtctattaccactaaaatgggctgtatagtttagaatttctcattttacgctgattgttaactgacacagcttgtttcattctttctgactaaaagtattactttaaattttggcgtattttatgtggaattacaaaaaaagtactctgtttatatttattatattaagtactttttatatttatgatacattttttaaaatggtaattatgactatcatatgttggtgtaatgaaaaaatcctgccaacaaaatacttccccatattagtatagacatagaaattcaatttattgttgaatatgcactcagattacatgcatgcgggtagtccaggggagactacaaagtctgggcggaatttcacagttcagtagaagaaagaataatttaaacctcttttatcctttcaagagaaaagtggatgctccttatgatagtctgtatgcatcttgagagtttccttagttgtaatttaggaaatatgtatttacagttccaacggttggaatactgatgatttttcattgtaaaatctggagattaggtttatcaaatttggaccaaagtattgggcctgttattgtttttaaggagataaaccctgaatggccagctgcttctcctttttaagcaaagaaaatttcattttatgtatccttacacatatcacataaaatgaacacatttcagagaacttatttaactcattaatgaatgtcaacataaaataatcaaaagggtcagaatctaatttaaaggtaatttattcaatagcaaaatatgagcatggaccacccagaaacaccacctctaaaggaatgcagtcagtggtccaaagtagggaagttaagatttcatttatataggcagaggcacaggagtttttagcaggattatgacattattcatacagggctggtgcatagttacagcagtttggttggttataggcagtgcttttttcggcggggggatgttaaaaattttttttaactttttttatagagggtacaataatcgtaggttttctgttatctggtctaagtgaagcagaatgacaaaagggatgttaacctataacaagggtcattaatgaagaaggcaggaggttttggtccttgacatcatttaattctctctagttatcgtacaaaacaagaaaaatgtgatttaatgtataatccaagaacagaagttgtaaccatatgtgactcagataacagtcacgtctctctcaagacttaaagtgttgttgtttttttttattccaacagcttttaggttttattttcacatggagcaccaataaggtattagagccaatcaaaataaggatttgatttagagatttattttctttacctggcaattcatttgcactaccatgaatgggagtcatttgcatagctatggacagtaaactttgcattgccattatgttatatatgttgagagttgtaaactagcctagtcaaagacaaaggcacacacttctatgttgtcacccaattcccagatgttccagccattctattgaaatgatgttcagttatcattttgtccatttcaaaaatcttacacaattttaccccacattatatccagaatctaacttactcatttgcaagcattgtccacctaaatgtacctcatatgtttttatctgttttatttagggttactctcttcctttaagatgaacagttctctttttagatggtcctgagttaggacagtttcaatgtgggatggagagcggcaggaagtgagatgggagagtgtgttctagttagaggcagatgactttttcagtctcagaccaggctgggaaacaggaagcatgctaaactttttaaacagaagcattttaatgcagataattggcttacaatgtgttagaaggttgagagagcagaaaggagatattatgattggagtaacccaagtagtaggaaacagctatggcctatgggactggagaaataaaatgaaagaagtattgttaccagagtctaggaactcagaggaggtctgaggagctgatgcagggatctctgaagagggctgcatcctggttgcttagaattatgaggatcctcatagcagctagtgtttagaaagaactgtcagggcaggggacaactgtttagttccacacttctgaagagatacccagatcttggagcaggtggggaggaccacatcattggtgctggtacttgttagcctggctagtattagtatttttcaggagttaacgatatagctggtgctggcaatggaattccttcttccattcttctgccttccaactgtacatcactattactcatgggcagaacctaacctgaaagccagtgggcaagggagtttgggatatgtagtctgcagattctcagcccttacatctttgagcagaatacagaagggtggacttgtagctgataggcagtgggtaaatgactacaaaagggtaaaagctgggcctaattctcatttacccatttatctggtccaattgaattaggctttcctgatacccaatgtttttagatagagatttatttattaggagcactgataagaaaaaaaacagcaccaacaacttgtcctaatcttcttcatctttggtctgaaagtgtacttttatggtccaaccatgtggatgtgattgatagtattggatgtaatggtagcgtatgcattgataccacagcttggctgctactgttacgtggtttcttcctttcccacttcaagttatttgctgggggaaggcttaggaatttacatggacctccatgcatcatagaaataagcaacgtgtctcctgcggcagctctactctctggacagagtttatttgtccctgattctctggtgaagaacaggggcatagtcttccgttgtggccacttcataaaacaaggactcccttcttactggctctcacattactgagaattgggtgcttactttttacgggcccaacacattctttctagtatagcaaaatacacaacacctaaaactaataccttatactccaattgaaattaatcagcaaaacagctcctagatatcaatatataggtattgtagaaactaattttctttggataaggtgtttcttcttgtccgtaatttactcccaaaggcaaaataatttcaacttgataagatctatcggaggggaatataatttaatgggaaaaatacattacgcttaaactcagaactgaattagacttccagttgtagtgctaacttgataggtagcttgcacaagttatttaacatttttaggttccatttttccagtgaagcttttataaacctgctcatgtatgcatgctttgtctttcagaagtggaataatgtttgcaaagtttttttgtgtgttttgtttttctttttcctagcccttagattgagaaaataccttaatttttattgtctttttatggtttgggattatatcaccattcttgaggaatttacaataacagtctgggctgtttcatttaagagaatatgtacaaacatctcactttcttgattcttagatgaaatttagttaaaagtcgacatgcttattgggagatatggcaaggtgagaatgtttgggaaaggaagtagagacagacattggatttttgtcagtcaagtttcttttgattttaaattatttattcattacattttctacatggcagttaatattctaaaactataaacaaaatttaatatagaaaaaatattatgcttttcttttttgcctttgcatgctcttatttcaaaatagatttaaaattcatggcatattatactagaaaacaagtctgtcaatgatctaagcttctatctttagatactaggaaaaaagagaaaaacccaaagcaagcagaagcaaggaaataagaacagaaataaatggaattgagaagaacacttcagaaaatcagtcaaactgaagctgatttttataaagattaatatgtttgataaagataaccatctaactagactgaccaagaaaaacaagggagagagagaacacagatacaagaatcaaagaggctacatcattacaaatcactacagacattacaaggatataaaataatattataagcaactcactgtctataaatttagaagcttaggtgaaatcgacaaacacttgaaagtcataaattgccaaagcttacttgaaataaataacctgaatactcctgtattagttgacaaaattgaattcatagtttaaaagttttcaatagagaaaatttgaggccaaaatggcaaattctaccaaatatttaagaaaaaaataataagactgggcacagtggctcatgcctgtaatcccagcacttcaggaggctgaggcgagccgatcacttgaggtaatgagtttgagaccagcctagccaacataatgaaaccctatctctactaaaaatatcaaaaaaattagccaggcatggtggtgtgcacctgtaatctcagctacccgggaggctgaggcacaagaattgcctgagcctaggaggcagaggttgcagtgagctcagattgtaccactgcactccagccagtgacagagcaagactctgtcagaaaataaagtagagtaaagtaaagtaaagaaaaggaaagaaggaaggagagaaagacagagagagatagagaaagagagaaggaaggagagagagaaagaaaaagaaagaaggaaagaaagtgaaggaaagaaaggaagaaagaaagagaaggaaggaaggaaaggaaagaaggaaggaaggaagggaaagaaggaaggaaggaaaaaatatataaattctacataaactttccagaatatataagtgaaggcaatactttccagctaatttatgtcatttgcttaccatgatatcaaaaccggatgaaaatattacagaaaagaaaattgcagacgagtgtccctcatggatatagactaaaaaagcctcaacaagtcctagcatatcaaatccaacaatatataaatttgaaaggataatgttgcatgactacgtgggacgtattttgggaatgcaaggctgctttgacatttgaaaataaatcagtgttattcacttatatcaataggctaaagaagaaaaaccatataatcatttcaatagatgcagaaaaagcatttgacccaattcagcattcattcttgatttaaaaaaaccaaaaaacaaaaaaacctctgagcaagctaggaatacaagggacctttcttaacctgataaaaggtacctatgaaaaacctgcagctaacatctaacttaagaatgacagatcccaaaactgggaataaggtagggatatctactctcatgactcttactcaacttagtactagaggtcttagcaagtgtaacaggcaagaaaaagaaataaaaggcaaacaagattggaaagaaaaatataacactgtctctatttgcagagatgtgattgtctgtgtagaaaaccccaaggaatctacaaaacaaacaaacaaaactcctagatctaataaatgagttttacaatgttaaaagatacaagatcaatatgtgcacatcagtttcatttctatacactggcagtgaaaaattggaaatagaaattttgaaacaaaaaagcaccataaaggaaaaccatgaaatatatagaaatcgaacaaattgtgagctaaatatatactttgacatactagaaaacagtaatcaaagacatcaaagaagacagaaataaatgaagatatatgctatgttcatggaatgaaaaaatctcaatattattaagatttcagtcattcccaaactaatcttaaaattagtgcatttccaataaaaatctcagcagattttttggtagcaaccaacaagctgattttaaaatttatataggaagcagagtaactagaatagccaaaacaattttgaaagtgaagaacacaatggaaaggcatattacctgatttctaggtttactgtagcactacagtagtcaaaagagtattgatacaaggatagacactgagattagtggcatagaaaagagagttcagaaatagagccacgcaatctaaacagacattttctaaagaagacatacaaatggccaagtagcacataaaaagatgctcaatatcattaaccatcagggaaatgccaatcaaagctacagtgagataccacttcatacccactacgatgtcaatcattacaaagacagataataacaagtgttggcaagaatgtggagacattgaaagcgtagcatagcaactgcaactcttttttttttttttaagattttattattattattttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccacaacagtccccagagtgtgatattccccttcctgtgtccatgtgatctcattgttcaattctcacctatgagtgagaatatgcggtgtttggttttttgttcttgcgatagtttactgagaatgatgatttccaatttcatccatgtccctacaaaggacatgaactcatcattttttacggctgcatagtattccatggtgtatatgtgccacattttcttaatccagtctatcattgttggacatttgggttggttccaagtctttgctattgtgaataatgccgcaataaacatacgtgtgtatgtgtctttatagcagcatgatttatagtcctttgggtatataccgagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctgactggtgtgagatggtatctcattgtggttttgatttgcatttctctgatggccagtgatgatgagcattttttcatgtgttttttggctgcataaatgtcttctcttgagaagtgtctgttcatgtccttcgcccactttttgatgggattgtttgtttttttcttgtaaatttgtttgagttcattgtagattctggatatcagtcctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagcgagttttcccagcaccatttattaaatagggaaccctttccccattgcttgtttttctcaggtttgtcaaagatcagatagttgtagatatgcggcgttatttctgagggctctgttctgttccattgatctatatctctgttttggtaccagtaccatgctgttttgggtactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtcattggtagcttgatggggatggcattgaatctgtaaattaccttgggcagtatggccattttcacgatattgattcttcctacccatgagcatggcatgttcttccatttgtatgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactaagttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggttgaagcccacttgatcatggtggataagctttttgatgtgctgctggattcgttttgccagtattttattgaggatttttgcatcaatgttcatcaagtatattggtctaaaattctcttttttggttgtgtctctgcctggctttggtatcagaatgatgctggccttataaaatgagttagggaggattccctctttttctattgattggaatagtttcagaaggaatggtaccggttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatatatccatttcttctagattttctagtttatttgcgtagaggtgtttgtagtattctctgatggtagtttgtatttctgtgggatctgtgatgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctctcctgctttctcttgtgggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactctgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctctttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtgtaaagtctgttttatcagagactaggattgcaacccctgcctttttttgttttccatttgcttggtagatcttcctccatccttttattttgagcctatgtatgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctgtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattgtccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagcttgtcaaagtcattctccatccagctttgttccgttgctggtgaggaactgcgttcctttggaggaggagagacactctgcgttttagagtttccagtttttctgttctgttttttccccatctttgtggttttatgtacttttggtctttgatgatggtgatgtacagatgggttttcggtgtggatgtcctttctgtttgttagttttccttctaacagacaggaccctcagctgcaggtctgttggaataccctgcgatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcctggctgctttgtttacctaagcaagcctgggcaatggcgggcgcccctcccccagcctcactgccgccttgcagtttgatctcagactgctgtgctagcaatcagcgagattccgttggcgtaggaccctctgagccaggtgtgggatataatctcgtggtgcgccgttttttaagccggtctggaaagggcaatattcgggtgggagtgacccgattttccaggtgcgtccgtcaccgctttctttgactgggaaagggaactccctgaccccttgcgcttcccaagtgaggcaatgcctcgccctgcttcggctcgcgcacggtgcgcgcacccactggcctgcacccactgtctggcactccctagtgagatgaacccggtacctcagatggaaatgcagaaatcacccgtcttctgcgtcgctcatgctgggagctgtagaccggagctgttcctattcggccatcttggctcctcctcgcaactgcaactctcatatgttgctggtggaaatacaaaatggtgtagccattttggaaaatagcatggtattttataaaattgaagacccttcttataccaccccagcaattccagtcccactgctgtgtgtttaccaaagtgaaattaaaacctgtatgtgaatgtttatgatagccttgctcataatcaccccaaactgcaaacaacccaaatgtccgtcaaaagtaaatggatcaaccaactgtggtatattcattgtatggaatgctactgagcaattaaaagaatgaactgatatacattacaactgatggatctcaagtgcatcatgttaagtgacctatgccaaagtcaagtgacttaatactatgttattccatttgtatgaaattctggaaaagtcaaaactatcatcataggaagcatgtcagtagttgttaaggactggtggtattgactacaagagggtccagggaatttgggtatggggggaatgagggaactatcctgtatcttggttatggtagtgctcacaaacctatgtgcatttgtcaaatctcacagaattgtatactaaaaatgtgaattttactctgtataaattgtgccttaaataaatgacaaaaaagaaaaaaaagccctgagttttaactgcagtaggtgctgaagcaagaatagtgtcactaaaccaaaaaaaaggaaaaaaaggaaaaaaaaaaagaaatttatgtcttatacatagatggctatttgaagtgtgttcttttctcttgtcagaacagtgccttcattataccttgcatatccatttttctctctttattttgtaatatttattataggtaactctgtcttaactaacttctctcttcttatcctgcaaagttatgtcaagtgcacatgacctccttaaagtcactgttgttttagagacatctcctgcagtttctagagtatagtaggtgctcaattcatatttattgactgaattttttgatgaaatatctcttaccactacagatttctgtccaattttatgaacattttatatatctatatttggtaattaattatcttgtcttatatagtgttttaagaaatctaagttgtaatattctctattaggttatacatagatttatttatcttatatctggcttcatcttgaaccctgggaatgttacttgactaatttgtgtcttgatcatgtcatggtgagatattttgatttagccattttaaaaacatcattctgactgcccagtgaaaaatggattataagggaacaaaggtggaagcaggcagattaggagaatgctattgtaaataatccaggggagagataattacatgttgcactaggctggtagcagagggtgacatgtgatcggattctggatatattttaagagagtactgactgtatttgcttctcttttctgtgtggcctgagaaaaataaataactggccactgatgtcagagtttttggcttgagctactagaagacttgctgtttactcaaatatagaagagagatttggaggataaaatcaagattttggagatgttgagatgcatttaagacatccaagtgactatgtccattaatcaatttcatgtaacattgagttcaaggaaaagatagggaaggaaatatgagtttgggagtcatcagtatatagatggtttttaaagctgttagaatgaaatgggcgagattacttacggagtgagtttagatgaagacatcatccgaagacatcatccaaagactgcaccctcgaccactccagtgtttgggagttggacgtatgaggaggatcaggcaaaggagcccaagaaagtacaaccagtgaggtgggaggagaatcaagatagaaatccagtaaactaagtctatcaagaatgacacagtagtcaagtgctgataggtgaagtctgatgaagcctagaattccactggattcaacaatttaggtgtcactggtgatcttaagaacagtttcaatggagaggcaggaatgaaagcccagctggattggaaatcagcagatatagatagctcttaaaaatagttttgctataaaaggatgataggaaacgaggacacattagtaagtggatgtgggttgagagttttttattaaaatgggcaatatagcatgtttgtatgttgttagaaaggatgtaacagaaaatttgatagtgtcagagaaagaggacataattgtaggataatttgatgaataggcaagaaaagatgtatatgttgactagtggaggggttgaatttgggagcagagatagctcattgtaacggaaggaaaggtgaggcatggctacagaggtaataactgacagttcagtgtacttactatgtgccaggttctgttctaagcactctccatgtgttaatttaattgttgcagcagctctctgaggtaggtattattatatcttcattttagaggtgagagaactgaggcatagctatattaggtagctagtgtaaaaatacagaaaacaaaatggcagcaactaagtaacttgctcaagatctcacagccaataagtaatttgcccatgatcatatcaagtaaatgacagagccagtttctgaatctaaaccactctggttttagagccagaacagggtgtgtgtgtgtgtgtgtttgtgtgtgtttgtgttttcttttttttttttgagatggagtttcactcttgttgcccaggctggagtgcaatggggcgatctcggctcactgcaacctccacctcctgggttcaagtgattctcctgcctcagcctcctgggtagctgggattacaggtatgggccaccacgcctggctaattttttgtatctttagtagagacggagtttcaccatgttggccgggctggtcttgaactcctgacctcatgatctgcctgccttggcctcccaaagtgctgggattacaggtgtgagccaccgcaccggcctagattagtttttataagagcatgtagaagttctagtgagtaagtgaataaactaggaaaatcgataaccctggcccaggcagtacttgaagcttctagtcatgattttaaagagagattatgagaatggcagtatggtgggtaagaaaacaaaatattttgatgactaaataaacagtcaaatagagatctccactcagtttctaaaatgcaagatttattacttgcttcaatataaatttatgaggcatcatcttagactcttagagttacatagaaaacaacatagtttctacctttgaggtttataatcaatgtaggtgggaatgcatactcataagagattatttaacaaagtaactgaaacactgaggctgtttcacatttcttgaccactttttttcctgtaaaacaagtcacttcattcattcattcattcaacttttaagtcttaatcatctattctttcttggggactttaacagacactgctgatttaaagatgagtaaggatagtttctaccctcaaggtttaccatgttatagaggcatgcagacctttaaacagaaaattgtgatattatcaataaatccttctgtaagcattgtagacctaatggaaatttttgaatgtacacagaaataaaataatacaatgaagtctcatgtgcccactgcccaacttcaataaagacaatatctaacaaatttctttaagctgagactcccattgggtttttcttttttttttttggaaggtaatattggagtaggaagaacattgattaacagagaaacaaattgggaagtaattgcatgggttgatgatatttataccagactcactgaccctatgtacagagatgaggctccaaatgggaaaagacttctgaggtagaaatgacagggttgctcagctgaaattcagtgtacatttttttcagaaataaaatatttctaataatatttttattaatggactttaggaaattatttaaagatctgagggaactgttttaaaaaactaacataattgattcttagacctttagaaaacttgttggattttttacaattcaaattttttttatttgggccattattataattatgtcatgatatgaaaagggtaacatttgtgtaaactacagaagtataaactactatgtcttttatacgaggattgtcaaatatttttaattgtgctcaaatttctttttgaaacattcgatttagaaatttcctaagtgtcgggaaaaataggtaggcatttacatatagacatttttgtgatttatgtaggtaaagcacctgtcatgtggagtcctacactttgtgctttggggaaatattttttaaagtgaggatacagtatatatgctcagtgaaattttaaacgtgtttgaaaagattttgaacttactcttaaatagctagatcattcttttaaaaaagcaaaacatgaataaagtcagaattcttataattaaatacactatcagaaagatgtaaaggaaaaatatttcaatactaatttgaaatcattagaaaaaataaaaataatatagaaaactaagaacagactgtataaaaagttcagtactggaggtctttataacagattggagatacaggtgtattgaaataactacatgaaaaaagcacataagctaaagaaagaaaggttgagagagagagagagaaaacatttgggataggagaacttgtaaaaacaaaactaaacgtggtagcaagatttcttttatatgttgaatatattcagaatggtaatgctgatgatttaactattatttaaataatttaaaggattaggcagaataatatctggataactgcttcaggttttgagatgcatggaaaacttaaaaaagtttaaagacaaaaataaaggtagtgcttactgtgaatacttagtaagtcaacttttagcaggaagaatatgcaggaagattttctaaccaaaaagactaagtgaacattggaggaaaataattgggtattggattattacatcaagtaaagtcaccttcaaatcggtcattcttttttattgagtaagagaaaattggtacatagccacctacttccacctcctatcaaaatttctgtaattccattggtgacttttcagtggtcacattcaatgacttttatccccctcatctcttgctttttctgctgtttttattgaataagagaaaattgatacatatttagtaggcattttaattgtattttcatggctattcattacttatcagcagagtgggaaaatgtattctgaattaatatgcttttcatcttcataatgacctttaatctatcctttttcttgaaacatttcttaatgtaggtcgtataacttctccgtatctagttcttctcattattgcgggatggagaaatctccgacctttcttgatgccacctcatcttttaatttcagttatagtcttttcctttctagagagaactttttcaaataggtcatgctgctggtgtcatattctcatatctcatagccacctacttccacctcctatcaaaatttctctaattccattggtgacttttcagtggtcacattcaatgacttttatccccctcatctcttgctttttctgctgtttttgttagaaataactctttccctttgaaattttatctcccaatagacatctttaaaagtagagttcttatatgcctaagtagtttcaagaaaatcctctttgaaagcaaaggaaatccactagatgagtccatgacatttttttgatcctattaaattcagtgagaatgtttgcttctaaaaaagcattcttttttgtttagctttagtaattgacatattaatttcatttcataattatattcattcacttaccaaaaatgtattaaatgccttttatatgtggggcactgtttctaggtgcttaagatatataagtaaagaagacaaagattcttgccattgtggagtttctattcatgcattaaaacctagccaattactgtatgattaatagatatttgatttatgtatgactttaaaaataattgtattaggtatccgtcttgtttctagggtagagttcagcatgtatcataactagttgcctattttcaagttcctgataactgcagttaatgtatcaaagcaatggcaatgtgtaattacattttaatcagaaatattgaaagcaatgattatttttataaatttctcttttatttatttggatcttctctgatcatagatatatactagcagcatctagcttaatatttattagtacttctcaagtgatagggtgctgtatgcagtataattgctgtactgttacttgggataaccagtaaaataaggctgttaatcaagcagtgttatgagtgacccagttctttttaaatgcctgtctctaaagataaatagtgctttgatttttaagagaggagaaaagacattttcattatgcctggccaaacaagtggctgagggtcagctagaaactgaatgtcaattgagttagattatattatggtaaagtattcattggggactgttgactattaatcttaaggagtatgtttatgtacgtgtgtatgcatgtgtaggaagagatattcaaactttaaaatatagttaaatcattatgttattatatatcattatataaaatattacagttaaatcattatgcaaaataatctgggccaaccgagtatttaatcaagctgcttgttactttcattctgcctacaatgttggaaatatgttatagtaggtccagtgaatgttaggaggctattgcagaagtctggggaggataaagttggttgcagttgagatggaagtgcatgaactttgtagaggttgagaaaataagatgtattagacttggtggtggattagtaatagatgatggggcaaaaataattcctaggtttccagtttggatggagtgtggtaacaatttctgaggtggaataccctggaaaacgaccaggttagggagaagaaactgagttcagacttgggcatactgactttgaggtgcctttgagcttctagaacttgggatacatgtttataggtgataatgcctagagacaagagaatgaaagaaaagggcaagagtaaagagagataacttcaagcccttaagaggttaatagaggagaagcaatcaacaatggagtttgtgaaggtggataaagaagtagtgctttgtcactgaagccaagggaaacagattggtccacagtgaaaggagtgaaaatatgtcttgaatccagtggggcatggagagaagtcatagatcatttaagtgaaaacttttcaaggagagatgcagaagccatgttgaactgaattgaggtaggagttggaggggaagaaatagagatagtgcttccataccaactcttgaaatttgttgcacagggtaagagtgtgatggagaattgcgcatggcattgaagaaaggatttttttcaatgttcttaatttttaaattttgagacagagtttcactctgatgccctgcctggtgtgaccttagctcatttggtctcaacctctgaggctcaggtgattctcccacctcagcctcccaagtagctggaactacaggcacatgccaccatggccggctaagttttttgtattttgttttttttctagagatgaggttttgccatgttgcccagtctggaactggtctggaactggtctgaacgcctgggctcaaacgatccgcctgctttggcctcccaaagtgctgggattatggatatgagccactgtgcccagccaagaaaggattctttcacatgcagttttaattaatttaatttattggagttttaatagctgtagagacacagtgatgacttgctgatctctatataacatgtaacatatactatatttaactactttggatttcccttacatgatattataaattattggactcataatttagaatattttgcatttaatttgagaggaaatgacctttgctctttgtacatcattgcttttaattaacccagttttctatactaatacccttaacccatatgtttttcctattcaacagtataatcacagccaaacattaaattacaaaaagatccttttatgactaatcctggctctcttgtggcataatattccttgtcaaatagtttattcaggtggaagtcttctgaagaataattaatactcttcctctacttgacatattttgtgaagcataattatctatgatgtttttccaaattaactaaaattatgttttaatttaaagccacgagagaagtttaaagaattgaaatgacttcttgtgttttatgattataaaagaatttaaaatcattataaatatttcagacagcataggaaaataaaagggctactttcccttttaattctattacacagatattttggagtatgttcttccatattatttttctatgcatgtctaaaagcaggtttcaaaatagcggttatggaggtgtatttaaactaacacctatttactaatttgaaacttgcttttgtcacttggcagcataactgttattttaaggtatggtagcacgttaagtcatataaactctgcctttctctagtttatttttgcttcaagcccatcagtattatcagcttagtttctctaacccaacaatacaaaagcttagctagaaaaggctaaaagaaaccattaaatctgatggtttactaaaattattaatgggatgagtttacttgaacttgtttcagttgtggaagttttagtttttttctgagatagcccaaatatgacagtatggggaaagcaaggaatatattttcagaggaaggtatgccaatactggggtttgagctagaggtagaagagtgtgtataatctagtgaagcaggtgggaggccacttttagaaaatagacatgtggattctatgactttcgaggctcaaaacttgaaaccagagcctggggtgttagatcaaaccagagtacattgtcaaggtttggagtcccagtggttgcaccagagtcagctctaatagataaaaaatgagcaacaaatacaagtaaagtctgagcaaaaaggcatagaatatagttccagattcaagctaggcaccaggaaaaagatgacaaatgaaattgcattcacaatattgagatatgcaattcagtttcttggtcagatgggcatagtagcatatttactatgttgtgatcattgattttaggaggagagatctttgcctttgttctgacgctgcacacctttgggatgtggtaaagcctgataagtatgtgttgcttccccagcaagttggagttgttgtgtaggttctggtgattgtaggaaagggttaggtccttcctttaatgagcacttgctgttgtaacaagtcagggagacaaattcagacatgtaaacaataatgaactcttcttactagaaaacctatcttaggttgttttaacttggaggttcattgatatctaagtttatgcttgaacaaagaattccaagttaggtcatcaagagatagggcttcctggaggacctgggagtcaggatgtggccgccaggtaaaacttgactataatatgtatgccttatgcctcctatactgtggagtctgtctttggcacttggcccagctcagcttggcctcagagaagtgggtatagtcaaggtgtgataggcctatgatccgttttcaacatcatttcctgaaccctatttcctaccacacatcattgtccagcttgctgtacattcatttcagggaatccagatggttctttttatgccttgaaatgttgcctagcaatatataactaacacgttaattattatgagtaagtccataggatgatttttaaaagtaagtgagaagaagaacaagcttttcctggaggtagaattacctggttcaccaataagaagatgagatcaataaaaaaattgaagatataactgagcttaagcagtactattgtttaatgcccccccacaaactgttttctcttgacccaagcttacacttttatataaactagtatacttttcatggcaacagcagttcaggagttgtaaaggaagtgtgaatggattattttcttgtcttctcaggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggtaggaagaagttcttttcatattattttcattggatgacctattaaataaatcctagttttcatagctcccataagtcataaatgctttgaacttcttcatgaatatattgaggtcgtgaagtcagtacttctaccttttgttctgaacacttgtagtggtaaacaatgcacttagtcatctatgaacattgtatgccttggtttttatcttttcattcaagtgattttataatagctatttaccaaattggaatatatttatatttcaagtgttttctaacttttcaattaaccttttttaattgtatgagatttatatagttataatcatacatagttactcttgtataattttacaataacattaaaatgaaattaaaaattcttctgtgcttatgtcaccttacatttaaataatgtagatacttgccctttttctgtcaggggcccttggttccactgtaaattcctttgcttatgtctaaatacctggttttagagcataagtaaaggtaggtgttggccttgaccctggactcaccaccctaggtcttaccacctaattacttaatctactctaagtactgtattttaaaataatagtaaaattttattttttaatttaaaggaacctctcctcataaatgagatttttataatcaagactttgttcctcagactatatgaacttttagaactttttatctgctgtaatttctttttacttttctttcctctttgcctccttcccttccataaatattttctgagtgcctagtataattatcactgctgaattcagttttttttttttaatttaactttttttttttaaattgatggcctctgcattggaatatgcaagatgatccattggtgtgtgggaaaaaatgtccaaagttccatttgtatttcttttaaataagtacaccaaaggatactaagctgtactaatatttggtgtgccatagtactgaggctttatgaggtccttgggtccagtggccactggtcccacatggttcaggagtgaccttagggaagaatggaacttacacactttggaggaataattgtggggctcacactcgtatattaacttccaaaatattataggtttcttgcagtttgcatgtgttagattaagtggatttacaggttatctagatgtaacttaatcctcataaaatgtgtgattggcttaaaaagattactatcacaggatgctgcatgtcaagttttttttttaatttaatatgttccttcagggaagaattaatattatgataatgacaaagcaactacttttggaaacaaactcatgtaacaaagatggacattttgaaacatatggcggtttaaacacctctgtgatttttttcattgaaataacatgcatcactataaaaaactcttacatcttcacacttaaaaacctggaatcagaaactttaaatatgtttaaaacttatacaagtagttgcagagaatttggaactgattgttaaaagcatataaacacaacaccttctgatttgttcatatgaatatctagaagctggtgtggtggcatatgcctggagtctcagctattgagaggctgaagtgggaggactgcctgaggccaggaacttgcacctgtgactagccactacactttggcttgggcaacatagcaagaccctgtctctaaaaaaaaaaaaaaaaagaaagaatacctagagaaagtagatatttcctagccaaatttcaacaaaatgattgatgagtgggactgaaaaaatgatgtacgtctacttgggtctgtggatctttgtaagtcttttttagatatgataacaaaaccatgaatcaaaaaactgatgcagaaacaagttttcattgttgttttataaactgctataacaaacatattaaaaatagtgacccatattttatgattatttttatataaaatgtttagaataggcaaacctatagagacagaaagtagactaatagttgccaggggttggaggaaaaaggaattgggggtcactgctaacagatatatggagtttgtttttagatgatggaaatattctggaattagacggtggtgacagttgctcaagattatgaatatactaaaaaccactgaattgtacacttctaaatggtgaattttatgttatgtttaacacaatagaaaaatttcacacacacaaaaaaagatccatattcaatattgaatagtattttatagcatttttaattatcttttttacatcctatctaaatttctgtgctttataatatctataatatattagtataatagcacttgtacatgataaatatatatatgttagatatttatgcctagaagtttttatcgatggagtatctgattgaaattttcagagatcataactctgggtatcaaattactttttcttgtaaataataaactaaattatatacttttattggctgccatggggtaggaggtaactgccataccccttttttcactaagaggctttcataattcatacctttaaaaattttaagggaaaaatgtaaagaataccatcccctgatattatttatgaattcttgataaacagtgtatgttcatatagtgagaaaatttttatcatttataccaaacaccatggtagttttaactatacaacttgcaaaaaatactttaagatcaagagatagggctgggctcagtggttcatgcctgtaattccaacagtttggaaggtggaggtgggaggatggcttgagcccacgatttcaagaccagcctaggctacatagtgagacgctgtctctacaaaaaaaaaaaaaaaaattagctgggcatggttgcacatacctgtagtcccagctgtttgagaggctgagatgggaggattgcttgagcccaggagatcgaggctgcagtgggctgtgattgtgccatcaaacttcagttcagctggggtgacagagtgagacccagtctcaaaccacaaaaaacagaatggcaaaaatcattttcattgaataaaatatatggaagatacttggaggctgataaattacattttttagatttcttccctctggagttctagctgtgatttactttctgccagtgaagattgcggggaggcaaaagccatattttctctggcagtgtggttggcagatacctgggcttcaccagttgtgaggtttttgcatctgcctctgggcatttcattctcaatcacttgccttcactctggggttactgtttcctgtggtttcctatcctgagtggccacagcagccttctgattctctggactgtagctgtggtgacacacctaaagagctggaagggcaaaagactgctacagcaggatgttcagtcttcagtcttttgccctttcagctctttcagtgtttaaggaccttcattcctgcattacatcttttttgaaatagtttacctgattaaaccctgtctgatacacttggcatgtatttttctccttgttttcacaagatggcttttctacacccagcattacatttagaaaagaagaaaagaaaaacaaagtctactcaaggtagccagacttgaggctaagagcccagtcctccagactgccagctttgttcaagacttctgacatcagccacaatttgggggttcttagtgccaccctgacttcagaccaactagcttcaaacttgtagatcctcacagacttcctcaggtttgataatttgcgagaataactcacagaactcagtaaagtgctatacttaaacaattgtagtttagtgtttttgtttgtttgtttttttagtagcaaaaagatacaaatctgaaccagccaaaggaagacatgtatagggcagaatgtgggactaggagaattccaaatttgaagcttccatcattctcacggatatgttaccctcctggtattatcctcaagggctcattacctgcctagcatcaatatgtagcaatatacacttggaatattgccaatcaggaagctcacctagttttggtgtccagagtttttattggagttttattacataggcatgattgattggatcattacctatctggtagaactcaatctctacgctccccttctttcctccccagaggaaaagaaggtagggacacagccaaaccatattgtattggggctgttgcgtggctcaaaaccccagtgctgtaatcacatggtcggtctttgtggcttggccagcctacgtcatgagtcttcttcttagtgtaaactatctgggggcttaccatgaatcatctgattaacataaactatcagatgtggttagaggggcccaccacaaataacaatcctgttattcaggaaatttcaagggttaaaaggttactgtccatgggctggaaaaaaggctagacctctctttggcatttctgaacccagtctatcacccttttaaagactttttcttaagcaccaaacaacaactccatctatatattcttgaccagaattctggctactatcttcatggaaaactagaaatgttttttaaaagatagacacattgatttatccctccacccccgaaaatctaggctttttgtaaacaggaaagagaaaataggtattgagtagaaaactacctttctgttccccaactgcctcttaatagtgacactagttgagatctattatggaatgaattattctaaaaatatatgtaaacttaatttattttagaactgtaaatatttactaattgccacttgagattgattagcaatgtgtaattcagttagtataataaatattttcacattcagcttataaatctatgacaactttaagtttttaatgttatttctattgttaatacagttatcaaaaacattttcatacaaacaatatagaaatgtgtggctctaatcatgtgcgtttattcagggtctcaaatcataagacttctttgacataaagtacagtggtatatttaatttcattgtcttccttgcattatagtaaaatgaataatgtcattttttctaaaaatgattttttcctttcactgtccttggggtagcaatgagatgacaagtgcctgtagccaagagtgtatgtgggtactttggtggtgaatacatctgagcttatagtcactaagtggaaagggcatgaacactcaagagtattttctgtaagaagtgcctgcatatttggcacttgttggtcatggttcagcagctgttcgtcctttcttttggtccagttaatttttcctgtcttattaagggaatggcaagatttcaaggttagttaatgaaatggttcagcttgaacaaacaattgctttataaaaaattgctttataaaaaccctaccagaggcctcagattacacagggaagaaggaatatgaagtattttatatttgtctgttctcacactgctataaggacctacctgagactgggcaatttataaaggaaagaggtttaattgactcacagtttcacagggctgggaggcctcagcaaatttacaatcgtggcggaaagggaagctaacacatccttcttctcatggtggcagaaaggagaagaatgagcaggggaaatgccagatgcttataaaaccatcagatctcgtgggaactcattatcacgagaacactgtggggtaaaccgcccccatgattcggttatctccacctggtccctcccacgacacatgaggattatgggaactacaattcaaatgagatttgggtagggacacagccaaaccatatcatatttcagaaaatttacttaaggtttggcttccatgaaaaagtagtctaccatttaaatctatagtaggaatgtactggtttagaatttgaacccacaaatcacattctgaagcattctttcaggggtggcaaatatacagccagcaggctaggtggagcctacaaatatgctttgtatggctatcaatacatcaaagaatggtatacacttagggattaaatttatactttcttttgccatgggcgtattactctattacttactctctatcttttataccttttaatgcctgtttggtcctcaaatatattcgattttgtgactccattataatactatgtcagcagccattgcttgcttcagaggagggggctatcacagtgtgcttgcaattgattaatgtctgcttccccagcagactttaaaatccacaggagcaaagaccacaactgtattgctccttatgaaatagcctatgcctggcatagggcctgcctgacacattctagatgataaataaaattttttccctcctaagaggagcataaggtcatagttgacttatttgtatagttatttattctgtttttcttttccatcaactatagccttatattgtgttaggtcctggataaagcttttaagtatgaagcaatgtcttttttgtaggaaacctattcatcttgttggggagagctataagcaatggattaatttgagcagctgttcctggtgaactaacctcttctctttttgccagggaggaggtggcagccattaagaattagtaccctagagaattttgcaatggtagtgggtcatgtagattgagtcaccttgaatcatggtaggtcaatgattggcctgccatggtaggatagacagtaatattgaacatagaatagggccgggattacaatgtggaacaattatactttatatggtcttgttggttttataatctatagaaaataaagttcttcatatcattttgactggtagtaaatgactctagggaccaaagtttaaaaaagggtgaaaatctctggatgagattcaagtgaaaatgaagcaggttaggagctgtagaccaactgataacctcaatctggaaccaaggaccaagcaggaccagtcagaagagctgttatatgtaaatccgtgttgaatcactctccacttcagaaggagctttcaggcacaccttgccttggtaacagtggtagcttcgctttaggaggagattttagtgctcactatgcaggaagaccctgggttcgaatctcaaattctgctacttactggttggtgaccttgggcaagctccttaactatcttcagtctcacttccttttttggtaaaataggcataataatatgtatcttacaggattgttgtgagaatttagtaagataatttatataaagcactcaatgcatgcctaatacatgataagcactcacccgtgatggggaatgaggaaaattataaagcaatatatgcataaatgaagtttgaagtaagctttcggaattaacatcatcagaaagtactataggaaatatggagattactgtgggctcttgaggtccgtgcaggtttcaagacattcatctgagaaatggggagaaagaaaacaggaagtgtgtagcaccctgttatctacttgtaccgctaattcattcattatttatcaaacagtatctcttctgtatcagaggctatgctaagcactagacatgtaaagaagactaatacctataccctatccttgaggagtttacagcccagtgggggaagatagtcaaaaaggcaaagaagcagcgataacatggttaagcactgtgacacaggtatgagcaaagtgacaagtgaggacaaagactggatacagccatttctgcctaggaacagagaatgggagtatgtgtttaggctgaggcaatgccatacataaacacacagagttgtgaaaggtcctgccatggtcaggggctgtaagaagttcagtatgacccatgggagtactctagactctacagtctaagtgagcaaagatggtatctgggttttgctcactgctctaaccttagtactcaatgctaggactgcccctcagtagatgctaaacgcttcctgaaggatttaatggggtatgtgggagacattatgtctagtgctttcatatatcctttccatgtaagcctcacagcttctgtaatatgattcccatttttaccatcaagaaaactgtcacatggttactaaatagtagaatccgtgaactcaaaaacccaaaactagaatgaaagggacaactcatccctacttttggtcttgtaaagatcctttagaaaaactctatatttttctgatcatcagttattaagagtaataaagaaaaggttgaagaaataaaagcactatctcatttctatatactgttcattgtatggaaatgaaaatttataattcagaaactattctatcaggaaacacatataaaccttagaagtcagtgagtaagaaagaagttctaaagcgcctaacttcaagtcatctcttttaagatgagtcttgagccttcaaccattgtctgttgttacatgattcctgccactgagttgtagggtactactgctgctgatgaatcactggaagacttttaccacatatttctgaaatcctatgtcctttattgtttatcattgagatgtttttattattcctgttaagctgcatttttcataacgtttgaggtgatctgaaacgacaatagaaggatcatgaccttgttcctgtgtagaaacaagcaaacagtatttagagcttctgaaatgagtacttcttaattgttggcttgaggacccactaagcaatgatcacattttcacatattcttagccatttgaaatggagattgtgtatgttttagggcaagtcaaattttatgtagcatgacagaactgtgtgtgtactttcagtaattgtatgacatatatggtatagtttgcctatcatatctgctggtttatataacataggaaatattagattgtagttgtgtggtcttttgtaaaaatgatcttgtatgtaacgtgtgtactgtatactttgttaaaatcaaaagatgcttttaattgataagcttttagaaataataatgccatgaggtgtttctctctaccacttgaattcctgtttttctcccaaatgaatcttttctttcgaaagtgtatgtggttatatatgagagtgtgtgtgtgtgtgtgtgtgtgtgtgtgtgtgtgtgtgtatatatatgtgtataccatttcttttcttctctcttttttttttttaagagacagggtctcaccatgttgctcaaactggagtggtggctcttcacaggtgtgatcatagtgcactgcagttcattcttttaaaaggatttaagtgctagtgtttgatagacctggatttaagattcacctctcccatgtattaatttgtgatcttggaacattgtcccaacattctaagcctcagtttcatcatttttaaagcaggcttaatagtagtatctaccgggatttttgtgtaaattacataaaatgatgaagtgcttggcgtatagtaagtactcatgattagcttctgctatctttatcaatatgatattacatcatgaacaacagtaatagcaatgttaatattaataatggatattggtgtcagggcatgtttctaatttaatacatgtgttaggtaacttccagttacaaagtttttataagagcacatgatgtgtataatagctgattatactgaaatacgaagtgtcagatttgtatttttctggtttgggatttttttttttttggttggtgaatatcatggagtatttgcattctaaaatttgactttgtattggttatatgaattattttagtgattatgcaaattcaactatatagtaaagtcaaattatattctctaaaaatcactcctaaatactgtgttatataatcaagactagaaggcaggtattactctcattcacttattaattcacttattcaccaactcttgattgatcaacttttatgggctaggctctctattgtttctagggctatgtagatcaaaagacttcacacccttgaggagtccagcctagggaaagccaggcttatgcactgatagataactttattatgatacaagttataataactgtcttaatcaaatgtgtagaatacagaagagatcgtgacagctctgcttgagtgagccagggaagacttcacagaggagagaatatctgaggtgggacttgaagaatatttctgagcaggataggagagggcatgtagtatagggagtggcttatgtagtttttcagcttccatttaatgagttagcttgggttatccagaaagcctttgagagttaaatcagtatgttccttccttcccctactctcatcctagttggccagcttcatctatttatgcatcaatgcgttaaatagaaacttaatgtaagtttattcttgttagaacaaatacatatcatggtaagcctcgggaaatatatgtcatgtcaaaatgatagcacaaaagaatatttaattggtcatctagggttgatgtaataaggttttaacctattaaagcatctattcagttcatctttaagtacctattgtgtgtcaggtactgtgctaggataataatacatattaattttttaaattaattaactgaaaaaatatcgattgactaaagtaaaacaatataaacttgcaaagaggcagcactgttttataaactccagagagcatttgtttaaacctgtatcagacagcaaaaagggcaatagttgcaaatattaatttggtagttgctggcaaaaattctttttgaaataataaaaaacaactgcaagagtggcccattttaagattctgaaaattctctgctttcttgagcattatatggacagaaaaattttccctgcatttattcacatcagattactggtactgctcagagtaaagcctgtcttctttctgttctccagtgtataattgtagcagatggcttttaataaaacatttagctaaagaagaatttttactctgggttggtggaatgtattataatgataatattggaaattctcaagaggagatgtttaatttggtatttttcttttgattgaataatgtttggtgaataattgaaaagtcaaattatagtatctgctacatcgttttttatttgttaagtttcaaaactaaattaaatcatgtagatgagtcatgtagccaagtaaatatttgctttttctttacatggtttactttttaaacattaaggcagtttatcctagtaaaataacactcaatactagattttattgagagtcagagcatcgcttaattatatggctgctctgttctctgtcatcaccttgtctaggtgtaggctttgagctttttgatagaatgaggttattccagctgtgtctgtaccattggtatttataaaaaccacaggctgttgtataaaaaccacattactgatataaatacaaaatttacaaagatctcatcagaaaatgtatagttactaaaaatttactaaccacaacaatgaggcaggcaaggagaataaagagtactcattgtgttgtaatgtaaatgccttgaatatgtaggtactggaaagtctttattaaaatgaactaagaattggctgggtgcggtggctcacacctataatcccagcagtttgggaggctgaggtgggctgattgcttgagcctaggagttcgagaccagcctgggccacatggtgaaaccctgtctctacaaaaaatacaaaaattaactgggtgtggcgacacatgcttgtagtcccagctacttgggaggctggggtgggaggatcacttgagcccgggaggcagaggttgcagtgagccaagatcacgccactgcactccagcctgggtgacagagtgagaccctgtatcaaaaaaataaaagaaaaaaagaaaaaagaaagagaaactaagaattaatgaaagaggttctttaagaaaatatacaatttattttctcttttcttgcataattatatatttgcttatggttaatttttttacagaataatttaaatcaaattttcttgatccccatcctttgagatctttcatttactgtctgtctatagtgatatctacatatataaaaactgtaattatatgtgaatttgagaagtaacagttttcttctcaactctccaacactgtgtataaaatttaaaatatactctaagtattttcatgtacttaagtgatatattctattattagtaacaaatatagtttttgttatccttcaaatgtgtttaatagttttgaggtaaattaaggaagatataactttttaatattaccttcattttcatattatggaattagagtaggagtatactgttttgaagaaagatgttagaggttattgttgagcatagatcatttcatggcttacatggtttactttttaaaaacttaaggcagtgttagtcaaataacaatactagatttcactgagagtcagaggattgcttaattatacgactgccttgttctttgtcatcaccttgtgtagttttgtaggctttaatcagtaataaaatcagtacttgcctgggcatggtggctcatgctttaatctcaatactttggaaagccaaggcaggaagatctcgagtccaggagttaaagacgctgtctctacaaaaaatacaaaaattagctgggtgtggtgccacatgcctatggttacagccactcgggaggctgaagtgggaggatcacttgagcctaggaggctgcagtgagctgtgattgtgccatttgccattttaatgacaaaacccacaattacttttgcatcaacctagtctcatattttcaagagcctgggattacactcctgtattccaatttcataataactttattgacattagcacatatttctagaacatatttaatttatgtttcattgggtaatatggtgtggtgagttctctctagggattttgctttgtctttgatttacttttccatttaaatttatgaaatttatgtttagatgtgtttactattgattacggctgaggtgaaaaaagggataggcagctgatacccatgaggcacctacctcctgccccaacatgttatacatttctgcacatgttttggtcacagttccattttgcagcctcttatttgattgcttcatgaatctgtttctcagtatcttctttcatttttgtgtctctttatgtttttttttttgtctctccattatatctttaattttcttttttacctgcctccctttcttaattgtccaaaatctagagttgactcttaaagaatgcaggggttagtggctggcttccatctcaaggcagttgaaaaattgtgtataaccttttactccccccagatctaactattaatagcctattgttgagtggaagccttaccaataacataggcagtcagttaacatgtatcttgtattatgcaaaaagtccaaggattttgcatgtgctgatgtagctgcattgacagcttcatgaatttcctctttaattattattattatcattattttttactgttgtccttttgctggattcatttatctcaaagtagtggacatccgcagctgcagacttcagtgtgtggtacttattcagaattcagctttttcttgtaatgtgacttttctgtgcttcttgaaagcacttttagcttcactagtggcacttcatatgggtcacatggtgttactcaagttttatggtattgcactaaacaatgagaaatatgtgagaaccatgatcactttttacaatgataaaatgtactggagagatgaactgctcacatggagatgattagcattacacggcatttcaagcagatacactcaccacaatagcaacccgagatggggttgaaaattttacagttgcatagtatgtactacatttaactttatatagttttgatgtaatactgcatctttatgtttgttttgtgtttttcaaattttattttagattcagggggtacatatgcaggtttgttacctgaatgtattgcatgatgctgaagttttgggtgtgaatgatcctatcacttgggtaatgagcatagtaccccagtacttagtttttcagcccttgtctccttcagccttctgttagcctccattgtctgttgttgccatctttatgtccatgactacccaatgtttatctcccactcataagtgagaacatgtggtacttggttttctgtttttttgttaatttggttaggataatggcctccagctgcatccacattgctgcataggacatgatttcattcttttctgtggctgcatagtattgtatggtgtatatataccacattttctttttccaacccactgttgatgggcacttgtgttgactccatgtctttgttattgtgaatagtgctgcagtgaacatgcaaacgtgtgtcttttcgatagaaatatttgttttcttttggatatatacccaatagtaggattgctgggttgaactgggtagaatggtagttatttgagaaatctctaaagcattccacagtggctgtaataatttacattcccaccaacagtgtctacgtgttaattcccctttctctgtagccttgtgagcatctgttgtttttttttgactttttagtaatagccattttggctagtatgacatggtttctcattgtgattttgatttgcctttctcagattagtgatgttgagcattttttcatgtttgttggctgcttgtttgtcttcttttgagaagtgtctattcatatcttttgcctgctttttaatggtgttatttgttttgtgcttgttgaattttttaagttccttatagattctaatgttagacctttgtcagatacgtagtttctgagtatgttctcctattctgtaggttttctgtttactctattgatagtttcttttcctgtgcagaagctcttcagtttaattaggtcctacttgttaatttatgttttcttgcaattgtttttgagggtttagtcataaattattgttacaggaagtcagggaccccgaacggagggaccagctggagctgcggcagaagaacataaattgtggagatttcattttaatatggacatatgtcagttcccaaaattaatacttttataatttcttatgcctgtctttactgcaatctctgaacataaattgtgaagatttcatggacatttatcagtccccaaataatactcttataatttcttacacctgtcttactttaatctcttaatcctgttatcttcgtaagctgaggatgtacatcacttcgggagcactataattgtatgtaactgtacaaattgattgtaaaacgtgtgtttgaacaatatgaaatcagtgcaccttgaaaaagaacagaataacacgattttcaggaaacaagggaagacaaccataatgtctgactgcctgcggggtcgggcagaatagagccatatttttcttcttgcagagagcctataaatggatgtgcaagtagggaagatatcgctgaattcttttcctagcaaggaatattaataattaagaccctgggaaaggaatgcattcctggggaggggtctataaacggccactctggaagtatctgtcttatgcagttgagataaggactgaaattcaccctggtctcctgccgtaccctcaggcttactaggattgggaaaccccaccctggtaaatttgaggtcagactggttctctgctctcgaaccctgttttctgttgtttaagatgtttatcaagacaatacgtgcacagctgaacatagacccttatcaggagtttttgattttgccctttgccttgtgatctttgctttgccctttgccctgtgatctttattggcctcagaagcatgtgatctttgttatcctttttgccctttgaagcatgtgatctttgtgacctactccctgtttgtacaccccctccccttttgaagtccttaataaaaacctactggttttgtggcccaggtgggcatcacggtcctacagatatgctgtgtcacccctggaggcccagtaaaattcctctctttgtactctttctctttatttctcagactggccgacacttagggaaaataggacttacgttgaaatattgggggtgggttcccccgataaattatttcccaaggctgatgtccagaatggtgttccctaggttttcttctagatttttagagtttgaggtcttacatttaaaaattttaattcatctggagttaatttttgtgtatggtgacagataagggtccagtttctttcttctgcatatggctagccaactatcccgtaatagcagggataatgtgtggctaagtcttttcaccatttattgaataaggagccctttccctattgcttatttttgttgactttgttgaggatcagatggctgtaggtgtgtggctttatttctgcgttctttattttgttggtttatgtatctgtttttgtaccaattatcatgctgttttggttactgtagccttatatatagtatgaattcaggtaatgtgatgcctccagctttgttctttttgcttagaatgctttggctatttgggccattttttggttccatatgaattttagaatagtttttttctagttctgtgaaaactaatgttggtagttgaatagaaatagcattcaatctcttgctttctttgggcagtatggccactttaatgaaattgattcttccaatccatgatcgtggaattttttaaaaattgtttctgtcatttcagatttatttgagcaatgttttgtagttctccttgtagaaatcttttacctccttggttagatgtattcctaggtatatttttttgtgtatgtggctaattgtgggattgtgttcttgatttggctctcagcttgaacgatattgctatatagaaatgctactgatttttgtgtgctgattttttatcttaaaacttttctgaagtcatttatcagttccaggaaccttctggcagagtctttagggttttctagtataggatcacatcatcagtgaagagagatcatttgacttcttcttttccaatttggatgcctttctttctcttgcctgattgctctgggtaggacttccattactatgttgaataggagtgatgagagtgggcatccttgtcttgttcattctcaaggggaatgctttcagtttttacctgttcagtatgatgtttgctgtgggtttgtcatgaatggttcctgttattttgaggtatgttgctttgattcctggtttcttgagtatttttatcatgaagggatgttggattttatcaaaagcttttttcacatttattgagatgatcacatggcttttgtttttgtttttgattctgtttatgtgttcaatcaaatttattaaatttttgatacactgttgagtttggtttgttagtattttgttggggatttttccatctatgttcactagggatattgggctaagttttctgtttctgttgtgtctttgccaggttttggtatcagattgatgctgactctgattttatttacttcaaagtaatttttgatttctgccttaatttcattgtttacccaaaagtcattcaggagcaggtcatttaatttctatgtaactgtgtggttttgagagagctttttgatactgatttctatttgtattccactgtggtccaagagtatggtttgtgtgactttttaaaaaatttattgagacttgcattgtggctgagcatgtgattgatcttggagtatgttctgggtgcagatgagaaagatatatattctgtggttgatgggtagagtatcccgtagatgtttattaagtccaactggacaagtgtcaagtttaagttcaggatttctttgttagttttctgctttgatgatgtgtctaatgctgtcagtggggtgttgaagttccccactattactgtgtggctaagtcttttcataggtatagacatacttgtttataccccaaacttgggcgtgtatatatttaagatagttaagtcttcttgttgaattgaactctttatcattatgtaatacctttatttgttcacttttacttttgttggcttaaagtgtgttttatctaatataagaacagccacccttgcccatttatgttttccatttgcatggtagatcttcctccatccctttatattgaggctttgggtgttattatgtgtgagatgggtctcttgaagacagcagatgtatgaatctttttatccaacttgtgattctgtgccttttaagtggggtgttttgaccatttacattcaacattaatattgataatgtgagattttgatgctatcataaagttgttagttggttgctttgtagtttctattgtgttgtttcctgatagggtctgtgggctatgtacttaagtgtgtttttgggtagaggaggtatctttccttcatttccatgtatagaaatatcttaaggatcccttgtaaaactggtttagtggtaatgaattcccttagcacttgctcgtctgaaaaaggttttatttctcttttgcttatgaagcttagtttggcagaatatgaaattcttagttggaattttttttctttaagaatgcttaaaaaaggcccccagtctctcctggcttgtaatgtttctgatgaaaagtccactgttagcctgatggggttccctttgtacatgatctgacctttttctctagctgtctttaaaatttttttctttagcattgagcttggacagtcttgtgactatatatcctggtgatgttcattttgtgtagtatctcacagatattctctattcttgtatctggatgtctacctctctagcaagattagggaagttttcttgaattattcactcaaatatgtttttcagattgtttactttttctcctttctcaggaatgccagtaattcatagatttggtcattttacataatcctatttttatcaaagactttgttcatttttaaaaattcttttttctttatttttgttgactgtattagttcaaaacactggtcttcaggctctgagattctttcctcaacatggtctcttctgttgctaacacattcaattgtattttgaaattccttaagtgaattttttaatgactgaagctgtcattgatttatttttaaagatatttctctcttatttcctggcttgctttagacgtttgtgtcgattttcaaccttgtcttgaatctcattgagcttccttgcaatccatgctttgaattctttctgtcatttatgagtttccattttagttggggaccattgcttgacagctctaaggccatcccttggtagtgtcactacattgagatttttcatggtgccagaattcttgtactggttccttctcatctgaagacactggtacttctaatttttgtcattattttctcgcaggtatgattgtttttctttcttcatttccctatagtgttattttattttttctgtaccctcctccccccctttctctatgggtgagactgcagagaattctggttagggtcttttggctttgcttctatagccctatgcacttctttgggcaagttttatattgggctgtgcaatttaatgtacaagccagtagatgacgctaggcagccaatgcagttgggtatatacttgattcttgtttattttcggaagctctctgttgtgtcaggcagtgtactgattctttgaatgcacagtggtcgagctccctgcttaactaccataggacagaggccatgaaggcagggatagaccagcacatctgcccacacgtcccctgatggcaggcacttaaatttctctcaactgtgaatggcaccatgtatggtctgtaagtgtttgtatatgtaagtttttataaattataatttttaatgacagatttgtatatattttatggcagtaaattataacagactagtagctacatatatttcgtgcattcatgatataattttttcttaatttttttgatatttctaggccacatggttggcatgtttttcatgttatcacagatcttcaaaaaattttccaatacagtttttaaaaaaaatccacatataattggacccatttatttcaaactcatgttgttcaagggtcagctgtagttctgaaaagtgatattcattatgtgttgttttttatttgctgttttactttccctttcagtttctcagattagtctgcttttcggttgtatgacttttagttgatttttaaattgacaggatagtaggctgtcctactatctaggatactgtcctactatataggatcctactatactaatgagagaaactgtgttctttcattgtactttatatgcccagggcctggtactagcccttaataaataagcattgaatgactctatgaattaaacttagtgctccatgatttttttttaaaggagaagtgaattgtctgtggcactgtaattggagaatttgatttaaagttacaaattttggtagaaaactttaagttatataccatagctgattaattgaagtcttactttttttcaccacatttaatgagtagatcctggggaccagatacaaactagtttttttcactataattactacttatgaaatagaagtgtagttgctaatatgcacacctcaaaatatgacctatcatacatctattgaaaactagtttcctagtttttactgcctttttctatcaaatagaaaaaaaaatggaaaaaccatttaatggaaagccattgagtgaatttaagattattgttggccttggaaaaattcagttcctctgtgaaatttcttgagcttcttcaaaaatattctatgtaaataccatattggggatattattgatactgtaaaatctttttagactttaaagctttattccataaactggcttgtgatttaattaatatattgttcttttaacattattcgttagattgtttcaaagtatttcaattaattcaatatgttgcaatgttaaaataataactataccattttattaggattctttattcagttcctttttccctgtattaaatctttacattttctagattaacaatttattttatcagtaatacttccattaagcacataatagacttcaattttctacatacaaacatttttattcctaataagtgatgaacaggctcagtaaaagttgctaagaatgtttgtattgctggattggaatatcatggatatgcatactttttttttccataggagagagctttaattgttactaaagtcaggaaaattcagtcacttttgcactttgagaagctgatctctgacatgtttatgaaaactgcttaatcttttaataggtgacaaattttttgaagacagcatcatgacgcttctaccttgatacctgcaaaaatgatgtgaaaaggagcaattttcattttgctctttatatcttcagttctggtgtgaagtagaatggcaattttggattgaaagcttatcttaatttttctacccatctgtctagttggcatttagatattctaagtaaggctccatttcttcatagagattctttaatcgatgttactgtagctttctttctttactttccagggacctcagatcttattttcaaagctcaagtatttgcaggggtgattctggtatgttcacataatttttgactcattcagtcttataaatttgacctgggattcaaaatgcttattgatctttattttatactatttaaaatcaagactttctgcataaactataccagaaccttaaattaagtacttaaggaatttccctagaaaatttacatatatatatatatatacacacacattttttttttcctgtttggcctgatgatatgtctcttgctgtgagctgcagtttttccaactcacttctgctgtgacagaccatatcccatttggacaaaaaatagattgagcttaatactaggaaaaagattatgcttaactattactatgaagagaataattgttcatcccagtggcagactgtagtcttgcattaagtgttctgggactaattaatcaggaaacaactattattaaaaaggaaactgctcatcagctgcctgcttgggctattccacagaaagaaactgtagacctggctacttggactccatcttgtagcatcattctttaactgcttatgtcccagttaaaagaggtaatttaaggatttttagcagaccttatttggtagtgataaactttaatattaaattaatattaatggacttgttgagtataaattaacataaaaacaataatattgggttagaatattttggtcaatctggaaggcttcttaacttctaatcttaccacattttaaatcctggaacaagccatgctgcttacatataatcctagtagacagcatttgagtgtgtatgtaaatatatataaacaaacgtgtttgtcatgcaagatgaaaatttaaaaatctaaccattactgaattaagtatatcatattgacatttctgttgacttactagtttatttggcttaactaaagtcttagagaattactatataagagagtattttaacttaacaagagtatgtgcattacgtatgtgttatatgtgttgtttcccaggctgctttgtgtttgtaagatgattattatatctaggatttgaggtgtttcttaatttaccaaacgggaattgattataaactaatgagaattttataattgttcttgatgttgtttttgttaattttacctcttctttttttgatgtttgtcctaatacgtatacaccatcacaagtttattagtttctaaaataagcaagtagttggatgaattaggaaggtttttggcattactttcaatggcaaaaaccgcaattacttttgcaccagcctagtaagaactggaaagctactctcagtgaagactggaattttaacttattcttcttatatccttcccacccttctgtccccaaccaccatttattaatggacacataatacgtatactctgagcatatttttatgaagccaatttgaattgtggcccattggggattaatttattctgtgctattgtagtatttcaaatcagttatagttcaaggtgctaaatcttatacaaatgatgctgcattacagtctaatgtttacaaacttcatggcacgcttagccagggaaaacaatcttgcgaatgttgggggtaattgccttttaataggtagatgcagttctactggcttgtttgtttaaacaaaggaagaaacttattaaatgcccaacttatatgtgatgcatctaatggaaacaagacagtatcttgaacaagaacagtgataaagcctagagccatgggttttattcaagttttgtatctctgggcttatatttttaatagtttgttttaaactttgggtatatggatttgtattaattgctataacttactcaaatattcaccttactggaagtattgttgtgtgtgtatttaacacagtcgttttaagaatcacatattaatttacttttgtgactcattagtggactatattgatttcaaataataatattacagttaacatagaagtctaaaagctgagttacccagcccaagtcaaatagaaaatgtgttttagaactggaaatagaaacgggagttactaataatgtgtctgtgatttctaactctctttttgatgttttccactgaacattacttggagcataatatcatagagaatttttttatattgtgataaaattgcttatcaaagtttccattaataaatagtacttccacagactaaacactaagaggcaacttattggctctccagaggtgaaatttcaaatgctgaggcatggctgcacatatgcagaacttgttttgcttgttggttgtgttgcttaccggtgcttagtgcctgtcttccttggtgtatgtgaggcaatggatgaaagctgtacatcactccaaaatgatgctgaactgattctagtttgacacttgaattaccttctttcctaagataacacgtcttgttcagtttcaatgaggtagtagatattatttccacagatattgtttatggaactcaatgtagaatgattttttaccatataagaggaaaaattatcttgttgctaaattctatccagtttggaccagtacaatggtgtcttaagtcactggataattattgaatgtaaggtccctgtgatggcacattaatgctttgagagaatggttataattaaatcatgatgatgtctttttatcctggatagagatagtctataagaatgcctgtagcagtggagtgtccttgaaatatgagggaaacacatgtcttaccttagtaatcttaatggttctttaaggattctatgatgcttcaggggcactatgatgcttcaggggcactccaagcaatttttaatgagtccttagtctcatgaaaatatggcaggaaaattatacaccaacatttcatcattttaatcctgtgtagtgtctaaattttagaatacagtctgggtgcggtggctcatgcctataatcccagcactttgggaggctgaggcaggtggattacttgaggtcaggagttcaagaccagcctgggcaacatgatgaaaccctgtctctacgaaaatgcaaaaattagccaggtgtggtagtgtgcacctgtaatcccagctgctcaggaggctgaggcaggagaatcgcttgaacctaggaggtggaggttgcagtgagctgagattgtgccacttcactccagcctgggcaacagagtgagactccatctctaaataaataaattaattaagaatacaatataaggtaccaattccatacctctcttcattcaagtcttgatttaatggttagagtacttagtttttgataatctattcttggtttatttacattcagttttaattttactgctgcctgttatttgtcagaaacattacctaggacagatctcaaagtttaatgtgcattcaaaccacctgcggatcttgttaaaatgcaaattcagtagatctgggatagagcttgggattctcatttcgaacaagctatcaggcaatgtcaacactactactagttagggatctcactttgaaccaagggtctagatcatagactgtaaactctagaatgtttctgaaatattttttggattattattagctcagtgaattcatgagattatttctggctcactttagttttaagaaaataaatatgctaaaaatgtacactatatcttactattttctttaaaacagtttttaaaattttctgtaactgtggtttgctttcattgtaatagagagttcatagcttaatttgttattgtaaaaagatggacacatagtataatttaaaacttaaaatagttacagttcactatcaaaagaatattatgtaaataaatataaaatgaactatgaaagtgagctaaagttacttgccttataaggtttaagttattttttcttaatttatgctttatgtaacaactaaatcatctgacatttgtcttttatttgatgtgaaagtaggaagaaaagtcagagaatcaaagaagcagaagatgattcttttgaatgtttttttctcttgggttttggctgtccgctttcatttttgattccggctgcttctttaacttttttcacatgtatagaggcatttaaattttccatttgagcccaagaaacaagaattagattttacttccatgaatcttcattcttatactattaatattcaacacagttaaaaccataatacattttacttcccaggaagaaaagttttgtttcccattccttctctcgggttatatactgagagaagagggctttaatgaaaaagccaaccacattaatttaaaatgttctatcatggagctagtagtttaacacagagtttaaggttcttggaggcccaacctcctttttttttttttttttttaaatggatagagatgtagccagaaagctagaaaggtattgtgacaaacagctctctgggaaaacctggccagtgtttttgctgtggaaatgtagtggcacatactaaaagcattaactcagcctctttattttcactaccttttagtaatcattcccaagaagaaaaagagttaagatgttattcatgatatagttgattactgacatagagataatgatatgaatcttgaacatacaatttactaatctagattgttgactgagagaacattaggttgaatgttaactaatttaatatgttgggttgctttttaaatgacattcatcatttaagacatctctagtattattctaaattatcaagaggatttataaactagcttttaatttcattcctgatatgccttttatgctgcttagttttgtttgagtatccagtgtggattctgggtgttttgtttttttttttttttgagacggagtcttgctctgtcacccaggctggagtgcagtggcgtaagctcggctcactgcaagctccacctcctgggttcacgccattctcctgtctcagcctcccgagtagctgggactacaggcgcccgccaccacgcccggctaatttttttgtatttttagtagagatggggtttcaccgtgttcgccaggatggtctcgatctcctgacttcatgatctgccctccttggcctcccaaagtgctgggattacaggtgtgagccaccgcgcctggctggattcaggttttatagggcatgaagcttatataatttggaggcaacagctctttaaggacaagatcccattgtgggtgtgggtgcaaattttacaaaagtatataatgatgtgaatgtgtttctagggacccttctgggacagaatgaagacaagctaagcttcatcttctgctactatcacaaactgagatgacacttcatatttttttttatcttgaagggtagtccactatatttggaaagagcataggcttatgttacaactgggattcaaaaatgggccttctccatcttctttgctaccgttagagtcttacgtacatctttttcctaggcaacaacagctttcaaaatggtattcacatttccatctttgtttttttacacactccttccctatagcctgttctctacagtgcagctgaagaaccctttttaaaaatgtttcagtgacatattcaggatatagaataaaatccagaatttttaaactattttcagtgttcttcattcattcccaaaatctaagtttctctctgctgtcatttctcttgagcctgaaataatttttttagcacttcttatggttcaggtctgttggtgaaaacttctcttagatttcctttatttgaacattctctattttgcctttattctttattcttgcagggtgttttcactggactactgagttgacagtttttgctttcagcattttgaaaatgttccactgccctctggtcttcatactgcctgatgaaagtttgtgttttttgttgttgtttgtttgttttgtgtgtttttgtttttgagacggagtctcactctgttgcccaggctggagtacagtggcacgatctcggctcactgcaaactctgcatactgggttcaagtgattctcctgccttatcctcctgagtagctgggattacaggcatgtgccaccatgcctggctaatttttgtatttttagtagagacagggtttcgctatattggccaggctggtcttgaactcctgacctcaggtgatctgcctgcctcagcttctcaaagtgctgggattacaggtgtgagccaacacgcccagcctctgatgaaagtttatcatcattccaggattggtttcataggcatgtgacctatgttgttgcataggtacccgtacttagaaagatcctgtgtttcattaaatgttctactattgctatcttgatacgcttaatggcttttgaacaagggccctgtattttcattttgcactgattctgtggtttcttctattttatatatattatacatgaaacaaaccagaaaatcttctctgcctattgggtaagaattgtcttgtatctaggctgcctgtgctagataataaggatcatcaagatttaagtagatttttttttaaacattcgaccaacttccaaaaacagtttttaggaatagaaaataaaatttataataataagaatactcattcatatttcacagacattcatagtttataaggttatttccatatactttctaattttatccttataaaagccctatgagttaggccagtaataattctatccccttttattgatatgcaaatacaggcccaagagaagttatatgaattaatcttaaatcagtcaggtaaccattcttctctgattaaaatctagtttaagattttttttctctagctgagcacggtggcctgtaatcccagcactttgggaggccaaggcaggcggatcacctgaggtctggagtttgagaccagcttggccaacatggtgaaactctgtctctactaaaaatacaaaaattagctggtgtgatagcacacatctgtaatcccagatacttgggaagctgaggcacgagaatcgcttgaaccccggaggtggaggttgcagtgagccgagatcatgccactgcactttagcctgggtgatagagtgagattctgtccaaaaaaaaaaaaaaaaaaaaaattttttttgaaccattatagctaaaaatagtgaatagtgacattttttagcacacttttttcccaaaatgtttcataaatataatttcatttaacctttcagctagccatctgatataagcagtattcattatcagtgtatttcccttttttgaaatgaaaaagatctaaaggtacaaaaaattatttgtatgggttacataagtaatgtaggatctaaagctgtcacccaaatctctaactctaaattgtgtccatttttttaatattgcactatcttttgttgtttagagatgaattcaacaatatacaatatacatttattattagctcaccaatatttttactttgtgtctttagactgcatctgatgtcgtaggaagcactcaacactttattgaatcaacaaataatgaatgtaaaaaatatcttttggcagcatctgatgtcctttggacttttgcttctttattctgttctggaaaatgtactatgaataaaactgctttttctctaatctcaaatgaactgcataatatttccaaaatgccgtatacctgcattttgaattatgagtcaactgataaaaaaatttaaaagacttctgggccaaaagggctatttacatgctaagtaatatgccttgggatgaaaacacattataaatatttatatttaaccaattttctctaaacccttttggaggtcttttgaagatttctttgtttgctccttcctagttcgctttctccctcccttttttcctccctttcttatagggaatgctattctgtaaaagctatattctatcttctgccaaaccctcaaatctaattttggaacaacttctgtaggtaatttaagtacagaagatagatttaatgttcattttacttttgatttatatatgacatctgtttggaaccaaactttctctgtttttagaaacagagaaaaaaaatattttgggatatgtaggccagaggcaaatgatctgacaagttagcccccttgtttctaaaggaaaaattgccacagtttataagagtggtataaaggccaagaagttgaccaagaccaaaggagatcacaaagaaagcatagcatatagtagactttcaagaaagaagtttactgaatgatgaaggaaaatatgtgtctatggtttttatggcctacctagcatataggatatatcttctttttttccgacccactaccaaagaagagttataaaattcctgtcttcagtcgtgttgacctaaaataagatgtactgtggtatgacaataccaacctttatgtgccttattttcagactttgtgcctttagcttaagtagagatattggctaatagctgtaagtcttgctacttttctgttctcagtgtgatgttcaaaattagtgaaatgcagacttttatttctttcctcaaatgtaagtcatttctgtttctgtagttattaaatgctttttgataatatgaaaaaatatacactgcattggcttttaggaacattttcgtcatatatatttcaaactttaattaggacctctaacaacaaccatgttttaaaacaaagtttggcagcagttggctttttgttttctttatagaaattgaaaaggtgctagaagaaggtgctgagtaattttaaccacatgcaatgtagtaatcacctggaaatcacacactttctcaattgtcttattgctactatgaaaaacaggaataaattttagtcattaatacatttattctttttttccagagaaaaattgaagctgaatttaacacattttattgacttgtatatcacatcattcatgacacaatttatattttatttgtgcacatgattaacactttattggaattattactattataaaattgtaagatacaattggatccaaattttttgtggaattaaaataagccaacaataggattatctttaagcatttagaacagaatgggttaaactgtcattattggtcagaacaagcaaataataggatgttttacattttattttgttgctggttttggttggtatagaacattattatatacaaaatactatttgagatgtgtatatcataaactatagcattgggaatcttttggtcatgccgaggtttttcattggaatttgttgtagcatttgctgtaactggatttgacctgtataaccaatagatagtgtaggatgttatcctttaccagtagttttctgtaactattatgtgtacagtctttgtgtctcagcccacatttataatatctgcacatcttaacaggcacctttttgaatgtaaacatttcagagctctcaagaacttaaagacatctaatcttgctattgcatgcttcaggtggtaagcatgtcactttaaaaaataagacagatagccatttaggactgggagaagctgtgaatttctctctgtcatccagtgaataagtggactagaactttcctctgttatttccagtagtgtttggcaaagatatgaagaatatttgcaacaagtgaatttagaatttgtcacaaacttagattctcatgaaatcccccaaaatgtgaggaacaaattagacataacttaatggtctttatactaacagagttttataaaatcggataagtaaaacaaaacagaaacaaacaccttagtctcactgtcttgtctgttatattttattaatgatgcggtttagacatattttccattaatacagtgtatgcctgtgttacttaataattgaagtttcttttaactctgttcatgttggttaaaaccattttttatgtgaagttaaaatttacagatataaagacattccagggatattgggtaaatggttcttctgaaaatttccaaaactttttaaacacccatttcgtacacatataaacaaatgttagttgtaactgccatacgtctagtttattagcaagttcaaaggatttgaactatatttataaataagtttcttctatttagagggaagaaaagttatttgttgaatatcgttgtaattacttgagtgatacagttttgctattttacaatcaatcattgttctcataaagttctgtaggaaatactgcctatttaatacctttacacttgaacaccaccaacaattttgtttcccttcagggcatacagctgtttccagcctactcagtgccatgtcaggacataaaattatcttgacagcaagatttaaattataaatagtcccataatgacattcagcttgggcggtacatttataaaagtagttattaaggaaaatgtaattcaacccattactataactagattctctcacatttctgaagctgtcttttggtagcccgataatatttgcatatgtaagcatttaaactattaaggctatcaagtcaacaagtataaaaacataatatagatattagataaatggtttcctaaaattttccaaaacttttctattacaaatacgtcttaatatatgtctttgccctatgaaaactgataaaatattggggagttgagaccccaagatcttgatattattcaaaaagcatagactggaaatactttatatataatgaaagaagaaaagaactagaagtcgatttatcttataagcaacatcagaatattggatagtgaataacattttatgagcacttttttcctagagtaaatgttgactgtaagttacttggtgttagtgttctgatttttaaatacccaatttaccatcttattagtacatttagatcctatgagaatgtacttttagccaaagtcatatttttctctgaaaaaattatatttattctaaaaaagctttactatttgaataagtgttgctgtgagtctattttatgctgcgtgtgtacctagttatttcagcatctgaaagtagagatacgtaacagaaagtgaatgggaagatcagtcaatcataacaatatgtaatatgggtccatgttgcagagccacacttatcaaagctttagcctgtgttgtggtcatcactgaaaaaatctagagcatagctggtttgaagctggcatggtggagatgttagtgttagattaacagtaacatttaacctctgtgatataaacctctatgaaacctctgtttaacataaacctccgcatgtttatgtgtgtgtgtgtgtgtgtgtgtgtgtgtgtgtgtgtgtgaacattgattttatttctgaagtctgtagtttataaacattattgcattgtgctgcttagtgggccaaaaattacccaagatgattgctgatcccaacttcgatcttctaattcagtttttaatcaaattttctttttttgattttgactccttctcaatagagatatttcttaccgggcttctgccagtttagcaacttcatttctctcttaagcatgtcttagaaacagcctaatgtatttattctttcctttcccaatttctgtctcttaaaaagggatttctgtcaaaggttcagtgttctgagttgttccctatgctacctaatcactttagccacttagctttgaaactgcctgatgaaaaaggaagttgtactggcatatgtaggtcagttcctttgatttctcatttttcttattcccctagatagaatgatgagaaagtttagtatttttagctttcttttaaacagctttatattctgggtggttttaagccaccccaatttctgatattttaaaagaatcctggtgtttattctagataagacacctactatataaaataatattttatgttgatgttcaacaggaaagggacactaatcagtccacctgatttatttagcaaatattattaccttctactgtgtgccaggcactgtacttgccactgaggataacagcaatgaaatatgttatcagaggagctccactgcctagtgaagaagatgatcaagcacactcagacctgtgttggttagtcaatggaattgcttagtaaattatttcgggtccctgcagtacggtctttttgatcttctagtgaatacatccctggtctgagagttagaaggttttcataccatttctttctgctggcatttcatctttcatcatatatttaatacagtataatcttgagtaagccatacatcatttttataaagttagtaatgtctgttacaacatattatgagatctttgggacagaaatgctgagtcaacagaaacattatcctttcaacaaacatgcactgagtacgtatgattgaagcactatgtgttaggctccctgagtgatacagagataagcgagacaattatctaggtctaggagctgacaatgcagtgtattggatggaaacgaggtatgggggaagtgtagaggagggcataacagttaagacatttctttagtgctttcttgtacaaagcaaatgtatgtttaaatgagaatcttattattaactttattctctctaaccctttatctcttcataatgatttgtagttggagattttccaaacctcagtgggcactgtaaactcaaaaattaagttagtttattatcaacttatttaaatagtgttctttagctttgccttcactttcacttgcattgccagagtacttaatcgttattaagagatattttttaaaaattctactatttgtgtcagggttttcaactttgaaaaatatgccaaaccatttcatcgggaaaaaaaaagtcctcaaagaccctcttttcaccagtgttgagtgtgtgtattttatccagtgttgggtgtgtgtattttatccagtgttatctaaatacatggagatatacaattaaatgcaaactatactcttaactctcatgaccataatctattagaagcaaactataaaatcaataaaaatgtatatttgccatattaatctaatgttataaattaggttgtcttccagaaaataaattactgctgacagtgtgaatatgatactgagagctacaacacagatttttttttgagctttcttttaaaaagcactattacagctatgtaaaattaaattaggttctttttctggtgctttttcagtgcttgcaattccttttttaaaaactaggacaattaagattttattgtgtgatgctggtaagcatggagtagaataaagcagggtattgtaaatcattaatctaaaggatagtaatatttattttaatgaaaggcaatagaattatattaggctagctttaaaataatagtggccatcactagtcgtcttcttcactggataagatagttaaaggaagggcatttgtgttttttgaaggcattatatttctacagagttatgaggatctataatatatataacaggctttccctaaccaacaagcccctttctaggtctaaggaaaatccatggcactctttcccaccaagcccagcttctcaagtcttctttactagctcataagataaaccaatggagggccgggcacggtggctgatgcctgtaattccagcacttttggaggctgaggcgggtggatcacgaggtcaggagctcgagcccagcctggcaacatggtgaaaccccgtctctactaagaatacaaaaattagccagacatggtggtgggcacctgtaatcccagctactcaggaggctgaggcaggagaatcgcctcaacccgggaggcggaagttgcagtgagccgagattgtgccattgcactccagccggggtgacaagagcaagactccatctcaaaaaaaaaaaataaaaataaaaataaagataaaccagtggatttagggggaaacaaaggagacacatagagggtataaataaagcagaaaggtatggagagacatgcataggggtctgtttccagccatttccagccaagttagtctataaatactggggaaatgtgtcatgttagcaacatatattactacatttgttactgaattttggtcactagttattagcaaggaacatatgaaactaaagatgcttcttgattttttgatacaaagcatgtaaatttaaaattgtatttcccaataaggcatctctggggaaaatgaattaatttgggctacttcttagcttaaacccttcacagggctgcgtgcagtggctcacccttgttattccagcactttgggaggccgaggcgggcagtttgcttgagctcaggatgagaccagcctgggcaacatgttgaaactccatctctacaaaaaatacagaaattagccgggtgtggtggtacatgcctgtagtcccagaggctcaggtgggaggattgcttgagcccggaggaggcaagatcgcaccactgcactccagcctagatgacagagccagactctgtctgaaaaaaaaaaaaaaattttttttcaaaggccttaccacttcttatagcaccctcatgattttgttttttctgtgagaatagggttccagacctcaaacaatacctagcatgcaatagaccttcattaacattttaatttaattgaacgctaattgcatgaatctgggcacaacatgttggcagtaagtaaatcttttccatttttagtgtattctagggcagagcattcaagactggaagtatgaaagcaagttagaagagcagaaaaatccaaatttcacacaaacctaatagttagagttcagtttaacagacatttattcagtgctcaacatttcccactgttcttggaagtcagtaatatgtagggttgtctaaagccacattgttgaatatgtgtagaatgatgaaagatataagtgatataaaaaataattaaactcatgattaagattttgttttttgttttttaacttggactgcagagacatctcataaagacaagagcatgagtatttcaagttttcttttgaaaactgagtcatagatgttgcatttcaagccaaggtttgatcattctatacttcatggctttttaaaattctagttgctataacaactttgatatttctttattatttttagcacttcagttgccataacaataagatatcctaaaaaatagcaattttcttttataagagaaaattttcttttaattaaaaatgaatgtgaaccaacacttcttacctataatgtgaacccattatttaaaatgggtctgtgctcttctgttttcatacaattttagcagacttttgtaggaaatatcttaaggttcaacttttctctctctgtttttactgtacaaaagttgaagggatacagctgttttgaaccctttctatgagataattctaatttttatgggatttcattgatataaaaatgaaatgatataaaaaatttaatttccagatttgttagtttataaagcaggaaaagatcgtgattaatggatagttgtaagccatgggaaatgtaagaaacgttgaaatttccttttctcctgtgttatttttaagtgtattttcatacctgttgccatactaaaacaggtacctcctcacttatctggaaataactgacagcttaagcctgagctatggcactttactcatagagcagttacctttatttgctctttgagaaaaaattcttataagcttagtttctgatacagaagcctctagaaaataaggacagcaaattagaacaggaaggaggggctatgctgtgtttgctatgcacatagattcataaaatatagagttatgtattatttttaaggtacctaattcttatggaaatcaaacaaatccagcagctacaaaggtatgattgtatcagaagacagtattcgaattgatgttaatagtgatgatcctaggctaccaaatattaaattatgtcagaattcttggtttaagaagacagaggaatagataatacatcttttaagaatttagatgcctaatgtaatagagtaaaacaatttttttttaaaaacttgggatcatttttctttttcttttttaaagaaatagtttcaacttttatttaagattcagggatacacatgcaggtttgtcacatcagaatattgcatgatgctgaggtttggggtatggttgatcccttcacccaggtagtgagcatagtacccatagttttttaagccttactttcctctctccttcctaactctattagttcccagcatctattgttgctatctttatgtccatgagtacccaatatttacttcctacttacaagtgagaacatgggtttttggttttctattcttgcattaatttgcttaggataatagcctctggtcgcatccattctcctgcaaaagatatgatttaattttttatggctgtgtagtatcgcatgttgtctgtgtaccacatttctttgtccagtctgctagcataaaacataatattaaaaatcaattttaaaaagccccccatttatctgggaaatgtaagatccacgtaccttaggttttcgtagactaagccttggtaatttttatgttactttattgctaatcacaggattttcctaaaaaacatggtcaggttcagacaatgatatttcttttcttttctttctttttttctttttgagaaggagtctctcactgtcaccaggctggagtgcaatggcatgatctcagctgactgcaacctctgcctcctgggttcaggcaattctcctgcctcagcctcctgagtagctgggactacaagcgtgcgcctccatgcccagctaatttttgtattttcagtagggacagggtttcaccatgttggccaggatggtcttgatctcttgacctcgtgatccacctgcctcggcctctgaaagtgctagtattacaggcgtgagccactgtgcctggctgatatttcttttctttaatgtactttaaaaaaggaatggtgagggagttggcaattcaatagaaaagagaaagtgttattattaatttccaaaactcagcatgttacctgtggttgcagtttctgaaggaaaaacgattagatagaaatcttactgatggtaaaataatatgcttatcttactatcagtgagctttgaatgaatagccactgtatgctttacatgctttaagttttagttttcataaccaacttttaaaggtaagtattattatctccattttaaagatagaagctgagatacatggagagaaagatatacccaaggcctcatagttaatgagtggtgcagccatcatgccaacccaaatctgtctgactataaagcctacattctttcctctaagtcatagtatctccttgtcttcaaacttaataaatgtttattaaaggtaataacatacctagaggaaaatatgagaagaaaggtcatactgtgtatggttttattttattgctctgcatactgttttgacctattaattttgttttaaacacatattttgtgtttgagactttctcccactaagaaggtggtaaatatacacgtaaattagtatttttgtctccatttttctttatgatcgagaaacatagtggaacctctcaaagtttttgcttacttggcccattgtcttagatctcagctagctagggcagtctcaaagtgttgtataactggcatttgatatgtcttttctcagtgtctcacttgcagctgggctgttgtgtcttgagtacaaacactgagccatgagtcagatatactgattgagtgtgaaagtatgtgcaggctggatatacttactccatccaccagtatctgttcttttagacattttagtagctctcattctttatggcacattgctacaaaggattctggtatgtttctttttaaatatcattatactatataatttcctggcaatgccttaaaattcactcaaataatttagggctctcatttcgtggctttacacagaactcgaacacttgattacatgcaaatgccatctcagccttttcagtctcttcagctataacttacacaggtcttaaatgatacattttaatgagctttgacatgcatgcatgtgtgtaaccacatgtatcaagatacagaatgtttccctcttccctgaaagttccctcatacctcttgccagtcttgactggtacatgtgtgcacatgagcgcatgcgtgtacacatacacacacacacacacacacacacacacacacacacacacacaccctgcctggggcaactagggttctgatttctttcagcaaaaattagtttttcccatttcagaacttcatataaaatcatgcaatgtgtattcttcaatgtatggcttctttcctttagttttaagattcatccatgttatgtgtgtctttagtgttgttccttttcattgctatatttcattgtatggaaatatcacggtttgtttattcattcccctgttgatggatgtgcgtgggctgtttctggttttggctatttcatttttatacatactgctatgaagatttttatgcaagtcttttgtggacaatatgttttcctttctattggaaggaattgatgggagagatagggtagattttcttttaatgtcataagaaaattccaaactgtttgtcaaagttttcaaagttgagccattttacactactaccagcagtgtatggtttcagttgttctatatccctaccaacattgtactgtcagtcttttagttttagccattctagtgggtatatattggtatctcattgtgggtgtatattggtatctcatctattttgccttttcctgatgactgtgggtgctgagcattttttcattttcttaatggttatttgtatatcttcttttgtgaagtgtcttccagttttttcaccattttaattggattatttgtattcatattaacaaattgtaggagtcagttatatattttggatgcaactcctttgttagacatatgttttgctaatactgtctttggcttgctgattttcttaatgatgtcttttgctaagcagaacatttattttaagtatattttattaaacttttttatagttattgcttccagtatcctaataagtctttgtctattttttaagagacacagtcttgctctgtcacctaggctggagtgtgttggcatgaccatagctcactgtagcttagaactctggactgaagcagtcctcctgcctcagcttgcaggtagctgagactacaggtgtgcaccaccacacccagctaaattttgtttttggtacgaacaaggtcttgctatgttgcccaggcttgtcttgaactcctgggctcaagtgatcctcctcgttaggcctcccaaagtgctgggattataagtgtgagccactgcacctgttcatctttgtctatccttaagttatgaagacattcttcttctagaatgttttcctttagaagctatatatttgcagtttcaatttttttttgtttagatctatgatccatatcatttaaatttttctatatattgtgaggacatggtctaagttaatttttccccagaagattattcaaatttttctaataccatttactgagaaaattttcctttttccttgatttgttttagaatttttaattgaaattcagttgaccatataagtgtgggtttatttttagactttcttcttctcactgatcattttgtatattctttatgcaagatcttaactcttttttttattattattatactttaagttttagggtacatgtacacaacgtgcaggtttgttacatatgtatacatgtgccatgttggtgtgctgcacccattaactcgtcatttagcattaggtacatctcctaatgctatccctcccctctcccccgacaccacaaccgtccccggtgtgtgatgttccccttcctgtgtccatgtgttctcattgttcgattcccacctatgagtgaaaacatgcagtgtttgattttttgtccttgctacagttttctgagaatgatggtttccagcttcatccgtgtccctacaaaggacatgaactcatcattttttatggctgcatagtattccatggtgtatatgtgccacattttcttaatctagtctatcattgttggacatttgggttggttccaagtctttgctattttgaatagtgccacaataaccatacatgtgcatgtgtctttatagcagcatgatttataatcctttgggtatatacccagtaatgggatggctgggtcaaatggtatttctagttctacatccctgaggaattgccacactgacttccacaatggttgaactagtttatagtcccaccaacagtgtaaaagtgtcctgtttctccacatcctctccagcacctgttgtttcctgactttttaatgatcgccattctaactggtgtgagatggtatctcattgtggttttgatttgcatttctctgatggccagtcatgatgagcattttttcatgtgttttttggctgcataaatgtcttcttttgagaagtgtctgttcatatccttcacccactttttgatggggttgtttgtttttttcttgtaaatttgtttgagttcattgtagattctagatattagccctttgtcagatgagtaggctgcaaaaattttctcccattttgtaggttgcctgttcactctgatggtagtttcttttgctgtgcagaagctctttagtttaattagatcccgtttgtcaattttggcttttgttgccattgcttttggtgttttagacatgaagtccttgtccatgcctatgcttgagatctcagaatgggcagactgcctcctcaagtgggtccctgacccctgagtagcctaattgggaggcaaccccccagtaggggcagactgaaacctcacacagccaggtactcctctgagacaaaacttccagaggaacgatcaggcagcagcatttgcggttcaacaatatctgctgttctgcagccaccgctgctgatacccaggcaaacagggtctggagtggacctccaggaaactccaacagacctgcagctgagggtcctgactgttagaaggaaaactaacaaacagaaaggacatccacaccaaaaacccatctgtacgtcaccatcatcaaagaccaaaggtagataaaaccacaaagatggggagaaaacagagcagaaaaaccggaaactctaaaaatcagagtgcctctcctcctccaaaggaacgcagctcctcaccagcaacggaacaaaactggacagagaatgactttgatgagttgagagaggaaggcttcagaagatcaaactactccgagctaaaggaggaagttcgaaccaatggcaaagaagttaaaaactttgaaaaaaaattagatgaatggataactagaataaccaatgcagggaagtccttaaaggacctgatggagctgaaaaccatggcacgagagctatgtgacgaatgcacgagcctcagtaaccgattcgatcaactggaagaaagggtatcagcgatggaagacgaaatgaataaaatgaagcgtgaagagaagtttagagaaaaaagaataaaaagaaatgaacaaagcctccaagaaatatgggactatgtgagaagaccaaacctacgtgtaattggtgtacctgaaagtgacggggagaatggaaccaagttggaaaacactctgcaggatattatccaggagaacttccccaatctagcaaggcagaccaacattcaaattcaggaaatacagagaaaaccacaaagatactcctcgagaagagcaactccaagacacataattgtcagatttaccacagtggaaatgaaggaaaaaatgttaagggcagccagagagaaaggtcgggttacccacaaagggaagcccatcagactaacagctgatctctcggcagaaaccctacaagccagaagagagtgggggccaatattcaacattcttaaagaaaagaattttcaacccagaatttcatatccagccaaactaagcttcataagtgaaggagaaataaactcctttacagacaagcaaatgctgagagattttgtcaccaccagacctgccctaaaagagctcctgaaggaagcactaaacatggaaaggaacaaccggtaccagccactgcaaaaacatgccaaattgtaaagaccatcgaggctaggaagaaactgcatcaactaacgagcaagatcttaactcttaaggctttatagtatgtcttgaaatcaggttgtgccagtctttcaactttgttttttgttttttctctttcccaagatcgttttagctctcttagatcctttgtgtttacatatagattttagaattagtagcttgtcagttctacaaaaagctgcttggatttgaattgcaatagcaatgaatctgaagatcaatttgagaaaaattgacgttcttaacaatattgattctcccattgcataaagctagtaggctgggcgcagtggctcacgtctgtaatcccagcactttgggaggctgaggcaggtgatcacttgagttcaggagtttgaggccagcctggtcaacatagtgaaaccccatctgtactaaaaatataaaaattagccaggcatggtggtgggcacctgtaatcccagctacttgggaggctgaggcaggagaatcacttgaacccaggaggcggagtttgcagtgagccgagatcacgccactgcactccagcctgggagacacagcaagactctgtcaaaaaaaacccaaaaaaagtgtgtgtgtgtatatatatatatatatatatatatatatatatgactttttaatttttctcaaatgacattttatagttttcagagtagaggttttatacattttcacctactttctgtttttcaaggctactttaaatgatttattgtttttaaattttgtttcctactgtttcttacaagtatatcgaaatgcaatgatttttatatattgacctgtgttccgacaaaatttattcattaattctagtgggctcttgggaagacattttagtatttcttatgtgcacaattatatcttccttttcttgtatggcttttttttttcttgcctgttaaactggctgggacctctagtacaatgtgtatagatgtgtaagagcagatatccttccttttttcccagtctcgggaagaaagcatttaatatttcaccattaaatatttcaccattaaatattatgctagatgtaggttttcccataaagtgtctttatcaggttgaggaagttttcttttgtagtgccactaaattaacttttcttaaatattcttagttgctaataatttgtctcataatgaaatgaaattgacaacatgaaattgttttctgctcttgagcggtcactaaatcagtagattgtgatatgtttcacttcagagggtttatttgattcttggcacttagaccaagttgctttaatactacagttgatagtacatttaaagtgcattggtactgtattttgcagcatttggcattttttagatgataagtaattaaataatcattgtcaattgctagataggacttttcaaagcactagtgaaatactcagtttagtttagggagatttatagatgactaatactgcccttcatttgaatatattaggaggttaattccccctcccacaattgggaaatgcattttctagctttttcttgtgaagtttgtgtattctgagcttcacatagactgggtgttagtgtttttcagtcctttgatagactcttttagctattttatgtgctttatattaaaattatgttaaacacttatttgttcgacacctattctgtgtctagcaccgcagtgtaggcacttgaaatgcaatggcaaagaaagcagatgttgctctcctcatgggacttgtaatctagtcaagaagacaaaggtgaatgaagtaaataattataaactataatatgtgtagaatctggtctggttccctgtgagaactcaaggaagatttcccagaggaagtggtgttaaaactgagacctaaagattgcatctgaattaaataaaaagaagtgtgatggcctagtaagcagttataaatatcctgaggccgtagggaacatagcaaatatatttgtgactggtgggtgagggatatgagttggtggggaggtagaggtagtttagctaatcctaaacaacatagaagagaagtgagactggatggatgcatagagaccagtttttgtagcacctattaagatcttatcataagggcaatgtaaaaccagtgaagtattttaaaacagaagcaacgcgatctggtttgcattgtggaaaaaaatattttgtctcttttgtgaataatggattgaagagagactacaaacaactcaaggccacattggaagccactacaggtgtctaagcacaagatgatgctggtttgctagggtaatgatagtgaagatggagaaaagttaccaggtaggagaagtagttgaggaaataggtaaattctgaatgcgtaagccttttggtacatttttaaatttattgaaggacaacaggtttactttagtctctatttgtttatttttttatttttattttttgagacagtctcactctgttgctcaggctggagtgcacggtggcgtgatctctgctcactgtaagcaattctcatgcctcagcctcctgagtagctgggattacaggcgtgcaccaccatgcctggctaattttttgtatttttagtagaggcagggcttcaccatattggccaggctggtcttgaactcctgacctcaagttgatctgcccgcctgggccttccaaagtcctgggattacaggtgtgagctaccctgactggtctctatttgtttaccttctttgatactatattgcttgtatagttctctttgataggcattgcctactgtttatcctatttgccattgatggctaatggtcctttctggctttgctgtttaagttctattgaggagtagtttgaattgactggatgttttaataatgaaatattgataaatataaaagaataaaagtattatatatatatataaagaataaaacatatccaatatataaataaaaaattaaatgcctgtgatgtatcatgtaataaagttatacagtttgggctgtttcaagtaattccatataatgattcctcctagatattttctgattagcattcatcagttgaaagcagaaggaggcagctgatgattgtaaaaaaaaatggcaataataagatacctaatgaccccgaaaatgaagcgaattatgcctaatttaaaaacaaagaatgctttatataggaaactatgtaaatatatattagtactcttttgtcagtaaggcttcacattataaatgtgttcatattataatcctatcggaaaaaagtatggtaagaaagaaaagtaaggaagctagcacagtcagccaggtgtggtgtctcacgtctgtaatcccagcactttgggaggctgaggggggtggattacttgaagtcaggagtttgagaccagcctgaccaacatggtgaaaccctgtctctactaaaaatacaaaattagtcaggcgtggtggtgcatgcctgtaatcccagccacttgggaggctgaagcaggagaattgcttgaacctgggaggtgaaggttgcagtgagccgagatcatgctattgcactcctgcctggtcaacaagatcgaaactctgtctcaaaacaaacaaacaaacaaacaaataaaaaacgaacaaaaaaatgaagtagctagtacagtcagttgctaaaaagaaaaaactactttgagctgctgaagctttttttttttttttaaagttggtggaaagaaagagggaggcttagtgggtcaaaggcactgcttctgaaactcttcatctcatgttttcatctccctttagaagcatgtgcaattatcaattatttatagtatttgtagattcaaatagctaccagtgattatttttggaaacaaactaaagggatttagtatgtgaaattttctgaatgatattttttgccattttcctaattttataaatattatgattcaaaactgcttcaaatatgtgtaatggctatactttttcaatggtttggtagtaaagcttagcatttaacttttctttacaaggaatgtgggacctatctacattcacgaatatttatcaaatataattttattttaaatatttatttttcttgtactagagaatatctgattttgtttgattttaatactattatctctgaaagtcaaaatatttccctataaaataggactttctagccttttgtataaaatttaaatattgccttttcatccttaaacatagtattcacttgaaaatcgttattctaatgtatcttacaaacgtctcatttctggtaatgagaaatacactttctgttctatattcacctaaacctccaaagattttggcagtaacatggttttctctgaaaggaagttcaacatggaggaaagaataggaccttctactctttaggaataatttttttccaacttttattttagaatcagggagtagaaatcatttttacaattaataatacataatagttatatatggggtacatgtgatattttgatacatgcatacaatgtgtaatgatcaaatcagggaaattgggacatctgtcatctcaaatgtttatgacttattgtattggtaacattctaacttctcttccagttattttgtaatatacaataaattgttaactataatctccccactacaaccactagaacgtattccttctatttgactgcatttttgtaaccattatccaacttcttttcattcctttttccctacccttcccagcctctggcaactgccattttactcactacttcaataagatcaacttttttatctcccacatatgagtgagagtatgcaacatttgtctttctgtgcctggtttatttcactgaacataatgtcctccagttccaatcatgttgctgcaaatgtaagaatttcattcttttttatagttgaataatattttattgtatatacatattgctttttttccccacctgttcatgtcttgatggacacttaggttgattccgtatcttggttattgtgaatagtgttgtaataacatggtagtgcatttatctgtttgatattgctgatttcctttcttttggatatatacccagcagtgggattgctggatcatatgatagttctatttttaaatttttgaggaacttccatactgttttccataatggctattttagttttacattcccccaatagtgtatgagtgttctgttttctctgcatcctcaccagcgtttgttactttttgtctttttggtaatagccatattaactaggtgagattatatctcattatagttttatagttttgatttgcatttgccagaggcaaaatgagtaatttttcatataactcttggcaatttctatgtcctcctgtgagaaatgtctattcagatcttttgctgactttttaatagtttttttctgattattaatcacttgtcagatggatagtttgcaaatattttcccattttttaggttgcctgttcaccgtgttgattattttctttgctgtgcagaagctttttagcttaatatcatcctgtttgtctatttttgttttgttgcctgtgcttttgaggtcttactcaagtagtctttgccaaaaccaatgtcctgaagcatttcccagtgttttcttgtattagctgcatagtttcaggtcttacctttaagtttttaatcaactttgacttgatttttgtatatggtgagagataggagtctagttttatttttctgcatatggatatccagtttttccagcagcattgatggaagacactgtcttttcaacagtgtattttcttggtgcctttcctgaatttaggttgactataaatgtgtagatttatttctggtttctctgttctattccattggtctatgtgtttttatgccaatatcatgctgttttggttactataactttgtagtgtatttggagtcaggtagagtgatgcctctagctttgttcttttttcttaggattgccttagctattcagggtcttttgtagttccatacaaattttaggttttttttttctatttatttgaatgtcattggtattttgaaagggattacattaaatctgtatgttgctttgggtgatattgtccttttaacaatattaattcttccaatccatgaacatggcatatctttttaatgtgttgtttggtttgctagtattttgttaaggatttttgcatctatgtttctcagggatattggcctcctataattttttttgttgtatgtgtccatgtctgcttttggtatcaagatagtgctggcctcacagaatgagtttggaagtattctctcctcttaactttttaagaatagtttgagtggagttggtattagttcttctttaagtgtttggtagaattcagcagtgaagccatcaagttctgggcatgtctttgatgggagactttttattattgcttcaatctctttactcattattagtctgttcagattttctatttcttcatggttcaatcttggtagattgtatgtgtccaggaatttagccattttttctaggttttccagtttgttggcatatatatttttcacaagtctccaatgatcctttgtatttctgtggagtcaattgtaatgtcttttcatctttgattttatttatttgagtcttctttcttttttgcttagtctagctaagggtttgttgattttgtttatcttttcaaaaaatcaagtttttgttttgttgatctttttatgttttttaggacttttaagaataataataacctatttcggtcccattttcacaagtctgtgattataggcaagttatacttactatctctactatctgctttcttcatttggaaaatgataatgatgatacctacttcatagagttttaagatttttataaaggaaaagtatataatgcacacagcacaatgcttggcatatagaaaatactcaacaaatgttagttatcttccatttttatcttaattttcctggtgtattttaattctgacataatttgtaaattagttctaagtcacttttaagaaaaatgctgatcccctaagaagtttaaaatagtgaatgtttgtctgtagtaagtcaaaataatcagaaatgttttaatgtccatcaaatatttgattaaattaatttgcattgttctaatttaggtatgtgtagctcaagcacttagaacaaatttctttgaccatttgaccttttttttcatattaggataaaaagtggataagcaatgtttttatttattctaatttctatgctcttttgagatcatatttgaccttcagtattgctctgaatagattttggtacagtagtgttagttctattgctttgtttgtacagttaaatacatcaaactcagcaattttttgtgggggtgatggggattggagagattagtaaatgatttctaagttctgttaattaaaatgtaactatatattttagagagaagttagtagtcatatcactttagttcatgaagacttggcaaatttttaataattaataagttttttctgccaatgagcattagattactgctgactttttagtgtcatagtaccttgtggtagtttctttacagggtttacaggagtatggcagtttattttttctgtcttgtccatacgaaataatctttacaaatgctataaggagaataccttgagaagttcataaatgccttaatatattataaagatcggtcagttccattgtcttcttttgtcagtcttgatcggagcttgccgagtaagtctataagcctgcatgtgcctggcaactgttacctagtgacagtttcagctgcagtagccattggctgtgctgttgattggggcaggagggccgagtcacctttctgatggtgagtttttctgcatcagcccaggatgaggaggaggagtagggcttgggctcaggtggagtcattgatgctgagagattgtgaagaatatactgacagcatccttgtagctgcatcacagtaaatcggacttctgaatcaagcagcccagcctagcagctgataagagtgaatgtaggtgagaagcattaccttattcctgtaacaagagaactgttttgtgataagtgaaactaggaatgtagaagaagaaatatcctatggctattataaaagaagaaggacttgcctgaatgacttggtggtgcaccagaaaataactttcagaagaatgctttctgttaagctgctgcattgttcctggaggaaatgttatttctaatgcatgttatttcttcaaaagataggataacaaagaatgacaggagactctctgaaatgacttcacttttaaaaaatactttggcaaatgttaacctgatatcaaaatgaccttggaagcattttggatggattctatcctggcagccttgcaatgtttcaaactctaggatttaaagttcatcttgatactttagaggtattttaaaataagactatcttgcaacctacctaatggcccctgtgttaattgagcacttgctcaaaatagagtacagaaaaatagaagaggcattttttaacatatggctgctacataactgcaaatgtaataaacaaggtaattttccactttcagaagatatagttgaagtaatgatttaatgtgttaaatcatctactgaaaatagaaaaggtatagcaacatagaacatgaagcctattagaaatacctaagtaataaataatggcagcatttctggtcaaataagctcggagtatattggaaagttttattgtctaactttatatttacatatatatgtgagatatgggtatacagttgcaaaggtgagaaataactgtgagctacatattttattatcatgctccattataaggaaggtggtatatgaaataacaaatgttattttaagttatagatgccaaattaatagcaaaaataattcattttgaaaaggaagaggtataagttacgttgctgttagtaccaccagtaactgtaatggattaaaactgctttcatctaaatgctttaaaaatgcatgcagaattaaaacttcagaagtttattacattttgccaggtgttaattcattaattcattgtatattctcttttctattggaaaatacttttttctcatgagagttatagggcaatctggagtctgtttgttacctctattctgcccatgtagagatgaatcttttcaaattaactttgatagagttgtttttcttagattttagaaaaatgagaaataggttataaatttgaccccccaacatcaatccctgaactaagcccaaagacactctttgccacaatgaactttttcttagcttttcaaccaaatttgagatcttaaattatttaaaatctaaaatatgaatgcatttttcatcatagataaagcaggaagcctgagacagtttcagagtttttcttttctcattctttccagttgctccctaagaaactgcctctcttaggagaacagcccacagaagcttttcttcctttggcaattcattttttttctttttacagatttaatttttcatagtgcaagataataagaagtctattttctctagaagtgccttatgtctgcaaaaagttctttgagggcaccagaggaaactaattagtgacctcttttcacctcctttctagcttatccccttctctccaccccttaccgccccccccccacccccccgcccgaaagctgaggtgtgtcactgctgaactgaggctggtgaagagacttgagcactctctgggactctcagctgtgacagaagcactgacactgtctactgaagcaggttctgaaacactcatgtgcggtgtttaacagatgctgggcagggcatctgcttgctgtagccaagtctgcaggtgtctttaaatttccaagccatgaatgaatccaggtggactgaatggaggatcctgaacatgagcagtggcattgtgaatgtgtccgagcgtcactcctgcccacttggatttggccactacagtgtggtggatgtctgcatcttcgagacagtggttattgtgttgctgacatttctgatcattgctgggaatctaacagttatctttgtctttcattgtgctccactgttacatcattatactaccagctatttcattcagacgatggcatatgctgatcttttcgttggagttagctgcttggttcctactctgtcacttctccactactccacaggtgtccacgagtcattgacttgccaggtttttggatatatcatctcagttctaaaaagtgtttctatggcatgtcttgcttgcatcagtgtggatcgttatcttgcaataaccaagcctctttcctacaatcaactggtcaccccttgtcgcttgagaatttgcattattttgatctggatctactcctgcctaattttcttgccttccttttttggctgggggaaacctggttaccatggtgacatttttgaatggtgtgccacgtcttggctcaccagtgcctattttactggctttattgtttgtttactttatgctcctgctgcctttgttgtctgcttcacttacttccacattttcaaaatttgccgtcagcacaccaaagagataaatgaccgaagagcccgattccctagtcatgaggtagattcttccagagagactggacacagccctgaccgtcgctacgccatggttttgtttaggataaccagtgtattttatatgctgtggctcccctatataatttactttcttctagaaagctcccgggtcttggacaatccaactctgtccttcttaacaacctggcttgcaataagtaatagtttttgtaactgtgtaatatacagcctctccaacagcgttttccggctaggcctccgaagactgtctgagacaatgtgcacatcctgtatgtgtgtgaaggatcaggaagcacaagaacccaaacctaggaaacgggctaattcttgctccatttgaagagagctacatagtaaatcaaatgtaatctgacagtggttttggatcatattctagattcatctggaaatttgccatcagagaaatatttacttgaatagttgactgtaaaatgaagtatgagactaaaggtttctctctttttttttctttttcatggaagaaactaaagggaaggatgtatagagggttagctcatgaaataattatagcatgtgagtattagtgtgcagtaataggaaaaattaagcactgagatgaaaaagaatatctcaaatcttctgcaggacatgagcaagccccttggctcagcatttctgtctttctgtctgactgtaccctgcctctgtctttctcattttgtctatgtttctctcactctttgtggaagttattacttacataaactgccctttgtagaaaagtgctacatattatatatgtggtaaagtataatcttttgcatcaaagtgtacctttaatcacactaatctataatccataagtgatctcttcatggaggatgcacagtaagcattgcattttattatttgccaaacaacccctttgcttgtgtttttataatgttctctgcagcacagtttttctgctataaacaaatagaaacagtatttttgtttcttctgggtaaaatgacatttgcttttccctggtttcctaacagtctcctgttttttttctctctttttcttgatctgcatccattggtaccttactttagaagtgtcttagctattgaaagaatctactgtatagagcatccatgatgttaaataatgtatttcttccagcaaagcaatctggtagcttattaaatatttttaatggcttttggaaacatttttatctggttccttttaaattagttcatgtgcttaaaagtgatgtcttttttttgctatagtaaagctttgtttttctttaagaaaacccactagtaattgtaatgcagatgcaggatactcacccagcagtgaggtattactcttaagggtacttagaatgccctttttaaaaataaataaataaaataaaacatgaatcttttttgtgttaggtctacgatagcttactgttgtgtccactagtcagtcatttgtgtgatatgcgtttgcacatactatgtttttcacagcaaagaaaatgtaaattatgttatctgtgcctaacgttttcttagcaaaatatatagatcaatgttgtttaagttgtcaacattggaaaaagtatatacaaaaacctattttaagagaaaaatacttttgtgtaattgttatttagatatttatattagacaaagctgcatttttagtgccgctgagaatataatatacttaattatcaaatacaggtaagagctgacagtattttcttttgtaatgatctgttttcaaatgcagagattaacttatttttttgcctgctacatggggttgtgtgataaattgtcaggggtttagatgtagcaaagtagcatttggggaattagcgaagcaagtatgagcagtaaaacatctaagtattacttttttaccataagtttcttgcctgaaagatattttaaaatttatatcaaactactgagtatttttcttctcagcatttttgatttctttgttttatgaaatgcatttaataaaatgtgcctatgactcttcaaattagaagccaaccatgtttgcaccctggtggtttggcttcaaaggtcttttagtagaaatgttgtcattttattgaggttgttctgaacccctgtatatttttaaacatgtaagaaagatttaaaataaagaataaaataatattctatatatcaaaatgagactttgcctcagtttaataaaacacttaggacaagagtttacttttttgggaatcaaaatctgattgttttatacttctgtagcttgggtttatatttattcttgtcccctgtttgccagtggcatcttggtttaaatgtgccttttaaattcagaccagttcaaggaaaacaaagttcaaggaagtgtactgctaacatttcagatatcacatataagacttctaaattatacatattatttgggaatcgtatttttatttctttaaggtataaatatagttagaaaggacccagtggattctgtgtacagaaagcctgaggccatgcttactgcattttccccttctggcttttccccatagtaattaataacaattatatgccaggctcactgttcacttttacatgtgttataccttaaatcctcactacagccttttgagataatagttattatttccactccagagataaggaaacgaaagaaaaatgattattcgtcagttaactagtcaatggcagaggttcccgcccatccagtaggcctgggccaaagcctgcctgcttcaccggtaggctgcgctgctttcatttcaaaagcctttaaatttttgtacctctgtctgtaccttttccctacaatatttctctgagttttatttatttttttctcatcgtaagtcttttgcttgagttcttttcttgtcttgtgatatctttttctttgatcttaaaagtttcttttattaaaacagcaatctgataagctcaaacttaccagtttagtctataatcaaactgaaattgttgatattactttggtttacttttgttatttcccttgaatacctttttgaaatctctatcaatttctttttggaaaaaaattgttttgaagaggaagagtgaaaagaaaggctttatcataggctgaaagaggctgaatgaggcaaattctgagtttatttatttactatagtattttatatacaactctaggacaaaccacttaacttccttttatcatattttaatgtgtttgtataataagctaatccttattttgaaacctctctttttaggtaatgtgttttaagaataggaagcataaccatttttctcatcattatattgtattttgtggtaattatccagtttggctataaaagacagccaaaaaacaatgcattctgtattctttttcctaagggttctattatttgcatagttgtttctagagttatagagtgttggaaagcttcataattgacactattagtatatgaaacttgggctgagatccaggccctcataaactgcttggccttgggtaagataccaaatgctccaaaaccttagttttggcattgattaaaaaatcttaagtcagagacttgtagctctctgtttagctgaatttgaggactaaatgaaattttgtagtctgtgtgcccagcatagctcctggcacataaaaagtgttcagaatatggtagctgctgtttttgttttgttttttgtttgtttgtttgttttgaagtggagtcttgctctgttgcccaggctggagtgcagtggcactatctcggctcactgcaagctccacatcctgggttcatgtcattctcctgcctcagcctcccaagtagctgggactacaggcagctgccaccacgcccagctaattttttgtatttttagtagagccggggtttcgcggcgttagtcaggatggtcttgatctcctgacctcgtgatctgcctgccttggcctcctgaagtgctgggattacaggtgtgagccactgcacccagccggtagctgctgttttgttatctttgtgggtgccatatttattaacatcacaacttaaaggtcactaatcccaattcaaacaggaataaaccattgagcattagggttttctaagatagcatttctttttgcaaatctatttaaattcaaattttggggttaaactcagatatttcaagtatatttctgaaagctcgtttcccaggaatagttattcatgaagacatcgtttgagattaaagatatccagcaagcggatgttgtgatgagacaggcatgattctgaggttaacctacctcttactttattacactaaatatgcttaaacattttattctcgttagggaagtaataataggaaggattgtccagggatgtcttgtcatttgtctttgcactttaattttcctcatttattaaaatgggatttgaagtattttgtcatatatctatttcttgggagaaacaatgattaataagctgatttgctccatagataacataaattatgtgaatttaaagataaatgaagttgccttaaaggacctttcctctttttctccccacgctagaaggtaatcattagatgtgaaaaagatacaattacataataagtagataaaaaagatttagatgtgagaaatctgctggtataacattctgagcatagatagcatcatgtatgtgtaggtagggccattttggtgcataggagcatgtatgtgttactcagtcagtgctgtactctgacgtgtaggttccaaaagatgctcttttccttgagcagaaattaactttattttagattgagtgatatgtagaaagtggtaatcctgtaaccaaatacatagatattgaggaaaacaaaattgctagagtagagaaaacagttcctattttatgatttctcataaatggaagtttgattcagtgctagtcttgctctgtattttaaaatattcataacttttttcaatagtaaaagtgtttttttaaaatattaacatgatgtcattaaggtttttcttcatgactattttgttttaattttttacaatgagcattggtaaaaatttcttttataatcagaaaaattaatatttggttaaaaagaatgctgaaggctgggcgcggtggctcacacccgtaatcccagcactttgggaggccgaggcgggcagatcacgaagtcaggagatcaaagccatcccggccaaaatggtgaaatcccatctctactaaaaatacaaaaattagctgggtatggtgacatgcacctgtagtcccagccactcgggaggctgaggcaggagaattgcttgaacccgggaggcggaggttgcagtgagccgagatcgcaccactgcactccagcctggcaacagagtgaggctccatttcaaaaaaaaagaagaagaatgcggaatatttaaaaaatattttaacatttcacaaaacagcttatgttgatagtacaaataacactatccaataatgtctcaatattgtcttataaagataggttatatagtttttctgagttctgtaatttttatttcaggtagatttttacaataaacttgacaaccttctacttgcaatagtagatgttcttgacttatttttgctttaatgtaaacagtttgaggtattacttgatgaatctgaaatggatctcaatcactgtaggattttttttttttttttttagacagagtctcgctctgttgcccaggctggagggcagtggcgctatctctgctcactgcaagctcgcctcccgggttcacgccattctcctgtctcagcctcccgagtagctgagactacaggcgcccaccagcactcccagctaattttttgtgtttttagtagagactgggttccaccttgttagtcaggatggtctcgatctcctgacctcctcgtgttctacccgcctcagccctccaaagtgctgggatgacaggcatgagcgaccgccccggcccactgtaggatttttaaatgcatcattcatggcacctttctgcatttttcacacctttaaacaacaaaaagatggctctgcgttaggaaataggctccagctggtacattacctgcatttcctacataggcagaattctccaaagaacatatttataattttttaatggtaacttttattctgcttttatatatgactttctccaaaggtgaagaaaataacagtaataaatttagcaggagtctgttatgtctgataaatatttaacatgaaaggcacatatcaccaccttcattatagtaaatggagccaaattagtttttgagattctaaaattctaaggtttaaggtgataaatatcaagaaacgtagtacataatagtagaattcatgaatgaaaataatttgcaaaaatttgaaaacttccaaaaaggatattttatacaaaagaaatacctatcattgacttaaacatttgaccccagttttattttattttctacttaagcaattgtaaataaggttgatgccagttaaaaatggcaaaatatatattataaattcaattattttaattgcaaggcacaaacaaggtacagagttgtatgacctgttctttaaatttttaaatttatttttgaataaaatgtggactgtagcaagagatgtgcagtaattttgtctgagattatacatgacacaaagaatgtttatgtacatactctgtaaagtatagctttaagatgtttacttatgttcttaatagagttctaagtttaatataattattagtagatggcgtatttttatagaaataacatcttcacaattattcatttactttttcaggaattttataattaaaaatgctaaattggtaagaaattattggaaaacactgcaagttgaaatttggaaacacttataacgcttttgaacatatataatgctcttgacattataaacgaggtctattctaaaagcttctgtgagtaaacactatctcatttcacatataggaatctgagataagatttttaagtgaccctaacaagatcatgtcgtttgacaaagatactactgacgacgtgtcttgtgtgacaataatattgcctgtgataaagttcttgaataatgtatttatagatggctggtaatagagtgacctgatatttctttcttgagaagaaaatgaagacttagttatttgatatagaagaaattctatgtgaatttttttcttttaatttgtgacataggaaaaattattttaaaattaactttatgttggaggtgtgatttttgagatcatagaaatttttaatcagatgtattatcaggcttgatcagtgttttaatatttcttttaacagttttttatccatagagggtaataaaaaatttacctctccttttgaaaacacagcagtcatctactgaatatattgagatatgtagaataaattgaaacagtgtttgctgtgtattctaaacactataaccttaatgatgaagacatcaaaatcacgttatattcaagtacctacttttggaaagtactaattttatagtcatatactttatgttttgaatttttttttgtaatagatttgcaatgttgttgagtcatcatcggttggatttttctcagtcattatgatggacaagattttgatgtttcaggctatagtgcttttgtatgtttgtaatctataaattatcagtcagggaatcagtgattagtttgaattagtgataaataaaaccttttaaataagtaattcagttttatttcaatgaaataaatatagttacagaaaaattaaaggaactcaaattaggcaaacacaaaattgccttgtaagtgtccttagaggaaatctttctttaagtcgtttctagtgtctgtatcagttgaataaaaatgagttccactgagttatttgaaaagtttattctcttaaatatgtaaaatttccataacaatttatgctacttatttaaacagtttgtaggatgaatcattgcaaagtccaaatttggatttaatctgaattaaccagatatttttgcatttcaaatctataaattaggtcaataaatatttattgactatgctatgttaagggcataaattgtggttctataatagtcctggactcttaagagtaactcattgaattgtgtgaatccaataagcaggaaaattaatttctagaatttgagggagagattgcagaaaagtcataggaactatgcaatacattgtagcgttagagggattaacgcattttagaatatgaattggcttcaatatttagccatgtgtttggatgctatagttctaaaggataccacaggatatttgagaagtttttgaagtgaaaggagagaaaatgttcaatgttcagattagtacaaaagtgttgtggggagaatacacaataactttggaatgcagtgtaagtaaaagaaaatattctttatgtggattatatctgattagagtaaaatcatcattttaggtataaattataagctttgagattaggacaataatattaacatgggtagaagtagcttgagggattgcacataggacatgttctaccaactcaggcatcatcttttttttttttttttttttttgagatggagtcttgctttgtcacccaggctggagagtgatcaccagtgtcacccaggcagtggagtgatcttggctcactgcaatgtcctcctcccaggttcaagtgattctcctgcctcagcctcccaagtagctgggactacaggtgtgtgccaccacgcctagctaatttttgtatttgtagtagagacagggtttgaccatgttggccaggctggtctcaaactcctgaactcaagtgatccacctgccctggtcttccagtgatgggactacaggtgtgagccaccatgcctggctttaggcatcttcttagaccactttttctagagttgttttcctaatatttgtcttgtgattacaagtgaatgtcactatatgcaggttattatgacaggcaggttttaacttctctgtcaatcaagttaatcatatgatgtaggcctaatattttgaataatagaatcactcattctttcatttaagtatttatcaggttgctattgtgtgccagggactattcttaattctgtgtaagataaggagatttctaagtaaaacagattttcagttctccaagagcacttagactacaaggggctatatggactttatatggataactatagggcaagataggagctgacaaattacagtccgctgactattgtagatacaattttactggaccatagcagcactcattcatttatatattacccatgggtgcttttgtgctacaatggtagagagtagttgtcatggaaatgttatgttctacaaagcctaaatatttactttacagaaaaaaatttttcagaaaaaaatttacagaaaaaaaatttttttctgtacagaaaaaaatttgctgatgcctggtatgagacattataatgccctttgtatgctactcacagtagaatgttgtgcttttatgtttgctaaaggatctcatacgaaggagtgatttcaacctgattcagtcaggcatcaggaaaatttctagcatatgaataaaaacctagatattgattcccctgtatgattccagtggtttttcagctatatacctgtctgtaaatgaaacacagatctactttttctaattagttcttactattatatagctaatctacattacttatatttagatttttcctactcaggtaaagttctttgcatatcaaacttagtgtctagtttctttatttaactactaatataacataatcgtattttacctttaagcatggagtcagtaataattaacattggatgtagtcttcaaacttcagaagcatttattaaacttctcatcaataaatgataatctcatagtctaaaagagttaatttacttataagtaagcatgcctcttttgtagtactccaataggccgtaaaacaaaaaactaaaaaacagaagatatagctgtataagagttaaatttacatgcaactctaaaacatatatgacttaagagaatttataattcaacaccaatgtatgacattattaataggctcttggtaatatataagttagaaaataaatggttatagtcgtacacttagctaagatgtattgcagtgctaggagttttatgttttttgtcattgtcaactaatgaatgaaaatacaaagcaattttaaagagccacaatttatatttacacaaaattaagccattttaaaaatcttgatgattcagttaatcagaggtatttgatacattatttaataatatttgctttggcagtactattgttttaaactattaataatccattgggaagttttggttttcttcaagtttagtaaatcagtaagaaaatgaataaatgatcttgatgtttttcttgaaaatacagttcacggagtctgttagaataaaaggaaacacttacacagttgtccctcattatctgtgtgggattggttccgggatgccccaaggataccaaaatccacagatgcttaagtcccttttatataatcacatacaataacctacacacacccttccatatactttaaattatctctgagttacttacaatatctaatacaatgtaaatgcaatataattagttgtattgtttagggaatagtgacaagaaatgtacaaatacatttcaagtacatgtacaagtctgtatgtgttgaacacagatgcgaccatccatttttttcccctgaatattttcaagcagtggttggttgaatcgatggatgtgaaccctatgaatatggaggactgactgtatatgcttttatgctttcagtactgtttaaagtcactgagatagtagagccatcattagaacccatatagtcagagtgaataccttaataatgtttattgtatgttttcccaaacaaatgaatagaaaaattttatgtaaaattgtgtattaaaagattgtaaatggtcaggtttccattagtttgattttgagagaaagatttcagagaatcattaggtccttctgcctttttcagaccagtcaacggactgaagggtcttaagaaaagacctcagggatttcttatagagataatttgagtgacaaggtatattgtttccacgtttttatatacccaccagcttgcccttccataattggcaccttttaatttctgacaatgttgtaaaaggatgagttatagcaaatcattattaacttatctcaaatgtttctaattctcatccctttcacataattaacttcctttttttcctcctcattcatttagttatttttatttttaattgtcaaagaaatagttgctcataaaggaaatttaggaaatgtttaaaatgataaaaaagagactaaattacgcatagttctctacccaaatataattaggtgtgatgataatgactgttgattttggttttcttttcttccatttcccccctatggattagggctttttctaaaggatttttaaatatgggtatttataacttaaacatttttccatattattgcatattgtttatgaacatttttataaataaggcttttccacatttagtattattttcttacaatttttaaggaagaaatactgaagcaaacagtgtgaaggtattttaagattatttatgtatattgccaaattggtttcccaaaggagtgatccagtttatcttcacactaataatgtatcaaactatgatgattcattgcaaacttgctagcatcaattctacattaataaataaattaaaggaatttgattttttacttatttcttcctagcccctatagggaatttgtttagttctttgcaattttttttcttccctacactaaaacagatagatagataggtaggtaggtgggtaggtaggcagatggatggatggatggatggatgaattaggatggatctgctgagcctcatttaaaccaaattgtctcaaattctttatttcagaagtctttaagctcagataatcttctcactattgttatctcacaatttactctgtgctactgctgctttgttgtttaagaacactgaattctgtcagtgctgttctcccattattactgctatcttcagcattgtctgtttcattgtatcttgtgtgtgccacacagccacctagatattgcgtttgagaaaggtttcgaaatttttttctattgtattcttctgcctttgttgcagtgataatctctactggcctttcaaggtaggggaggatatgttcctaagcagaaaattttgaggcctgtgtccttgaagagtttgtgaacatcaagatttcagtagttaagcactgaccccaggcctggtattgatacttaggatttccctaacctgcagaaccatgggaatagtatccatagtggtagagctgtggtaagcaaatcagcttttacgttagaaaagtcacacctggtgtgattgtctaacaagcaagcatgcttgcaggtctgtactgtttctcttctttatgtcttttacatctctctggttcctcagagtgctttgtatatagtggctactcaattatttgttgagccaagtacagagtgctctctgtatagtaagtcatctatttcttgagccgaattgaatttaattgtcagagttaacagtagttcttgggtctcttccagtagttctttcacctccagctcacttgagggtatggttggactgaagattacttcaagattattttccccagtgccttgctgttaccaactggggaagctgtggaaaagaatattttaggagagttgaacgatgatttaatatacctatcatttaatatagcttcccactttaattgaatttttccttccaaaattgacattcagtggacttataggctctttttgaatatgcgtcttaaaggggggtgaatacactttggggtagctcaggttttttccataatgtttatttatattcagctgaaatgaatatatttttggcttattcccattgtgattatataggaagaatgagaatttttgttttacccaagaaccttctgtataccttagtaaaagcattgtttctgtccaggcttctcttggtcttgaaccattcttgtaaaatatggttttgaagctcatcaccaacttttccctgactatgctctaataatacttcttttaatggtgctcagggctgaataaaatgttacgtgtgtgatatgactagtaacagatgagagcgagactatcattttcccttggtttataaactattctgctatttattcaggccagaaataaattacatattttggtagttatagtttatcctttaatatatcaagtttgttttcaataaatctatacatctgttttacacctgcttaatttatattccttctccatatatgtacaatggtttttttaaacaaattttacattgttatctcccttcaacttcatcttgttagagttggctcagtttttccagcatttctgaaacctttgttccatttctaatacagtcattaaacttttgacttctgcaaatgtgatatacattttttttcaacttttattgtaggttcaggggctatatgtgcaagtttattacttggggaaatttcaagacactgagctttggggtaggaatgatctcatcaccgaggtagtgagcatagtacccaataggtagtttttcaaccctcatccccttccctccttcctctagtggtccccagtgtctgttgttccaatctttatattcacatgtaccaatgtttagctctctcttataagtgaaaacatgtgatgtttggttttctgctcctgagttaatttgcttaggataatggcctctacctacatctgagaacaggaacagatgcttctcaaaaattctcaaaagaagacatttgtgcagccaaaaaacacatgaaaaaatactcaccatcactggccatcagagaaatgcaaatcaaaaccacaatgagataccatctcacaccagttagaatggcaatcattaaaaagtcaggaaacaataggtgctggagaggatatggagaaacaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttattgcggcactattcacaatagcaaagacttggaactaacccaaatgtccaacaatgatagactggattaagaaaatgtggcacatatacaccatggaatactatgcagccataaaaaatgatgagttcatgtcctttatagggacatggatgaaattggaaatcatcattctcagtaaactatcgcaaaaacaaaaaaccaaacaccgcatgttctcactcataggtgggaatcgaacaatgagatcacatggacacaggaaggggaacatcacactctggggactgttgtggggtgggggagggggaagggatagcattaggagatatacctaatgctaaatgacgagttaatgggtgcagcacaccaacatggcacatgtatacatatgtaactaacctgtacattgtgcacatgtaccctaaaacttaaagtataataataataaaataaaaaagaagacatatgtgtggccaacaaagatatgaaaaaaataactcaacatcacttagcattagagaagtgcaaatcaaaaccacaatgagataccatctcacaccagtcagagtggctattactaaaaagtaaaaaaaataataataataacagatgttggtgaggttgcagagaaaagggaacacttatatactgtaagtgcttattttataacatctaatttgatataatccagatatttggatttttcagatgagaataatttattttctaagcttatactacatattggattacaaattttttaaaggctttctgtttacccatttaggaaccaaagtataatttaatatatgattatttgatagcatttactatgagaaatgttaccatttgtgttccataactacacttaaaatatggaaatattttaatacagatacctttagcatttgggacatatcttgcagagagattttcaagaatgccttttagtggagatttgtgaaatgaaagatagtaaacctttggggtttattgcagttctgcccaaggacaaatgaatgaatggatgacttttcaaagtaatccttacaaagttataatttgtgatgctttccccatccttaattaattgttctctttaactactttcacagaaagcccatctactctcaggaattaaactatcatccttttgccaagtattccaaaatagaactcttcaaatctggccttgtaccttttctccaggagcatatactatgctgccttcaatgagccttcttattctggggttttcataaaaattgaaacctgaacaatttcaaaggaaaatcattattaccatttcttattccttacactgctcatctctttttttgttgttgttttgttaatgtcattagtaccactgccttcttatatttccactttatagccctgtctgtttaataaatgttaattgaaaaaaagactacctggattttttttcttctaccttaatcactctttcatttagaatccagtttatacacttcattcttcactgtcttttaagattctttctctgggtaaccagatcacttttttttttgcttcttccatagaaagattaccttctttttttgaatctttatgtatagttttattatattctctatgtgctttgaatgataggaactttaggttaactgataacttatggatacagcctcctaccatggctaaaattcctttcataactagcaaggtagtctcttcaattattataaagttctgtgacttagaaaatacttcctaattaatgagccccaaaatcttcctattgatcctattgacataggatcaaatgtccaccatttgatcccatgtcatatctctgtggaaacacagaaataagtctccctttatgatgtagcttttctggcacatgaaaactactgttatatctgccttctcttctcagattaaacatctttatttctttaacacattgctaattcattcattcagcgaatatttattgagcattttttttgaggcggagtctcgctctgtcacccaggctggagtgcaatggtgtgatctcagctcactgtgacctccgcctcccgggtttgagcaattctcctgcctcagcctccagagtagctgggactactggtgtgtgccaccatgcccggctaatttttgtacttttagtaggctctgggtttcaccacattggccaggctggtttcgaactgctgacctcaggcgatccacccacttcggcctcccaaagtgctgggattacaggcatgagccaccatgcccggcctattgagcgtcttttgtgtgcaagtcattgtttaggtatttggaatctggtgaacaggaatgataaactcttttctcatagagcttacatccaaatagagataaaaagtattctatattaagatgccagcaagtaaaaaaaaataagataatttcagattatgattaatgccatgaaaagaatagaacaggacatcaggatggagaagtgatagagatgggaggcagcttctccatgaactttggtttacaaatatctcatcattttggttgccttccaccacaacaacatgcatggacttggcacttttaacatatgatcttatggtgaaagacttctgatctgctaatgtcctctgtgtacatagggaagtatggagcttcttagttatgtgggagatgaagctgtctgaactacatcagtgagggaactattaaagaaggagacacaaaaatttagaccttttgcagttatcgttagccgcagtattctcttgctcagtgtgctcttcttacagtgggatgagtagttgccatatttggacaatgtgcttcccttagtgcagctccacatgtaatcagctgttccaacaacaggtcaccttagctttgtagtgaacttatttaggtctagatctcacctgtttggaacttggaaaatcagtttattgaacatagttgcagggctttgcagttattccttacttactcagcacttccttctactttaatgtgatctttttctaatgtttttaatagatttagaaagcttatgttccttgttgtctttaaagttagcaaaaatgatgtatacagaagagtacctaggcaaaacttagtaaaaagctttcttctaaattgatttttctttatttaattagcacattttgagtaaggccataggtctacctcaaactgtacctgaacctgttaatatctagttcccattttttccccttttgtttcaaatattttataaaatgtttgctaaagacagtgaagcataggctgggcatggtggctcacgcctgtaatcccagcactttgggaggctgaggcgggtggatcacttgaggtcaggagtttgagaccagcctgggcaacatggtgaaaccctgtctctactaaaaatacaaaaactagccaggcgtggtggcacacccttgtaatcccagctactcaggaggctgaggtaggagaattgctttaatctggaaggcggaggctacaatgagccaagatcacgccactgcactctagtctgggcgagagagcgagactttatccccgcccccgaaaaaagagagagtgaagcataatggtttagcctgccctctagagtcaaactgaaattttttattcatcacttgttacctgtgtaatactgggcatgttacctaacccctctgaccgttggtttcctaataattgtattggctttatagggatatgtgaaataatgatatataaatcatccctcacaatgtctggcatatagaaaagtccaataaatgttagcagtagcagctgtagtcattgttgttcctggcccacagaaattaaatatagtctattttgggctttccagatctaaaaaccctttaaatgcatgtgcacacacacaaatatatacacagctagttttctgccatttattcttagggatggacacagtaaaaacatctttattttttacatcttatatgccatctgtctagaattttactagatgaagcatcaatgttaccatctctgaaatccatatgttcttattgaaagcttaaaatttgtcttctctgtagtcatttatcatcttttcaggggtctacagtttctcaaagattaataatactaccagatcttctagtagctactttgatatttctttgtttgagcctagttaaaaaaaaaaaagacatgggtatgagaggctgaaaataaagttgagaattgcctgggtatttcacttagccatgattctcaggtctttgttagacaaagagtaaaattatctataccagggaagagaaataacgtttctactaaataaatgtaaaagtaaccactaataaatactaaataacagagctactgtatgacaagtactgtaaatatatattcatgttatataatatgtttaatccttttagcaactccttttcataggtgagaaaattgagcatcagtatttaagtatcttggttatcacacttctactaagtggcggaatctatagaatttgaatccagctttgtctgacaccaaaaccatatcctttctacctaatatatgctacctcccctactatttggcagttaacgttatactgacatgtatattaaactgaaactatataaagagaagctaataaaggcttttttgctatagaagatatttctagagtcagagaattgatgaggatccatgagtaaacttggcaaatttccctcaataggaaaacgttagcattttagaaatattataaaatcgtgaaatcttagggttgaaagaaaccttcttgattataagttttgttttctggtcacatagcaattatatatgggattatattataaagaattaattttattattgctgtatctgtaatattttgagacttaagataaattattgcttttgtttacttatttatttaccttatttacttctttataccactgtattttaacagtttcttttatattgtatagtctaatggttacacaaacatttgtgtgtaaccattaggataaacaaatagagatttcagaattcttccacatgtaagtgatgccctagtactctaatttataatagagggattgttatggcttatactgaaatactagaagagagttttgcttgcaagacgtgtatacacataggctgatttcatattaagtaattctgctttattataataattcatcctgatcattgttcaataatggattcacattctaccttggttttgtgattgtgctggtgttgtagtataaattatagttattatgcacttcaaatttaaatgttattgataagtaaaattaaacactttccatatgacagcgtgggcagatatttttgtgtagtatgaaacagtgaatttcaaatagtagttaatttcttaaactaatattgagcattatatccctaaagataaaaaagtttaaacccagagaagaaatcatagacactacatctatatctacctctttctctctctctctctctgtaaaatcattccagtttcttctgcttagaacagtaagttccatggggcagggactttgtcactttccccactgtgtttctaccacctagtgcaggatgccatacgtggtagatgttcagtaaatatttgggggcagactgtgttggctttgcagataagtgttatactaaaaatgaggggaatatttttgcttttgagtagattacactgctaatcatttcagagttttgcttgaatatttctgggggtttatgtttttcctgctctgaatttctagatgccattagcaaaatgttttatacaaaagttaagaacagaacgtttatatttgtgttaagtatatgcttatgtgtatttatgttcatgtctttttatctattaatagaaaagtgcagctgttactgtattttgtcttatcaattgctaagggttaggtaagtgttgctttgatttgtagtcccaggtaataagtttaaatctttgtgcttatatataattgtatatgaatatattgctgacaagggaaattattttggttatcaaatatcagaaagtttcatattattgtctgtatctttctgataacaaggccactactttctagtaaatcaggtattttctctgatgttaattaatcctttaagccactaatccaacatttctcagaagtataaacgtggacagtttacatcagattcactggtaatgcttattaaaattacagattttcagcaactaccttagtcctcctaaatcagaatatctacaatgtgagtctctgaatttgtgacaagctctgcagatgatttctctgcaatcagaagtttgagaatcatagtatgaaactttcctggaagtgtctttgcccttaggaggggttccatcctggaagctctacagaaaaaaatccctcactataagctctctgcccatttaagttccagagtagtcagtcttaagacactgattgtgtcagtttgaattacaaccaaaggtgcattatttccaaaagctgttggactggaacaaaacaagaacatcaaaattgctcactagaccaatattgaaagcagacaaaatggcactcagttccagttcctgacaacatcccaggaaatgtctcagctgccttcactggggattgtcactgccaaaaatgctttaccctttaaagcctcgtggggaactaggcactgtagagctgagctgactggaggaaaaaaaaaaagttctacttttttcaggtctacaagagcagagctttctctggtactatgagaatttcagcctaaaaattccttgtatatgagatcttgaccatatgatcaaatcctctctacagccatgacccatcttgaattattttaccacttgcacagggctactactgcattttgcagggttccaaatgcatctccccatctcgcagaatagatatcattccatgtattgatccatctttttctcacttctctatcattagctataaactgattttgaatttcagggtttaaatcaggaactcttactttctagcccctcaaaagccagtttagaaaaaatgtaattttacatatgtacattctatgtaaatttgtttgtatcagagaagtggtaatgctaccttttgtatacaaaggtgatgatactgaattaaatttccagaagtaatgatgagtttttattcatgcatccatgttgtaatctctggccttccttgaattcaggggcattctaaaatgcagtgttttggcctggcatagtggctcaggcctgtaatcctagcactttggaaagctgagacaggtggatcacctgaggtcaggagttcgagaccagcctggccaacatggtgaaaccccgtctctactaaaagtacaaaaattagctggatgtagtggtggatgcctgtagtcccagctacttgggaggctgaggcaggagaatagcttgaacctgggagatggaggttacagtgagccaagatggcggcattgcactccagcctgggtggacagagcaagactttgtctgactggaaaaaaaaaatcaaaataaaaactaaaatacagtgtttagttagagaacagaccataccaattaatttttacataaattaaatccatgacttgcctggcattttgccctagccaaattaactagcctcagaagttggattttgcctctgtgtttgtttcattttctcagtcaagaattaagagtactgacattacatattaagcttttttgtatcccctggggtaactaactagcatggtggcttatacatagcaggtatttaggaaaaaaaaacacactttgatttactgatattgattatgtttcaatacaagggcagttcagctactttgcatggacttctttgggaaggatttactatgatttctatttctatattcgtgtatgtttttgtgtttgagttcagtcatacttattacttacccatcttcttattgaacctcccttttgatcgaatgtgattattgcattggtggtatattagttgttttgaagaattaatatttctttctaattcaagcctatgatgtgactcaggctggtgatacaatgatggtattaagacaatgttcatccccttcaacagggaaagtaaaactgttcaacttgcttttgaatacccagtatacctgttagtaatttatttaggaaggtaatagtctcttcatatattagaaattttgccacattaagcaaaatcttagaaaagtcagtatttatcagaatttaatattaggaaatctttttcaaaggaattgaacatatccaaatcggagctaaatactgtcacaaatagctctaattttttcaccttcaagcaaaccacattcaggtgttagctattggctctgaagtagttgttctatatactataggtgttggaggcccctccttggtggattttgaaacagtagaaactcataatgattgcattctcttaggaatcttacttaatctggctgcagcgtgcagaatttatttcaggagtcagaccagataggagactgttatggactgaatgcatgtgtgtccccctctcctggcgttcatatattgaacccataatccccaatatgactatatttgaaaacagggtctgtgaggaggtgataaaggttagatggggtcataagtgtggggccctaattggatagggctgattccattatacgaagaggaagagacatcagagctctctctacaatgtgaagacacaatggagaagtgtgtaatgcatgctgtgtataagccaccatgctagagaaagtggccgtctgcaagccaggaagagtcctcaccaggaatggaatcagccagcaccttgatcttggactttccagcttctaaaactgtgagaagtaaatttctgttgtttaagacacccagctgtatgtttttcttgcagccagggcagactgagactgagacagagacagagaacactgtcataatctaagcttgaggtggtaaggagtgtggcatcaggaaagacagcaatgagacaggtatggtgggaaaggaaagaaagtggtataagagaagggtccatgggacctagtggctgacagcatgtggggacaaaggatgatgtatattatctgtatttcccaaagtggggaaaattttttaagtccaattttgttgagggttctgccttccaggcccccaggtttggtgatttgctaggactaacaggactcagcatatagtcctcattgctatatttattacggtgaaaagatacaaagcaaaatcagtaaagggaaaaggcacatggggcaaagtctggaggaaaccaggcacatacttccgaatcttctcccagttaagttgcacaggatgagcttaattactcaagtatcaagttgtgaaagtatggtaaagtgttatgtgccagagaagcttgcctgagcctaggagttcagggtttttatcaagagcccatcacataggcaccctttgcctagaatatacccaaatttcagactctcagaaggagtttaacatgcatcacattgttcatataacagtttaggtacaataaaccacatttatcagggaataatggcaactgctgaaattcaagtttccagttgccagcaaagggccagcctttcaagcatttcattctaagaatagcagtctcagacctgcagtattaactgttttttgcacagtaatattttaaactagaaagggaacattaaatatatgtcactctgtttttcttactgaagtttgtgcataatagaaacaaattttaaccctaattattgtcttcagttggccacacaaaaggatatttttgagaagtgttaggaagagaaaaacaactctgaatacagtgaaatgttgccatgcgtttaaagtcagccatggaacataattttaggttatattctcctgtagagtaagagttatatacacagtatctttagtaataaatacctagagagctcaaagaggtaagatgcctttgctgaaggcaccatctcttgatgacataggatctctgtaaaccttgctggtgtgcagaattcctcatgtgtcaggtgcacaatcccaaagctttcctactttgtacttcaggttcaaagagatttttaaagcatcttattttcttgattttggtatagcatctactgcccagagcactagatgagtctcagttggaagtgggaagcagaaatagcataggttcaggagcttccagaaaacaggatgccctgacagtgttttcctttcctgtaccacgtgtggccctttctttccttaggatgttaccttagaggtttctcttgctagttaatagaaagatagttttgggggcagaccacaaattcctaggtatggtttgaggtaagcataatttgacacatataattacattatgttaaactttaaaagttctcaaactttattttaatgccaaccacatcttgtttagaatccacatatgtaaaacatgtaaaagctgagctgctgagcaggttgagctgaagcaggctgaggagtcctgcaatcattcgcccctaaagctcctgcagagaatcttaaaagttcttggagattgcttctcccctctaactccgttgtagtagagatgagaaaatgaatgatcaggaaattaatctatatcagttagttctttcaagtccttacaaacccttttctagaacttctttgactaaccccattttctcctgtagctgttcctgtaacgttttatataaacatagtgcttatcattttgttttatacataaatgtttgtgttgtctccctcagagtccctaacctcagtctattttttaaaattaattttagatcctcagtgcttaatgtaatcctagtatatagtaggtagttaataaatactgcattaaaatgaataaatttattcaatactttccatggaaattatttattcaatttgtagtatcattttgcattcttgatgtcttaatttcgaatggttctctgttaatttctgagattgtttatttcttcaactacattgtcagctttttaaaaatctttattgcctactccccaacataaaacccagaataataggagtattttggttaaccaaagagaattccatagaaaatgtcatgataactgtagctttacttccttcttactacctctcaaaatgttcctgatgtcagctagtaagagtgctctgctctttcttttatgaggccagtatgtaaagaagcagtgtataactgaaataatgtgaatttgtctccaggatctaccacttattacctgttgaccatggtcataatatcgaacctctctgatgatgatgatgattattattattattattattattgtgagatggagtcttgctctgtcgccaggctggagtgcagtggcacgattttagctcactgcaacctcctcctcctgggttccagtgattctcctgcctcagcctcccgagtagctgggactacaggcgtgcgtcaccacgcccagctaatttttgtatttttagtagagacagggttttaccatgttggccaggatggtctcgatctcttgaccctgtgatccacccgcctctgcctcctaaagtggtgggattacaggcgtgagccactgcgcctggccttctgattcttatttctgtcatctataaagcagggaaagtaatatctgccttatgataaataaagaaatgacatattatgtgttttaatgtatgattgtattaaatgtaatgtatgttacaataaatatttaaatattaataaatatcatttattaataaatatttaaatgatagctgatgtcatatacaagcaggtgtgatgaacctactagtggtgtttaaattttaacatgagtaaagatcaccttgggagcctgttcaattgcactttcgggtttagtaggtctgagttaggacctgcagttcttcatttctgataaactcctaggtgctgctgatgctgtagtctacagagcacacttggtgtagcaggcactggagtattcaagattcccttgttatgcttttttttcttttaacatacgttgaatgattggttggactgtctttggcagttattttatatcttctcagatattgtgactgtttttaaggtagttaacaataatattgtggactcatccagtgctttgttttgaaaacttttttgttacaatgccagggacacaatatttttaaaaatattttgtagtgctgtatatccaaatattaggggcaaacaattaaggtagacatgatgatcttatctacttttgtaggtaaataggtttattgaatttgaaaggatgccaagcaaggatttatggcatattaaggcagatcaagccaggaatggtggttcacacatacaatcccagctctgggaggctgaggtgggaagatcacttgagcccagaagttcaaggctgcagtgagttatgattgtgctactgcattccagcctgagtgacagactgagaccccgtgtcttaaaaaaaaaaaaaaaaaaaaaaaaaaggtcagatctttggccatttgcttctgctgtataattatctacaggccagtaattgaaagtataaacctaaattcgcaatgttagatgaacattataacttattagaacattatatatgtataattaacattataccagtatataacattataacttattatttagaaagattgtaaatctttctaagttgaagttgaaagaacaatagggtgggagtcaggagatgtgaattctgggtttggctccaacaaaggttagcggagtgaccttggaaaggtgagagttaattcttactttttccatgcattcatgatactttataaaaataacttttcaacaaagttctcagtcctctatgtaagagaagatcttacctatgacaattttctaacctttagcattctgagtttaaatgtaaaactatcaaatgctctgaaaaattaatgttgcctatgctatttttattttaattgtattaattttgttaataagattttaatagtaagttttggagcaatttactggccagctgaatatctaagatatttcattcaaatttgaatatgtttttacaaaaatataagtaaagcaattgtaaaaacttttacactataatttcagtttttttcctaatttatgcaaaattatctattaaagtaaaagacaaaacacaagagatttatgaattctttaatattatgttattcagccactatatgtaactctttcaaatactatgttaatttgtgagtacctccacaacaacaaattaaaacatgaagtaaggaaatggacatttggcactattgggaaatgatacttggttaagcagtgctttattgcatacttgatatttgagaggaaggatttgacaagttaattagtcttttctcttacctaagtgatttcatcactcaaatcctccagaagttccaaagcggtatctatctctgtcttcagcagcagcacaaaccaaaccttgagagaattctgacacatgatccccttttattttgaggacatagggcaagagatgtgcagaagcatttccttggggcttgaagatgttatttgtgagagtagatgttcaaggttacagatcatacagtgtcagtctgagggccagatcctagtggcagaagacgttcatgtgttcttcattaaatttaatttgggttatttgtgacagctggggccctctgaaacatagggtttgtggcagggtcccctctttcttagacctaagggtgatactgcttgtgtaccatagtcccaggagcagaactgggtgtgctgagatatcaaagttatgcatgtaatctcagccaggttattataattaaatattatttgggtaccagataaaatgctgaaagttaatactggataggctgctgtcataaatctccttagctaatctatatgtttaaatggcagccagacaactaaagtatgtgaacaaatagcattgcaagctaaaattatgcttttcataagcaaataaccttcactgtgcttcttagcatcttggagttgttctcttcttggttgtggctactgttatgatgttcatatatagtaatcatcaatgtttaacatttaggacttctgagcaatcaagtaagcattgaatttttatcttatttctagtgtagaaagtaggaaaggaagtagagaaaattttcaatttagtgttgattcaaagtcaacaaatagatgatggctatttcacataattttctggtatttgctttctatagcattgttttcaaagtcaaggttctcatgggggagaagtactggacatctggacatcttttttctgacagcattgtcataagctgtgataactattttatgtttaaaactaatgtaatcagacaacattgtagtgtgcaataggaacccttatataatgtgtgaaatggtaaaattatatttatttaagaggatattgacatttattttgtatttgactctatacaaaataagtttttactgtatctacattaagaagatctccagtaagtgctttgagatcaattagtgcttaaattagcatttagagatcagtcatttagagatttttttcaagtatttatataaaacctgcatggtatattttataaataggctgctaatatagataggattctcataggtgagtggtaataatgtcataaactagtaataagttttataattactttaatatgattctgtggttaaaaaataagtttgtactatgtacataaagtatttatgaggcagcatattttgtcaaagaataatatttatctagtatatgcatattaccttctattttccccgtctagttttcaagtatatctttttgaactttagtcccctctgtgattgatttttaccccaccttatttcaaagaaattcaaggggactatctcttaacttttttttcctgtttttgttgttgttgttatttgtttttcggaggtgtgtgtgtgtggttgagacaggatctcagtctgttgcccaggctagagtgcagtagtgcagtcatagctcactgtaaccttgaactcctgggctcaagcaatcttcctgccttagtctccttagtagctagtactataggtgcacactgctatgcctggctaattaaaaaaaaaatttttttttaagagatggtgtctcactgtgttgcccaggctaatcttgaactcctggcctcaactgatcctctggcttggcctcccagagtgctgggattatttaaaaaccaggcaccacattcagccttggttttcaaattcttttcaggaagtctttttattaaatacgaaactatatcccaacctcaaatgcattcatacatggggaaaatgtaactttttgaatgtgttgaatttataaatgaataagttctttgttattatttatatcttaagtccttcttaaattagagaccaatacaacttacaaaccgttgctacctatgaaacctttttcaacttttgtgtcttctcaattgtattctgagtaacttccatcttccatcattatcattaatataatactggaaagagtagaatggaaatgatactggcctgagtgtttttaagtttccaaaagatatttggaatcttctgtctgcatttcaacagggccttggcttcgattgcttattttactataaagtgtgtttcacatgtttgccacaatatccttaaatatgctttgctgtttgaccgatgtaaaatcatactccagaaacacctgcatccaagaataactgctgttgaacaatgtgtctaaggctttaatgcaaataccaatcacttggggatcttgctaaaatgtaagttctgattaagcagggttggcatgggcctgaggtcctgcatttctaacaagctcccttgtgatgccactgctcctggtctaggtaccataccttaaggagaaagtatgggttacatctatatgtctagtgcttcctaatgcatttgcccagtgttacaggtctaacttgttcttaggcagtggttctcaaactttagcatgcatgagaatcacttgggagaatgttggctctaaatttacacgcttgggctccactcatcagagtctattttggtgggactttgggacccaggaatttgcacttttgaaaactcctcagattttgatgcatatggactaacaccacaatttgagaaactgatactttaaagtttggaattgctatagaaattcatggtcccttctggaatgacagcttgttaaagccaagcaaggatacagtgaaaagcccatctgaaaggagattgctttgaatgccagtgtagtatttggttaatggggaagcagtagtataaatttgcatgcttttcttttctattccgttgcttcaggcaatataatttactaggtgtattaatttattgtaatataccaatggtgaagaccatagctcattcactccctaattaaccctagaggagtcttaattggataattggttagaaatagtagatgagtaggtatattaaatgttgaatggatggtcagtattgattctactcttggattctgactaggatatttactctctctctctcagaaacatctatatctttaatattacttgctattgtatttactaactgtcacaagaatagcctgttccacatataaaatacagagttggttctcatgttttttgttgaagggaattcggataactagtgagttgtttgtcattttcatttaagacagaagttaaattctaaaagtatgtcactcagtgaatttttaaaaattatatcttttaataactttaagattgattcttcatctattcatgtctctgttttaaggatgtgggtggtatttatataattcctaattgattctataaaaagtattttaaacaaaagggttatatagaggttatagttattagataatcttgtcagaaacagtgccatttagaatacttggttcagcaaactgtttaatgtcagccaaagtgatttaaaagctttatttaggattaatccatcatctgcttaaatttattatctcatttattcactaatttgcatatgactttgcaattcagaaattttaagcaaacagtgatatacccaaaaatggattacaggataaattgaattaaagcaaactgcagtgcaatcaaggccagctctggacagaagcctgggattagtgagctgtgattacatcactccttttctgctcctccgcctttaagagcaagcttctttatgctatccctggatggttttgttccaacccctatgctatgaggtctctcttgcccttggagatttaaagttttgtatcagaaatagatttgaagatcatcatgaccaaatgtagttagtgctatgtgagaaggatatctatcacacaaaatgctttatggtcacagagagattagttctgtctgaagggaaaggggagaagatgacaaacatgccatcggggcaattaacatataacccttccacgggtgagaatactggaccaaatgacctttttggggtgcctttctgttgtgaattttctagtttattaataacccaagaactgtgccttatagtccatagtattcatacctctcaaaaccaaggtacttaggattggggaggaaaaagactctactaatttttaaagtagacctaaacaatttgcactgcctgtgtctttgacctgattttttactctcacctttctttatctgtccagttacctttgtatactaccaaagctttaaccttctgtcctctcaaacttttttaaattttactttatttaactaccaatttatcaaaacagtcatttacacttgacgccagcccactccgaaacagctgctgtctagcttctgctaccagcacttgactatgcttatttgaagatcatcagtgatacactaattaaaactccagtgacttatctggctttgtgttccttcatctatgccacagttgaatcattgaccactttttgcttgaagttctcagctcatgctgctttctgttgagtgcttctcatgctacctcagtggtacttgttaaatgttttccttttctactttccctccatttagtcgcacaaagcccccaccctctatactcgtctctgcctatttaacagatcctacctatgctctaaggcctggttcataggccatcttccctttaaatctttgagctaaaatgttttctcagttctgtagtttttaatctaatttttacttggagcacttttaggatgactgttgccttgatagtatgattttgtacacatttcttaactactctagcagatgttaaaaaaataaaaaaaggagagaaatcatcactgtagcttctgcaatgctgtgcattattagaaatctttaaatatttttcttaatatactgtggtagggagaataatggcaccccaaagatccccatgtcttattctttgagttagtgggtgcagcgcaccagcatggcacatgtatacatatgtaactaacctgcacaatgtgcacatgtaccctaaaacttaaagtataataaaaaataaaaaaaaaaagaaaaaaaaagaaaaaaaaaagaaaccactgaatatgttaggttacagggcaaagtcaaattaagttggaattaaacctgttaatcagttgatcttaaaatgtggagattaatctggattatgctagtgggcctattgtaatcacaaacatctttagaaataaaagagggagtcagaagagagagtcagagtgataccatgtgagatctcatcccttgctttaaagatggaagaaaagaaccatgagcaaggaatgtgggaaacctttaaaaactaggaaaggcaaataaaaggcaagaaaatagatttccccccagagcctccaaaaggaatgcagctgatgtgttgattttagtctagtgagacccatgtcagacttacgacttaccaaattgtaaaataaatactaaaaattcagagacaaagggataagtaaaataggaaaataaaactcattattccaagacttgcttaattccctttagaggtaatttgttcattattacactgttttttggttgttttacaaaggaattctatataatatagttatcccagtgaagaaggagcccagataagatatattgatttattcttctttctttttgtatgttgtaaaacagagtcttgctctgttgcccagactggagtgcagtggcacaatctgggctcactgcagcctctacctcctggctcaagaaatgctcctgccttagcctctaatagctgggaattacaagtgtgccacgtaatttttgtatttttatagagatggggtttcatcatgttgcccaggccggtctcgaactgctgggctcaagcaatcctccctccttggactctcaaagtgccaggattacaggggtgagccaccatgccctcacacaaaaagaaattggttggtacatatacacagctttctgatttctttttatttgagcttcataatttgaaaaagatacctctgttgttcagtggggctgctacatagtagaagctcaataagtattgaatgaatgaaaaaatagaattgataaataaagagaaaatgtctttattcattctaagaaacaaattaccctttagcatttttttaatttttaatttttgtgggtacatggtaggtctatatttatggattacatgagatattttgatatatgcatgcaatatgtaataatcacatcagggaaagtggaggtatccatcacctcaagcatttatcctttatatttcaaacaatataattatatcctttttagttgttttaaaatgtagaatttatttttgttttactatagttaccctgttatgctagcaaatactaggttttactcatactttctatttttgtacccattaaccatccccacttctctcccaccccctgccacaacttcccctctcaacctctggtaaccatccttctactctctatctccctgagtcaattgttttaatttttagctcccacagttaagtgagaacatgcgatgtctgtctttctgtgcctggcttatttcacttaacatagtgacttcacgtttcatccatgttgttgcaaatgacagtatctcattattttttatggctgaatagtacttcattgtggatatgtaccacattttatttattcattcatctgtcgatggacacttaagttgctttcaaatcttggctattttactcctgtaatcccagcactttgggaggctgaggtggtcagaagtttgagaacagcctggccaacatggtgaaacctcgtctctactaaaaatacaaaaattagccaggcattgtggcaggtgcctgtaatcccagctagtcaggagactgaggcaggagaatcactggaattcataaggtggaggttctactgagccatgattgcaccactgcacaccagcctgagtgacaactccatctcaaaaaaaaaaaaaatcttggttattgtaaataatgctgcaataaacatttgagtgcagatatctctttgatattctgatgtcctttcttttgtttatatactcaatagtggaattgctggatcatatggtagctctatttttagttttttgaggagcctccaaactgttctccatagtggttgtactaatttatatttccaccagcagtgtaggaaggttcccttttctccacatcctcgccagcatctgttattgcctgtcatggataaaagccattttaactggggtgaaaagatatctcgtagttttgatttgcatttctctgatgatcagtgatattgattacctttacatatacctgtgtgtcattcgtatgtcatctttggagaaatgtttattcagatgttttcccattttttaataagattgttagatttttcttctatagagttgtttgagaaccttatagattctggttattaatcccttgtcagatgggtcgtttgcagatattttctcccattctgtgggttgttgcttgactttgtacattgtttcctttgctatgcagaagatttttaccttgatgtgatcccatttgtccatgtttgctttggttgcctgtgcttgtgtggtattactcaagaaatttttgcccaggctaatgtccttaaaagtttccccaatattttcttgtagtggttttataatatgagaccttagatttaagtctttaatccattttgatttgatatttgtatatggtgagagatagggttcttctgcatatggataatcagttttcccaacaacatttattgaagagactgtcctttccccaatgtattttctgagcaactttgtcaaaaatgaattcattgtagatgtgtgggtttatttctaggttctctattctgtgccgttttggttatgtagctctgtcatataatttgaagtcagtaatgtgattcttccagttctgttctttttgcttaggataactttggctattctgagtttctgtgctgtcatgtaaatttcaggattgttttccctatttctgtgaagaatatctttggtattttgatagggattgcactgaatctgttgattgctttgtgtaatatggacattttaacaagattgagtcttccgatacacggacatgaaatatctatccatttgtgtgtgtgtgtgctctttaatttctttcaaaagtgtttcatagttttcattgtagagatcatttacttctttgattaattcctaggtatttaattttatttgcagctattgtaaataggattactttttaaatttctttttcagattgtttactgttataaaaatggtttttgtatgttgattttgtgtgctacaactttattgaatttgtttatcagttctaatagttttttggtggagtctttagttttttcaaatgtaagattatatcatttgcaaacaaggataatttgactgcttcctttccgatttgatgctctttatatccttctcttttctgactgctctagctagaactttcagtactatgttgaataacagtggtgacagtggacattcttgtcatgttctagatcttagaggaaaggctttcagtttttcccagttcagtataatactagttgttggtctgttgtatgtggtttttattatgttgaggtatgttccctctatccccagtttttggagggtttttaccatgaagggatgtggaattttgtgaaatgctttttcagcttcaatggaaatgattatatggtttgtgtcctttattctgttgatgtgatgtatcacatttattgatttgcatatgttgaatcatccttgcattccagggataaatcctacttggccatgatgaatgatctttctaatgtgttgttgaatttggtctgctagtgctttgctgaggatttttgcatcaatattcatcaatgatattggcctgtaatttccttttttgatgtgtctttgtctgattttggtataagggtaatactggccttgtagagtgagtttgtaaggattccttcctcctttatttttctaaatagtttgattcagattgatattatttcttctttaaatgtttggtagaaatcagcagcgaagccatcaggtcctggacttttctttgctgggaaacattacagctttggtattgttgtttgttattggtctgttcaggtttttggtttcttccttgttcactcttggtaggttggctatatctaggaatttatacatttcttccagatttcctaatttattgaaattatgtttgctcatagtagccactgttgatcccttgaacatctacagcatcagttgtaatatctcctttttcacctctgattctatttatttggttcttttttcttttttttttttttttgtctggctaaatgtttgtcaattttgtttaacttttaaaaaaacaattttttgtttcattgatcttttattctgttttcttcatttcagtttcatttatttctgctctgatcttttttttttttttagacggagtctcactctgttgcccaggctggagtgcagtggcgtgatctcggctcactgcaagttccacctcctgggttcgtgccattctcctgcctcagcctcccgagtagctgggactacatgcacccgccaccacacccagctaatttttcgtatttttagtagagacacggtttcactgtgttcaccaggatggtctcgatcccctgacctcgtgatctgcccgcctcggcctcccaaagtgctgggattacagacatgagctaccgcgcccggcctctgctctgatctttattacatcttttcttctaattttgagtttggtttactcttggttttctagttctttaagatacagtgttaggttgtttatatgaagtttttcttcttttttgatgtaagctcttatgtctataaactttcctctcagtgctgtatcctgtaggttttggtatgttatatttttattatcttttttacaagatatttttcaatttccttcttgatttccttattgactcactcatcattcagaaacatattgtttaatttcatgtatttatatagtattcaaaattccttgttactaatttctagttttattccattgtggttagacacttgatattttttcagttctttttaatgttttaagacttattttgtgacttaacatatgatctgtccttgaaattgatccatgtgctgaggaaaagaaggtgtattcttcaactgttgaatgaaatgttctgtaaatatctagtaggttcatttgttctatagtgcagatttaactgatgtttccttgttgattttctgtctggaagatctgtgtaatgctgaaagtggggtgttgaagtctccagctgttactctattggggtttattagagctactctttagctctaataatatttgctttatatatctgagttttccagtgttgggtccatagatacttaaaattgttatatccttttgcagaactgacccttttatcattatatagtgaccttctttgtctcttcttatagttttgtcttgaaatctattttgtctattagaactataactactcctacttttttggtttccattgggatggaatatctttttccattcctttggttttagtctacatatgtctttttaggtaaagtgtttttcttgtaggcaacagatcattgagtcttgtttctttatccattcagccactttgtgtctttttattgtagagtttagttcatttacattcaatgttattattggtaattaaagacttactactgcctatttggttttggttgtttcgtggtcttcttatccctctttccttccttcctgtcttccttttggttaaggtgattttctctgttggtatgatttaatttcttgctttttatttttttgtgtatctgttgtatgttttctgatttgaggttaccgtgagacttgcaagtaatatcttataacccattattttaagctataacaacttcacactgtttgtataaacaagcaaaaagaaaactgagtgaaaactctacatgttaacttcatcccccagatagttaatcttttgttgcttctatttatatcttattatactgcctgatttcaaaaattgtagtagttactattttctgttggctcatattttaatctttctatttaatataagagaagtttatataccacagttacagttttataatattctgtggggtttttttctgtgtatttactgttactagtgagtttgtactttcagtttatttcttattgctcattaatgtccttttctttctgattgaactactctctttagcacttcttgtagaacagatctagtgtttaaggcctttggcttttgtttctttgagaaagtctgtatttctccctcatgtttgaaggatattttcaccaggtatactattccaggataaaagttttttttttttctttagcagtttacatatgtcatgccactgtctcctggcccataaggtttccacttagcttactgtctgacttagagctccattgtatgttatttgtttctcttctcttgctgcttttaggatactttttttatccttaacctttgggagtttaactattaaatgttttgaagtagtcctctttgggttaaatctgcttggtgttctattagcttcttgtacttggattttgatagcattctctaggtttgtgaaattctttgctattatctctttggataaactttctaaccttatctcattctctacatttttttaaggccaataactcttagctttgcttttttgaggctactctgtaaatcttctaggtgtgcttcatttttttttctattatgtcctctgagtgtgtattttcaaatagtttgtcttttttgtctatttttattattatattttaagttctagggtacatgtgcacaacatgcaggttagttacatatgtatacatgtgccatgttaatgtgctgcacccattaactcatcatttacattaggtatttctcctaatgctatccctcccccctccccccaccccacaacaggtcccagtgtgtgatgttccccaccctgtgttgccaagtgttctcattgttcacttcccacctatgagtgagaacatgcggtgtttggttttctgtccttgcaatagtttgctcagaatgatggtttctagcttcatccatgtcgctacaaaggacatgattccattcaggacataggcatgggcaaggacttcatgactaaaacaccaaaaacaatggcaacaaaagccaaaatagacaaatgggatctaattaaactaaagagcttctgcacaataaaagaagctaccatcagagtgaacaggcaacctacagaatgggagaaaatttttgcaatctacccatctgacaaagggctaatatccagaatctacaaagaacttaaacaaatttacaagaaaaaatcaaacaaccccatcaaaaagtggacgaaggatatgaacagacacttctcaaaagaagacatttatgcagccaacagacatatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttatatggttggtgggactgtaaactagttcaaccattgtggaagacagtgtggcgattcctcaaggatctagaactagaaatagcatttgacccagccatcccattactgggtatatacccaaaggattataaatcatgctgctatcaagacacgtgcacacgtatgtttattgcgccactattcacaatagcaaagacttggaaccaacccaaatgtccatcaatgatagactggactaagaaaaatgtgacatatttacactatggagtactatacaaatagtttatcttaaaggtcactaattctttcttctgcttgatcaactgtatttttcaaatccagaatttctgctttattctttttaattatttcaatctctttgttcagttcatgtgatagaattttgaattccttctctgagttatcttgaatttctttgtgttttctcaaaacaggtattttgaattctctgtctgaaaggtaccatgtgtctctttctccaagagtggtccctggtgccctatttagtttgtttggtgaggtcatgctttcctggattatgttgatggttgtagatattctttggtgtctggacattgaagggttaggtatttattgtagtcttctcattctgggcttatttgtaacggtctttcttgggaaggctttccaggaattctcaagtacttgggtgttgtgatctaagcactgcctgcatgaaggggcaccccaagcccggtaacactgtggttcttacagactcataagatgccgccttcgtggtcttagataagatctggaagagttctgtggattaccaggcagagacacttgttctcttcccttgctttcttccaaaccaacagagttctctctatgttgagctgcctggagctgtgggttgatacaagtgcccctgtggttaccaccactgggattgcactgggtcagacctggagccagcatagcattttgtctcactcaaggcccagtataaccactaccaggttatcgcctatgttctctgaaggccctagggctctacaatcagcaggtagcaatgccagaaagtcttgtgtttttcctttcagggtagtgagttcccttaggcccaaatgggtctagagtagctgtccaggtgctagggactagaatgaaaaccttctaaatctacctgatgttccattgtactgtgcctgagcctaagccacgagtcacggtttttcccgttcttccctcctctttccacaagcagaggagcctcagcccacggccatcaccaacacaggcccatggggagtactgccaggcttccaccaatgttcatttaaagcccaagtgctctttagtcagcttatggtgaatgttgcctgacctaggactcacccttcagggtggtgggctcccctctggcccatggcagactcagaaatgccatctaaaagccaaggcctggaatcggggaccccaagaacctgcctcatgctctatctccctgtggcctagctggtacctaagatgcaagacaaagtcctgtttactttttcctctgctttcttcgagtagatggagtctgtcatcatagctaccacagctgggaaagtgctgtgtctcacctgaagccaacatgtctcagagtctcacccaaaacccatggcatactccatgagtattgcattggttattcagggccaaagggttctttagtccacaggtgatgggatctgccatgactgggtacttcctttcaagtcaatgcgttcccttctggctgagggagtttctcaaaatactttctgggagctaaggcctgaaatgggggtctcacaacattgtctggtaccctatcctactgtggctgagctggtatccaagatgcaagttaaaatcctctttactcttccctttcctctcctcaagcagaagcaaggggtcccttttggagccacaaggggtctcttttgcagcctggagctggaggagggtggtgcaagcactgtattaaccattgtgtctggtgtctcagtaagttacatgtccccccagtccactggctctgacaccagcccagcacaaggactcacctacgacttagagtccttatggcctagattgcctttcaagtttatttaggtgcccagagcactccatcctgcagtggcaaggcttgctggaactcagattttgactgctcagatgggtgattcccatctggctagagccagtccatatgctccttccatgagtggctgtcagctaagtacagcctggttctgcttttgctatgacaggacagcactgaattaagtgcagcgtgtcacaatcactgcattctttctccccagatgcacagattcttcttgccatgcagccactgctgggggatgagggaatgattgtgttggcagttcaagactttttcctgccctattcaatgcctctttctgtaatattcagttaaaaccaggtagtgtgaatgcttacctgatttttggttcttagaaggtgcttttttggtgtagttaataaatttggtattcctcttgggaagacaatcagtgtagctttctattccgccatcttgctccaccctctatgtcgaattactttttttttttttttttttttgagacaaaatttcactcttattgctcagactggagtacagtggcataaccttggctcactgcaacctccgcctcccaggttcaagtgattctcctgcctcaacctcccgagtagctgggattacaggtgcatgccaccacgcctgactaattttttttttttttttttgagatggagtctcgctcttgtcgcccaggctggagtgcagtggcacgatcttggctcactgcaacctctgcctcgcagattcaagcgattctccatctaagcctcctgagtagctaggtttacaggcacatgccaccactctcggctagttcttttgtaattttagtagagacggggtttcactgtgttagccaggctggtctcgaactcctgacctcaggcgatccgcctgcctcagcctcccaaagtgctaggattacaggcatgagccaccgtgcctggtctacttttaattcttcaaatgcactgtattcttatctccacccaccctgcctcaactgtactgtccctattcctcctctcttacacaaataatacttccattacatgaaggctttgttctccttccctttgaataagtcctacggattttaaaaattttgatttaaatcttaagccttttgtgaagggtttcttccttcatcactcactgcctttccttcccctcttccatatgtataagcaggtatactcactttttgtttccatagcaccttgtacttccaccgtagccttaatacattgcagcattattgtccatttaattatctttttcattaggctttaagctccatgaggttagggactatgtctctttttcatcattgttgcattcccaggcttggcataatgtatattttaataaatatttagaccaggcacagtgactcacacctgtaatctcgcactttggaggctgaggcaggaggcttgccttagcccaagagtttgagaccagtctaggtaacatactagatcctgtcactgcaaaaagttaaacaaaattttagccaggtgtgttggtacatgcctgtagtcctagctacttgggagactgaggtggggaggtgcttgagcttaggagtttgaggctgcagtgagctagaatcacactactgtacttcagcctgggcaacagagcagagaaaaatatataagaaaatttatatctagaataacactcatgaaatttactagtaatctcagatgtgtccaaaataatactctcagtctaggtagatatgaatattgtttttaggttgtttattagctcatttgttgaagttcatagccctacccaatattaaagttgatgataattttataggcttggccagatgtggtggttcatgcgtgtaatcctagcactttgggaggctgaggtgggtggattgcttgagtccaggagttcaagaccagcctgggcaacatggcaaaactttgtctctactgaaaatacgaaaaatcagcctggcatggtggtgtgcacctgtagtttcagctacttgggaggctgaggtgggagaatcacctgactccgtgaggttgaggctgcagtgagccgagatcatgtcagtgcacttcagcctgggaaatgggagtgagaccctgtctgaaaaaaaaaaaaaaaaaaaagtataggcagaatgtaacctcctgtaacagcaaaatctacttttaagtaaggtatttgaggtttatccagagttcaaagttgacatcttgacattgtttcacatttatatttgaacttaaatactttttggcagttgccatttttcagttagatggtatttttcaaacaaataattttattttttctgactttccttctttggagcctagtaattttgggagtatatatttagaacatcgtgtatagttttttaagaaagaaaatggcattgatctatttcttttgaaaataatactctgttggtggtttggaaaggtttatgtagaggtaaatgggtttatgtctgttgatgggctcctgcagataaagccacagacatcttcagccatgctgcttttgtgttgatgttctgtttttcccttgggacaataggtgctgttccttgtaaaaatatgataggaaaggaaatttgttctgttttgctgctatttaaagcaccacagacctgctcagtagactttgacactctattcatctcatcctccgttgaattattgttgttgttttattagggaaaagttttccttggagataattcctacaaagtaattataatttacaaagttttcttggttttccatgtgaaatgaaattatttctggagatttgggcctatgaatatctggtttcagagtcttaatcattaattgttttgcctcctatttagatgattaaagttaaagctaatttattttctctgttttcattactaacgtaaaatttttaggtggccagtagaaagaattcctaacagccaaaatctctggtcttttagaatgtcattttaaaccacttttctctcatcttcttatacatatttgctccgactctacctttcactgtgggtttcatttaccctggaacctaggttactaggggctgcaggaagtacctggtgcagggaatactagtacccattctttcatagccaggaaaaaggggagagggtgttggaatatacacaaacaagtcaaagttggggagacttgagtgcatcaagtcgataagtctttgccaagtcctgcctactgagggatgctcagtttctacagggcagggaagacacctttggtaagaaaataatttaccttctagcattgacccccttatcaatcccttatcctcctttagaagaattgaattgcctgtggttagcttctaacttccccaaagcatgtagtactctgcagcctgggttgtaaggcttataatgagtgtttgccctagtctggggattctttttaccataagtggtgtgtctgatggaaactgcctccctctggaagatatatatcatgaactctcattgtttcagtgtaacttctagtctcacaaattcatggagtgaaagtcagagagtgaaatttagcttagtttctatggggatgtgagtaatctttagggattattaaaacaatatactttttttccccccaagttttcccttgctcctctttttctagctcttcccccattcacctatggaatcatctgcattcattatttcaggagagaggtagatacagtctaaaatgtaggagtaattgctcagctctgagacttacattttataaaaataaattcttatcttaatgtaaaatacttcttcaggaacaaaattcaaaagatccaaaaggatctaattgtacataaatctcctccttctttctccccaacccaccagcattctttctctttgtcattcagttctgtatacacaaacagtacatagtttacactcttgtacaccttgcttttttcaagtaatacctttgctatagttctagattggtacatattaaactacctcattctttttaattagttatagtaatcatatcttactggtagatattacttcagttcctcatcttatgctttcacaaatgatgctgcggtgaaaatccctagccacacatcattttgcacacatatgagtttatcgataggataaattcccaggagtagaattactaggtcaaagacttattttattttttagagatgagatcttgctgtgttacccaggttgctctcgaaccctggacacaagcatttctcctgcctcagcctgccagtgtgctgggattacagatgtaagccaccacatccagccaagactaatatttttaactttgagtttaaatttttttttctatgtcaaactgtagacatgaaagtttagggttttttcctgaaacaaatgaagattttctaaattctagaaatttcacaatatgtattaacaaaatttgaaaatctgtacataattccactatactctatggtgtagaaaggactgaagatgatacatggacaatttttgccacattagaaggaaaatcctttccagtgttgagaagaagagccgtaggtcagtgtctttattcccctgtataccttttcaggagctgaacttcaaaagtaggaaacagggaggtattgacagtgatagtgatagtaatagtgaaaacagtcagttaggttctggagagaatctgagaacagcaagattgtctgagaaagacgaccctctaagggatagagaacttctaagagcactggtagactggccaaagcctataaacagagcatggaggctgcagaatacttggaccttaaaaccagaagatacagcaaaatttgagggcatcagtagtggttgccaagaagaccagccaaatctcagtgaacacaacaagcacaggatatttagtgaccaggtcaagtgataaatatctcaattgaaggcaaccaattgcctgacctacagcaagtgaactagcacgcgtgtcctctccaccatgaccatgaaacaactcagcttcctccttgtacctagttgccatcccaggaatgaagagagagtagagagattccttaaagaagttggactttttatggaaagattgtttgcctgaaagagactgctttaaactaggagaccaagttatgtttagttggtaaatttgtgacaactgcccatcctacccacacccatcactattagagaaaatcgatgctgcagagaaaaatgatataaaatgtagaaatgaaattatatatttcttgaatgtctcagtcattgtgtataaattttatcacccttctccagcatacacacacatgtgcacacactactggggagtatctctctaggttcttctaccacatgtaaggcatacccaagggtaaatcatatggcaacatacacaagtttctatattttttctattagctttaatattaatagaattttgtgtgagtatatagcaacttctggttgcctgtagctatctttactgaaatattccatcatatcttcaccatatcacattaacttaaataggatctcttttccttttatcaagtatagtaatagctaacattagtgagtgtttattatgtatccagcactgtgcccatatgtaatactttgcaaggatcaatgtgctgtatatgaggaaactgcaagttaaggaacttccatgtatactttgaagttcattctcttaaataaggaagctatattgccttccactgccttgcatttttgttttcagccctgtccttcaaaaccttactgtgtttgtgtaaattctgtcttcccatgttccttctcccccactcccttgtcccatttggttttctggtccttctctgttgcatgaattctatttccctccttttattgcctgaggtctttctggcacactgattctctgagcctgttcttatgctcctctttccctcccactctttgcccttttgtcattggcagcttcttacagattcccttgctgtttttattttctctctctcagtccaacaaagactgcttataaagagcagtgaccttgtcatttgaacaaaagattccaagaaccctgtgtaggttggttattgatttgcttaactgaagaaactgattagctacttcatctgttgttgagtatctctattaatgtcagggagttacatgttacagtattagtagctctgacagtgactgtcttcaaattaattttactgactgattttatctcagagttcttatctatagagtgatcactataatacctcccaaaaggaaagataaaatccctgaaagtgcattaccttagaggcttattttaaaacaagttttatttttttatttcacatttttaaagttccaaattatgcttggaaaagataatatcatttaggcctttaagttttttttagctttgaattcactgatatgtatttttcatttagatttgaaatatgataattgagaagagtatattcaacaaaagaagagtgaagtaatatatgaatgtatatgtaaacctaactacatatatttatagaaatatgcatatgcttccataaatattaaccatacgtgattatgtttgtaatattcacatattgcttaggaatgctaattaattaaaaggtcttgttgaattcaaattggttttacaagcttcattttaatgatttgttattattactgtgcgactttgaaaaaccaggtctattgaacttatggatatgggaaatacatatatttaaactgaaacaaaacgttattttatttttattttttattttttatttttttgagagagttttgctttgttgcccaggctggagtgcagtggtatgcgatctcggctcactgaaacctctgcctcctgggttcagataattctcctgcctcagcttcctgagtaggtgggattacaggcgcatgccaccacgcccggctaaattttttttttttttttttgtatttttagtaaagatggggtttcaccctattggccaggctggtcttgaactcgcgacctcaagtgacctaccaacctcggcctcccaaagtgctaggattacaggtgtgagccaccgcgcctggcctgaaacaaaattttaattgtgactttttagcattactttctcctcaaaaagccaagaattgactctttgatatgttatctagtgaaataaatttgatattattttctttgatttctgtagagaatttttgtttatagtttaaattccttttggataacattaggaattattttaataagtagagtaggttttctaattattagtaagttgtaattatttaccccctcattttttttcaatcttacaaaaggccaaaatatcacaatgaacatatccagtagaactggggggaaaattaaaaatgagtttctttatgcaaaattgctaccacatataatgcattatgatatggggagtggcttacagttcatatattcttatagtttatatattcttgattaaatcttttacagaacttagaaatttaagttaaaaacacttaaattaaaaaaatttaagttattttatgtggattaattttaaaattaatagcatagtagaaagatgattgtaatcttcaaagattttcaaattagtgtataccgttcatatgacttagaacatttaggaaaactacaggtatattttggcatagaaaataacaaaatgtggattattgtttttacttttttgttggatttcaatttgatgtttacaagtattgaggttattttatatagtattggaaagcttggatacctagaaacatggattcttagtggtgggttttggcatcaaacacacattggcctgagtcagagcttcatccatttcaagcaatgttaccttgggctaccattccgagcctcagtttccttggttatgaaatgggagtgatggcaattatctcaacgaattattgtgaagatgaaatgataagatgtttagcgcagtgcctggcacttattgagggttggtaaatggtagttgttgctaattgtagcaatgacaacagttctagtgttgtatagtgtgagaaaataaaatcaaatctgaaacatatatcacatcactttcatagctttctctctctgttttcaatttctgttcctgggactctcttttaagttcatatattataatgttattaattttagaccctaataacttctaaactgtttagagtcatagttatgtaatcataaacttttagagctgaagggaatttggggatcatttagtccaaacctcttattttacaagaaagaaaattatgtttggagtagtgaagtgatttacccagtataaattacttgtggcaggcttcttcttttttttttttttttgagatggagttttgctcttgtagcccaggctagactgcaatgatgcgatctcaactcactgcaacctccgcctcccgggttcaagcgattctcctgcctcagctttcagagtagctgagattacaggcgcacaccactacgcccagctaatttttgtatttttagtagagacagggttttaccacattggccagggtggtctcaaacttctgacctcaggtaatccacccttctcggcctcccaaagtgctggcattacaggtgtgagccactgagctcagccggtgggtttcttataagtggaacgctgttcattgtaccacatactggccccctcaatgtatcattcatttaaagtgtgaggctctgttagtttgatttgttcacttgagaccctgttatgcactgggtactgtgcatgaaatgagaactataaagttcctaccctgcagatattcatagtgaaaggaactgattgacaatcacagtagtgtgataagtattatagaagtagggtatagtaaatacagttaaacgaaaacaaagggataggaaccgtagtttattaagtgtctatatgacaagtaactcccatacactcatttaatgccataaccttctgatatagatattattatccataatttcttatttcatagcaaagctcagctcctgattgagaaggaaggaaggaggcatggtatccctgagttccagtaaaaaactcagtgctcatgaggacatgggccttctataaaagatttggtagatattggttgataattaaatgggagtgatgaatcattgagactgtctttttacctgccgctgacattaaagaccaagttgctttttttgtcatttgttttttacaaattcattgccttaattgagtagaagaaactaaacattttctaatttcttaagagaataaccttagtgatctaaactgaggaataagcatttcctgttgtaaatgtacttctctcagttctcttagtatttctggagtcaaaaatctagggcaaggccaaaagcttgggaaagacacagaatcttccatgccctctgagaccctacattttctaaacttaacttgattttctcactttgtttactctttttttttttttttgagatggagtctcactctatcgcccaggctagagtgcactggggccatcacggctcactgcaacctctgcctcccgggttcaagcgattctgctgcctcagtctcctgagtagctgggactacaggcgacctccttaagcagagagggggtttcaccatgttggccaggctggtcttgcactcctgacctaaagtgatccatgtgcctcggcctcccaaagtgctgggattacaggcatgagccaccgtgcctggcctcactttgtttacttttattacttgcttttctcctgctatgccttcgtaaaatctcttagttgcatcactgatgggcatttaaggcattgtgagaagatttagttgttcagtgacagtagtaagttgtcatttttattgctggcttaaaaaataatttttggaagagctgccatgtactaacagtccattgcataacactttactttttgtttttttaaagagatagtatctttttattaacatttttttaaaaatccataacttagtaggtgttagtgtttctaaaacacttgattgctcttggttccaaataggttttcagtggggaaaaaaatacccatttagagaatatttgatatggcatatatgctctctttctaggggaaaatatccttctgggattcttaggatacctgtttttttttttgactttcagttttataaatagagctgacctaggtttacgggtttctttcatttctaaaattctgctgttttactagaactactattatctttggaaactcttaattaaaagaaagaaaaatatataatattaggcagaaaccatgaaaattataaatagaaaattatattaattataatatgcatcagaatttggtgctctttatagttactgaaatgtatataaaaataaatttgctaacatagtgaactttttataagcaacaagtatgcaaaaagttcattaattattataagcagctagaatgccaggcagaatattagcaaccaaatttatattacataggcaataattgacagattcgtctctggagaaactgactattccaaaggaaaagaatcccaaagagctggccaggtcactactccactgacaatgaggcacacccttgaacaaaccccactgaagtccacagagcttctgatcacatttttagttcttttagttctttagtatttaatatataaaatagtctagaattactagattttcaaggaatacctttattgtgaatgaaaaccaaataacacaaaacagaaaaaaaggaaactcaggaaacaactcaagagaaacagagataatgcagaagaaagtacacggtatatatatatatatatatatgtacatatatgtgtgtatatatatgtacatatatatgtgtgtatatatatgtacatatatatgtgtgtgtgtatatatacatatatgtgtgtgtatatatacatatatgtgcatatatatacacacacacacatatatatatttatattccagaatattccagaaattctttcagagaatatgagatgaattagtgaaacttttcaaatgcaaaaatgacacagttactaactctaggaaaaaccaagcttgaacaagaatacataattatagaacattatatggcctaactgtgaataacagatatgtggttataagacaataaatagtgattaacctaaattggagatataatgatattagggtaatagatgtagtagaagagagtgtgtgtatgtgtgttcattcatgtgcttgtgcatacatacatatgtgagtgcagacatgaccatgggcatatgtgttggtgggtgggtaagtgctgtattctcatcttccatgttgcgaagtcagtagataaggggtttgcaaactatgacctggagtccaaatccagctgcccactgttacttcaaaataaagtttcattggaacacagctactcctgtttatttacatattgtctacagctgctctggtgccactatggcagagatgaattgtcaagaaagaatccatatggcccacaaagcctaagatatttactatctggctacacaataattaaaacaaattttaaaaatcaggaaatagcagttcatcatttagaaatatacatgtaaggcccagcatgatggctcatgcctgtaatcccagcactttgggaggtcaaggtgggtggaccatgaggtgaggagatcaagaccatcttggctaacacagtgaaaccccatctctactaaaaatacaaaaaattagccagatgtggtgatgggctcctgtagtcccagctactggggaggctgaggcaggagaattgcctgaactcgggaggcggaggttgctctgagccgagattgcaccactgcactccagcctgggcaacagagcgagactccgtcaaaaaaaaaaaaaaaaagaaatgtaaatacaaaaaaaatcagttgtgttctatgcagtaataaggaactatctaaacaagaaatgaagaaaacaattccatttacaatagctacaaaaaaattactcaggaataaattttaccaaggagatgaaagacctctacactgaaaactataaagtattgatgaaataaattgaagaggacacaaacaaatgggaatatatcctgtgttcatagattagaagaattaatattgttaaaatgtccatactacctaaaacaatctacagattcaatagactcttttttttttcttttctttttttttttgtgacaaggtctggctctgttacttaggctggagtgcagtggtgtaatctcggctcaccacaaacgccgccttcagagctcaagccatcctctcaacttagcctcctgagtagctgggactacaggtatcagccaccatgcctggctaatttttgtgttttttgtagagttagggtttcgccatgttgcccaggcttgtctccaactcttgagctcaagtgatgtgcccaccttggcctcccaaagtgctaggattacaggcatgagccagcacgcctggccagactcaacaccctttatcaaaattccaataacttttttcacagaaatagaaaaaataaccctaaaacttgttttaggattgtttaaatcttatttgtttaaatcctgtttagaccctgaatagccaaagcaaacttgagggaaaaaaaaaaaaccaaacaaataaaaacaaagctggaagcataacacaacctgacttcaaaatacaatacacaggtataataaccaaaacggcatggtactggcacaaaaacagaaccatagaccaataaaacagaagagagggcccagaagtaaatacatttatagtcaattgatttttgacaactatgccaagaacacacaagatggaaaagacagtctcttcaataaatggtcctaggaaaactggatatccatgtgcagaataatgaaattagagcctcatttcataccatatacaaaaattcaagtcaaaatgaagacttaaatgtaaaacctgaaactgtaaaactactagaagacagtgtaggggaaaagctccatgacattggtctgggcaatgatgttttagatataattccaaaagcacaagcaacagaagcaaaggtagacaaatagaattgaatcaaatgaaaaagcttctgcacagcaaaagaaacaacagggtgaggagtcatcctacagaatgggtgcaaatatttgccaaccatacatctgataaggggttaatatccaaaatatataaggaatcaattcaattgtaagaaaacaacctgatttaaaaatgggcaaaatacctgaatagacacttctcaaaagaagacataaaaatggccagcaggtatataaaaaaatgttcagtgctataagaggaatttgcatatctttacagatttggcagtgatcaaagcaaaagtctgggaaagctctacaagcagaattctcctttgactccttgaggagccttacctttcagattgagaaaagctataatatgatttaaaatccatctggcatttgctgttagattgtgatttttggtaacagcagacagtgtcaggttttattttattttcctagaatcagggtagtcaagaatatttcgtttactctagccagttctttttcacattttggcccaaactttattcccaaaacattatatcggtacatattttaaaatctagcaaacacatgggcatttgtgaagaccttttttttttttgtacaaaatgtgttctgaatttttgcttgtactgaaaaatacttgaaataaacacaggaagttgtatactaaaaaatgctgaacatcactaatcatcaggaaaatgcaaatcaaaaccaaaatgtcacttcacacctgttagaatgactgttagcaaaaagacaaaagataagtgtcaatgaggatgtggagaaaagggaacccttgcacgctgttggtgggaatataaattggtacaaccattatggaaaacagcatggatgttcctaaaaaaattaaaaatagaaccaccataggatccagtaatcccaataatgggtatatatccaaaggaaatgtaatcagtatgtcaaagagatattttcattcccatgttcattgcagtattaatcacaatagccaggatatgtcatcaacctgagtccatcagtggatgaatggaaaaagaaaatgtgaatacataatggaataccatccagcctttaaaaagttagaaattctgtcatatacataaacatgaatgaacctggaagatgttatattctgtgaaataaactaggcacagaaagtcaaataccacatgatctcttacgtgcaatctaaaaaagttgaactcatagaaacaaagtaaaatgctaactaccagaggctggaggctggaggattgggaagatgttggtcaagggacacaaaaatttcacttttataggaggaataagttcaagagatctattgtatatcatggtaattatacttaatgataatatattgtatacttgaacattgctaagtgtatatttgatatttacatattgtctatagccactctggtgctaccatggcagagataaatagtcagaaagaggttatacggcccacaaagcctaagatatttactgtctggccctttacagaaaacaaccttgtgatacacaataattaaaacaaatttaaaaaatcaggaaatggcagtacgtcatttagaaatatatatgtaaatacaaaaatcagttgtgtttctgtgcagtaacaaggaactgtttgacaagaaatgaagaaaacgattccatttacaatagctacaaaaaataggaataaatttaagcaaggaagtgaaagatctctatacaacaaaaaaatgataagtatattaggtaatgcgtgtgttaaatagcttgatttatccaccttacagtgtatgcatatatcaaaacatcatgttgtctacgcattgggtaaagtgtacactgcttgggttatgggtgcaccaaaatctctgaaatcactgctaaagaacttaattcatataaccaaaaaccacctgttccccaaaaactattgaaataatagtaataaaaaaaactcacacctgtaatcctagcactttgaaaggccaatgtggttggattgcttgagctcagaagttcgagtccaccctgggcaacatggcgaaacctcatctctacaaaaaaaatacaaaaattagctggatgtggaggcgcgtgcctgtggtcccagctacttggggggctgaggcgggaggatcccttgagcctgggaggcggaaacttaccttatacaccataattttaatttttacttgtcaatttaaaaagaatttaaggaacaatgtttgaaaatatgagaagaaatagcttaataaattgacaatgttcacctaaaatgagtaagagtctgaagtgcagaggaatgggacagaatactgctgcttttcatttaagcctaatagtatagtactgttttaaaaccatatacatgtattgctttaatacaatttttaaaaattaaatttagaaaattaagaaaaggtagctgttagaattaggcttgttggtgtagggttgccatgttacactgatgcataattcaccaaatactgtatttaaaaataaagtatcagagataccatggaaaaataaacatatgttaaaaaaataccagtaccttcaaacaccctattccctatagtatcaattttttattatatgctttttgatataactgtaataggtaattgatgcaaataacctccatctcttattttagtattattagtggtttcaaaacttcatatagcaacttctttttaccatagctgctaatgagaagcaaaaaagaaaaaaaatcaaaccaaagaaaattgatttactatcttgtcacactcttttggtgatggtaataaaccagaggagaaaaaaattaaaggagtagtgaattggctcaaagtgaatcagacaagtacttctgagggtcaatgaaccctaaaacctgatggtagataataaaatattgctgaattttgatttactattaagtatctttaatgtactgtgttttatattcaccaaacagagttatcttttcatataatgcaagatttttaaatgtaaaaaccatggtttatttcgttttgtattctctacagggtagtgtttggactcagtaggtgcccagtaaaggcatgctttaatatgaatggattttcactactgagtagcttgttctggttgattttcaaaagagtcttaaatttgtaagtgaataaaaaattatatgagtattatgagtgttcaaacaaatggaagcatttcttttccctgatttcgcataatgtgtatgatttgtgctaagtgataataaagacccttccgtttttcactcttggaagagaaacccttatcttctctacaaacaatttcaggttgttgttgctgtaaaacaagccctgagacctgttatcgactcattgttattttttctattttccaccatcctgtgagagaacatctttttaatgtggttttatacagtcttcagtgtgtctcagatatgggtttagtaaatctgttaagtacttttgtttgtcttctgttttttctctgaacaatacagttatgcaatttcctttgttattaaatgtcaggattattttcttatttatcaaccctgtagttttcaatcatttctgccatgttctttttggaagactgttgattgctttttagctaaatggtaccacagccagagaaaaagtggctaagatctgatgacatttgatgaattggtatgtcatttgcaattgtgtattctacccagttccctatttgagagaggtgttttctcctggaagtgctagagaaattgttatagcataattccttagaaaaattattcatagtaatgtatccgtgagacacatctagaccagggatatctcatggaaatgattgtcctttctgaacaagtgccacatgtttttatttgtaaacttattttcttctcatcctggaaataatgatattaaaaacattgtgtgactagtgatctatgactctgatatacaaacaatgcctattttattgtttctgtataataagcaagtcctgttgtgttcatttagctagaaatgaaaaaaaacccagcacacctgcattttgcatttaattaatttatggtggtgtagtattataccgtcttttaaaaactactggcaaattttaaatgtgcagtgcactatataaataggaatgagaagagtctattcatggcaaggtaattagagcatctttggctagaatatctctgagtaaaaatagctagtctcaatgttggagtaaggtaattaagtcctgaagaataatgatgaaaaccttttgctcagataccctttcttcatttaagttcaatgccgtacattcaaataaaatctgtgtaatcaaactagcccattaagtactactgagtgagataaattgtaatacctattctatatccttgcaaaagggaaatgcatgttatctagaaacataacagcttataaattaaaaacattcatttttcttctcttttgtcttatatcaactttttgtatatttatatacataatcacctaactcctacctcctcttctttcttccttcttcctcaggtaatgtacaataatacattatagtaaccaaaatcgagattgctggattttttttatgttcttagctctctgacaaagagagcttgcttgccctttttccccccaaatcttaaatataggcatctttcaatgagttgtctcagtcccattttttccccctgtaatccatgccttggtaaacctttattcctaccacaacactttatgcagtgattcccaaacatatattcctggtcaagtctcttggactccaaaattgtatttccagctgttgcctggatttctatatttgaaatgtaatgacatcttaaactaaatgacttcaaagtcaagaatcattctctagtccatctaatcatcccacctcctcttcacacagccttcactacctcagttcatgacaccatcagtcacttttgaacaacttgccgcattttacacatccaactaaagtcatgtccgttctacttatgtaacatcatcaaattcatctccttcattctgttctcattgcccttgctgaggttgaggcccacatgtcctcttgccaggagtatagcagttgctcttgatcttcacgtgctgcttcaccagtccattctacccacagttcatagatgtgctttcttaagaactggactggtaatgccattactctaaaaacttccactggaccttcgctgcctcttaatctaagaccagaatttttagcttcatttgcaaggcctgtcccagtttagctctttagcctccttttgcatatatgccatactctagaaaaatggaatggatttttccccctcagatacgttatgttattttccatccatatgtcttttcataatacgtaaccttcatgagggcaatgattttcttttaatctgttttgtttactgttttatccgtagcaagtaaaacctatatgtcacacgtagcaggtactcagtaaatatttgctgaatgaataggtaagtaaatggatagaagaagaattggaagatacatttcatgagactcacctattcctttctgactttgggttctgagcaagagtcctgtatcttctcagtaagttttctttgtttatgctaacttaagtgaattatattacttctaatctaatgatactttactgagacagcataaaaaagttagaatggcaacttggatagagggacttggtttagagacctgtttcattttgaaaaggtttctctcagctttgctttgtcatttacatagtataaatgaacaaaaccccactcaaaggtcagatatcccacaacccaaacatgtactgaaggaagaaacatcctgctttaaatggaacaacaatactatgtttttggctgcatgtaacaaagaaatttaataagagagtcatgtattaattacagacatatttatcctaagatactaatttatatactaattagttgattttcaaggcaaactaatttggttgtttttcaggccacaataaaactatccccaatattttgtatccacattcattttcttaataaatgaccaaaactttaggcaagaagcaaaagcagaatcatgatgaaaatgtgatgtcaaaactttgaagttttaactactagttatgtttcttaaggaatcaagacctgagatgggggactccagattcataacctgataaagtattttcaggtttgaatagatgtttgaaacacctttaaaagccaactacatagcttcagttatgtggaagaatgtgatagataaaggacagcttagattttaaaaacaaagtcaagaaataaatgtgtctataaggtacataaggctacagattaagaaggatgagacctgtttctttaccaaccaaacacttatgcagagatatatgttttcagtgaaacataggtgctgataaatatgcaattttctttggttataaaagattctaaggctcataggtattgctgaatgtttataattaagtaagcttactctaagaagcatgaatttagaacacaagaaactaaaataaattaagccataatttctgcctaagagaaattaaaagttcatgctttttttcatgactactggagtaattgtaggtatactgagcatgcttctttcatttgatttaattttgactctatcaatctatgccctggttaaaactaattctctcctagtgggcttttcttttctttcttttgtttttttttttttgagatggagtttcactcttgttgcccaggctggagcgcaatggcgtgatcttggctcaccacaacctccgcctcccaggttcaagcaattctcctgcctcagcctcccaagtagctgggattacaggcatgcaccaccacacccagctgattttgtatttttagtagagacggggtttctccatgttgaggctggtcacgaactcctgacctcaggtgatccacccacctcggcctcccaaagtgctgggattacaagcataagccactgtgcccggctgtgtccttttcaatagcatgtaattttcttacatattgtgaagtgttttagatgattttttccaatcctttatttatttaatattttgcttgataaagtataattgtacatattcatgggggtacataatgatagtttgatccacataatgtatagtgatcagggtaattaacatatccattgtctcaaactagatgatttttaatgaataataaactgatcttatttctaactagttaggaaaaacaaagaattcttcattatatttatgcacaacacaagggtacttatgagaagataacacttaccatctgggacacaacatttctaccctagtattctattcatggtgatagctaataactgacactattctcagggacagtagcagtggtagtattgccactattatagcccctactctagtcactgccttccagcaaacatgttcttgttatatattttccaattaacacttacataatgtctgaaatgtatggtggtaggtgttttagcctgttttacttcaaaataggaacgtaaggaagataaacatatacataagaagtgagtgtttaagcccatactaaaatttacatgttatactttagcacaacaccttcttcgaagtaaaggggacaactgaaatgtatcatcttgccatgtataaaaaggcatgtttcaaagcataatgaccacactgtaagccttcactctttctctaatcttctttaaatttgcacatgggtaacaggtcagacattcagaatagtgtagccaggtaaatcagaattttcattatctggatttgtatgcctcactgggtgcactgggggaggcctctatgacaagcatgttaaatgtgtacttttctggagcccaaaatgctgaagacattgctttagcctaggtaattcttctcagagaagaataattatttacacatgtacacatacaaaattatatatgctgttcaatatatgttttaaataaagagatatacatacaaattttctagctcttgcttacatttttcatctatagtgctgtaatgcaatgaaattaagcctctctggtaactgcagttctccctgagaataagtttctgttatagtaccattatgctagagggtcccacatatgcctgaaggaaatactttatgacagttgttaatattatagccaaatgatgcttttattccaatttaatcattcataaaaggcacaaatagcacctagtaagtactttcgtttatattttcccgtgcttttaaaatgttgattctatagcatcactcaatattaatataattttaagtattatttacttgtatttggtttgaaatataatgtctgccacttaatggattatttactacctgaaaaaataaactttgaggccagatgcagtagctcacgcctgtaattttagcactttgggagaataaaattgctgaggcaggaggaacgcttgaggctaggagattgagaccagctggggcaacatagtgacaccctgtctctacaaaaattaaaataaaaaaaaatagccaggcttggtgatacatgcctgtagtccagttactccagaggctgaggtagaaagatcacttgagcccaagaggttgaggctgcagtgagccatgatcacaccactgcactacagcctaggcaacagagcaagacattatacccccaaaaataaataaataaaatttgagcctagtagttgttgtcatttgccacttttctagactaaatcattattataagctataccatattactgacatgttttgattaatgtaacaaatgcttttccagcttaacatttttcacagcttattttgatatggaatttctcttaatgttatagtaacatctaaaaatagttttatttagataaatttctttaaaatgtatagtacaaataacatctttgttagatctgtaactaagaggcaataaatttgaagcacactccatatgagaaattgtaaagccaaactaacaaaatcgtgattactttgggatgacacagtgtcatgaaagtcaagaggagagtatcatgaagactgaaaagtgatagcactgaatgctgctgttcttttaaagatgaaggttcagctatcagagcaggaacctaagggcaaaatctgaaattaataaatcaagaaatagcaatataagcatatggctatttaggaataattattactattagataagaagttgcttctggaaagaggactcatgacaacaatggaatcatgggctgttttgtgatactggatttttaaatcatgaagcatgtgttatattttaagccaaaaaaaaaaaaaaaaaaaaaaactggggagggatcttcgtgttggtaggattcgttttccacctttaaaaatttaggtaaggaaagtgggatagaagccagactttaaggagacaagaaatggaaaggaagtagaacagcagccatagactagttcctcaagaagcttgacctgaaagagttatgtatcagttaaagaccatgagatagaggagggtaatctgctgtaagttataacttacacagtttgctgatttttatcatgaattaaaaatatgtacttgtttaaacgttgcactgccatttaccatttgctaagtagatgcataagaacattgaggccaaaattacagtcccaggagcctcagtttcactgtggagttttccctcagcaaatgtttgcttttgcttgtccttttttcttagctaaccttggtttctagatcaagatgattttccttctttgttttcacacagcatattcaattgcaccacactctttttaatcacaattctttctgatgggtttttgattggatccaaatttgcaggctgggccctgagaatctaattcagtctgttgcagtacttctcaatcattttagtcttagaactgctttatatgcttaaaaattattgagggccctgataatttttgtttttgtaggttttgtcttttgacattttccatattagaagtcaaacctaagaaattttaaaaatgttctttatttaaaataacattattcatcccattatatattaatataacatttttctgaaaaagttactattttccagtatcaaataattgaagaagagtgtatattttttccaattaaaaaaattctcttagcaattttcaatgcgttgttatttactatagtcatggttttgtacaacagatctcttgaatttactccaactgaaattttgtatcctatgaagtagttactataattacagataatcaggaaaattgacaaatattaagaacaactctcattcattcaaaatatccaccacttttgggaagtaaaattatctgctcttgtaataaaattagataaaatcttaaaatcaattagatagtacttgagctattacagctttgaaaatgtgtgtccctgtgtttgtgcatgcacacacactgaagtataatttattcagaaacagggcttgttcccacttggcaggagtgttgattttctagcttatctgcagtttgaggtaataagtctaacaagttttgggagatcttaagtattatactgtagtttgaagactgatttgttacatttgcaaattggttggtttccacatacagaccttaatacacctacctgtgttagttactttctaaatgtttgttattgctacaaccatacttacgtgtttcattgaattacaagttccttaagaacagtgatggtattttaaaaatcaggagtagcccaccatgactaggtatatggtattgaagtgctctctgcatatttactgacccatagttggtagataagggttactataaatagaaatagtccgccttattgccgataatggtggtaaaggcataactctggaaattatttttatttttaaaataaaaatgatagaatgagcactctatcttaagttgggtcctactatgatatttgtaacttagatcacttggagacatttcttaggtaccggctaattatttgttaatcaaaataggagccaagcttctaatagaagtgtgtaaaaaacagtaataatgatagttcctggaaaatcacttgcaaatattcaactgcaaaataaacttaagaacttttattaacaatatagattattatgaaagtcaagggatgaaaactgaagctctacacacacacacacacacacacacacacacacacacacacacacacgctttgagatagggtctcgctctgtcacccagactagagtgcagagtggcacaatcacagctcactgcggcctcgacctcctgggctcaagtgatcctcctccctcagcttcctgagtagctgggactataggcatatgccaaatacatctatacatgtaatttccagagttatccctttactacaattctcaccaaaaaatacaaaaatgcgactaatttttgaattttttgtagagatgggggtcttcctatgttgtctaggctggtcttgaactcatggcttcaagtgatcctctctccttggcctcccaatgtgctggtattacaggtgtgagccaccatgtctggccctgtctttttcaatattaatttgaagaacatccttgaatcaatgactattacttgaatataaaggccaaatttagagtttatcaagactcaatagataattacagtagataatatttactgagtacacactgtgtgccaagcactgtgatacatactgtatgcattttcacatttaatcctcaaaacaagtgtgttataattagggcttagcaaggtttaataactattcctagttaagtggcagagctgagagttgaacccaagaatttgaacggtgatttttaagaaattattgatgttgggaggctgaggcaggagaatcgcttgaacccaggaggcagaggttgcagtgagttgagatcgtgccactgtactccagcctgggtgacagagcgagactctgtctcaaaaataaataaataaataaataaataaataaataaataaataaaataaattattgatgctttgaaacgtatgttgttaatatagtcctgtattcaagtgttagcacacaattattttaaaatgtggagctcatcaattattccaaagagaaacttgttataaagtccctaaaatttcactaaggggaaaagctcagatacagacgtgaataatatttcactaagatataagattattagcatgaatgagatattatggggatgcaatgtaacttaaccatatgttattaaaagtgtttttattacattgatgagttatacattcatgggaagtatttatttcatatgttttgtagggagaaatttaaaaggatttggttaaatcattttgaggacataatttgagagaaacataccttttgcaatatttttatatccctgaaaattttttgttaaaagactccatctttaagagagctagagattctctcctggaaagtgactagaccagtgataaaacattatagatctggagtgaacaaattatatcactgcagttctaggggggctattgatataatttctagaaagggaagtttaaaaaatgcctgtatccatagaagtagattctgtagaaatacactgtagaagtacctgttaaacttctcccttccttattatgaggtaaaaaaatcaactatagctattgaatgtaaatgctatttgattatagtagactcttccagatgtaccccattctactcagtacatctgtttctttcactaagcaatgtgttccactcctgaagaatgtttgtctttaatgtatcacattgaaattccttcttattattttatacctttacacagttgatattgttttggttgttattttgcattgacatagttctttatattttcagtgacatcgttctttatatatgcttgttaacatttggcagttaagcatattactaagtttctttttaatgtttttaaagctagttaagagttttaggaaaaatattttctggtgtcaatggatacagaaggttaaatcatttgtctttgtcttgaaagacttaatcagaattgatatcattatatcagtggttttcaaccatggtcgtacattaaaatcgcctaagggaagttaaaagcaaacaaaaatgcgcattaaaaaatgaaaaccagaaaacaatgccaggacctgagattctggtcatctgagattctgatttaagttgtctgggacaaggtccaggcaagagtatgtttaaattactgcccaggtgtttctgatatgtgaccaggtttgacagtcacaggattgaactatccgtataaagcctccctcagtatctaggggggattggtttcaggacgcccacagacgccaacctccaggatgctcaagtctcttatattaaatggtgtagtattaacatgtaatctacacacatcctcctgtatactttaaattatctccagattgcctataatacctaatacattgtaaatgctatttaaatagctattaagtgtatttttgtttgtatttttattgctgtattgttatttttttcctgaatattttcaatcactggttgattgaatttgcagatgcagaacctatggattggagggtagattatattctgtgttcatctcctcttgggtgttaaatatacatttagtacagccatgttgtacagttcaaggagatgctgttcacattgtgttctatatgaatggcacttccttcaggaatgaatggtgccttctggaagttggctgctagttgtataaataagctaatggcttcagtaattgctgttagaggaatatgcattatggcagtagccttcttcacttccggcgtacaaatgattgccttgacagtcactctctatttaaaactggtcagatgtatataacagcaagaccagaaaaagtttgtattttacagtagctgaggatttcaaagttcccaacaggaatgatgggagctgtgtatgaaattaaaatttgcttgaggtttcagaactaagagcatgggaaatggttcagtataattttttcatcattgctgtttatggaagtattatggaaagctgattgcattaggcagggttccctagaaagacagaactaatatatatatacacacacacacacacatacacacacacacacgttatatataatatatatgtatatactttttgtttgtatttttgtataaactcccatgtgtaaatatatatatatacacacacatacatatatatatacacacacacacacatatatatatatttatgtatatgagtttattaacttacatgatcacaagttcccacaacaggctgtctgcaagcttgaggagcaaggagagtcagtccaagtctaaaaacagaagaacttggagtccgatgtttgagggcaggaagcatccagcatgggagaaagatgtaggctgggcggctaggccagtctcaccgttttatgtttttctgcctgctttatattcgctggcagctgcttagattgtgcccaccagattaagggtgggtctgccttccccagcccactgactccaatgttaatctcctttggcaacaccctcacagacacacccaggatcaatactttgcatccttcaatccagtcatgttcacactcattattaaccataacatttatctttctaaaatagaacaggaaaatatccatgattataaaaagagatgcctcattaaatgctattagaataaagaatacatggtacatctattgagtctcttgctaacatgacaaacatacattgctaactgtgcgtaggttctttacattttaattaattatcagtgatgtaaaaatcactggcctttaacaacagtttgatttcaaacccattaaagaggctaaggcaaaaatgtggctttagtctctcagccccattgtgtattctttactgtggtgaatatcaaaacagcagttaattatagtagtaccatttctgttcttcatttcattatctctgtcttgcactattattttttgttgctgctggctatacagcatcaggcctggcaccagcgaagtatgaacacaatgccagcactgcattcagcacaagaatagaaaggcagatggcagattttactatttatagttgtagccaatctgcctgaggtgagccctgccgaaatggttcttatcaagaatgttttcatttattaaagggataggaaatgaaagccaaataaaaagcctcagtcctcaggactctgagagcaaaactcttgctatagattgcaaagcaattccaagtattgactagatatttatgaactagaaaattatatatttaactctctagtctcaaagtaaagacttcaggccagcagtgacttcacagcagaacttgaggaattcattgttcagtgaagttgtgctgccatagcaactgatgcagagtgaattttaattattaagatcaaaataggcttatgataaaaactatttaacaacatcaaatatataaactgaattgtttttactttctcactaatcatttcttgactgctatagaaacagcacaacataactctacttcacatttgattctttatattgttttaaaaaattcattgtttgaaactccagtaaatattttagaatatcaattagtatgttgagataaacattgtgttcaaaattaaaatggcgtgtgaataatctagctttcttatcctctagacatctgatttaaaaagtgttttagtctcggctgggcatggaggctcaggtctgtaatcccagcactttgggaggctgaggcagggagatcatgaggtcaggagattgagaccaggctggccaacatggtgaaaccccgtctctactaaaaatataaaaattagctgggcatggtggtgcatgcctatagtcccagctacttgggaggctgaggcaggagaatcgcttgaacccaggaggcgcagtttgccgtgagctgagattgcaccactgcactccagcgtggcgacatagcgagactctgttgcaaaaaaacagtgttttagtttcaagaacatattgtggtgataactaaaacaccgtattgaagaacccaggtggttcatgtaatctgaaatatagcagtgagttatgatagtggctaataaaatttatattccacagaaaataaaaaccttaattataggctaaagaaattaatttgattcaatcatagtaattaaagaaaaatattttgattggatgtattggaatgtagcagattatttagtaatattctaaattattgcaaagcatctgttcattttaaatcatggtaaaatctgtcatgtgagtttattgattttatttaaatgaaatgattagttgattggaaattttcattttttcaatggcttatactttgatagaagaagcttatagaaaactagttttggaaaggtacagctacaatctaaatttagaatcagattttttgcttcatgaattttatgttccttttcaaaatatagcaaaaaagcaaaaaggacttctggttagatacaaagatatgcagatagcttaggtctttcccaatgaccctccaaaagtaaagaagtttttaaataaataaaattgcaagggcaaagaaaattagcgtggagataagtaataaaatttggaagctggaaggcaggtggatgagtgctaactaatttagacctgaggaatctcaattataagtttgtagtggggaaaactgacaaaaatctgatgtatatatcagcatcttatacaactcagaaattggaaacactagggccttttggaagtaggagttaaagtggtggctgggtgcggtggctcacacatgtaatcccagtactttgggaggttgaggcgggcggatcaggaggtcagaagttcgagaccagcctgaccaacatagtgaaaccccatctctactaaaaatacaaaaattagccagatgtggtggtgcgcacctgtaatctcagctactcaggaggctgaagcaggagaatcccttgaacccaggaggcggaggttgcagttagctgagatggtgccactgcactacagcttggacaacagagcgagactctgtctcaaaaaaaaaaaaagtagtagttggttttcaagatcccatcctcctcatacagctaggccgtcatacagtaaagcctctcctacttggcagaagactaaaggcatatattctgtagagggtaaaatatagttgccaggactgtggatattgcagaacagcagaaggcagagggcaggtgtataaggccattcttgcattgctataaagaaatacttgagtccagacacagtgactcaaacctgtaatcctaacactttgggaagcctaggcaggtgatcatgtgagctcaggtgttcgagactagcctaggctatatggcgaaaccccatctctacaaaaacttagctgggcatggtggcatgtgcctgtagtcccagatactcaggaaagcttagctgggaaattcacttgagcccgggaggttgagaccttgtctagaaaagaaaagaaaaaagaagagggggaaggaggtgaggggagggagacgagggaagggaaaaaaaagaaaaaagaaaagagaagaaaaatacctgaggctgtgtaatttataaagaaaagagctttaattggcttacagttctgcaggctgaacaggaagcatgatgctggcatctgcttagcttctggggaagcctcaggaaacctacaatcatggctgaggtgaaaggggagcaagcatgtcacatggccagagcaggaacaagagagagaggtgggaaatgccatacatttttaaaggatcagatcttatgagaactcactattgtgaggatagcatgaagaggatggtgctaaatcattcatgagaaatctgctcccatgattccatcacctcccacctaagcctcacctccaacactgaggattacttttcaacatgagatttgggccaggatacacatccagacgatattagctggtgaatagtagattgaatcagagatagtacatggaatttttgcctgttgagtgttgagacttcagtcttctgttagccctcagcatattggtaatcaagtatatataatcaaggcaagagaccagaagagttttctatgccaaatttaagaagtccaagaaagaaagacttacaaattccctgggagttccccagggatatagctcagtcacatcatccttcaatgaacacaactgtcaacaagccctgtccgttctactggccttccacttagcttccacttagccctattcttaaatatgagcatacagccaaatatcattaggcattggaagacagcatttgacttttttttagagaccaaaacaaaaaaataaaaacaacttgaataagactatgcagggaagagggaaaaaaacaaacataaaaagaagctaaactaaaattaatatctggggagatgatagaaaatgaaacaaaatgaagatttttaaacatttcttttattgattcataatatgttatgtatttatggggtacatgtaagtatttttacatgcataaaatgtgtaatgatcaagtcaggatatttagggtatcatcaccttgacaatttatcatttctatgttttggtaacattttaagtcccctcttctagtggttttgaaatatatgataatactgttgttaactatagtcagtgtagtctaatatctagtgttagaacttatttcttctatctagctgtaggtttgtacccattcattgacctctcttcatttccacctcccaccatcacgctcttccctgcccctggtacctcattctattctcaatttgtgtgagatcaagttttgtagctttcacatatgagtgagaacatatggtatttatctttctctacctgggttatttcacataccataatgacctcctgttacaatcacattgctgcaatgacaagattgacttccttttatggctgagtagtcttccattgtatatatgtacaacattttctttatccattcatctgtcaatggacagttaggttgattccatatcttagctactatgaacagttctgtgataacatgcaagtacaggtatccctttgatatactgacttcttttcctttggacagataaccagtagttggattgctgaatcatatggtagttctattgttgttgttgttgttgttgttgtttttttaagaaatctctataccgttttccatagtggttgtactgatttatattcctaccaacagcgtataagagtttccttttctccagatctttggcagcatctgttatcttttgtttttttaataatagccattctacctggggtaagatgagaactctttctggtttcgatttgcatttccctaatgattagtgatgttgaacatttttttatatacctgttcgtcatttgtatgtcttctgttgagaattgtctatttgtgtcatttgcccactttttaatgggatatttgttttttcattcttgagttccttggatattctgaatattaatcccttgttgaatgaatagtttgcagatattttctcctgttcaacaagttgtctcttcactatgttgattatttcctttgctgtgcagaagcttattagtttaatatagtccccttgtttatttttgttttagttttttgtgcttttaaggtcttagctgtaaaatctttgcctggaccagtgttctgaagtaatttcactatgttgtcttctattagtttcatagttttgggtcttacttttaagtctttaacccatcttgaattgatttttgtatgtgatgagagataatggtccagtttcattctttggcatatggatatccgattttcccagcaccatttattgaagagtgtgtccttttcccagcatatgttcttggtgcctttgtcaaaaatcagttagttgtaaataggtggatttatttctgtcttttctattttgttccattcgtctttttgtctgttgttgtgctattcccatgctgttttggttactatggtcttgtaatataatgtgatgtcaggtagtgtgctacctccagctttgttctttttgctcaggattgctttggccatcctggctcttttttggttccataaacattttagaattctttttactaactctgtgaaaaattacattgtaattttatagggatcgaattaaattttagattgctttgggcagtatggtcattttaacaatactaattattctgatccatgagcatgggttgtctttccatttgtttatacccttttcaatattttccatcagtgttttatagctttttttggtagagatttttcaccttcttggtcaaatgtattcctaagtattttattttactttttagctattgtaaattggatttccttgatgcttttttggctatttcattattggtgtctagaaatgcttccgatttttgtttgttgattttgtattctgcaactttactgaatctgcttatcaactctaagagattttttgttggactcttttagtttttctaaacataagatcatgtcatctgcagagagggacaatttgacttcctcacttccaatttgtatgtcttttatttatctcttgactgattgctgtggctggaacttccagtactgtgttgaataggagtggtgaaagtgggcattcttgtttcattttgtagaggaaaggctttcaacttttttcggttcagtatatgttagctatgggtttgtcatttatggtctttattattttgaggtatattccttctatgcctagtttgttgacagtttttatcatgaagggacattgaattttgtcacacttttttctgcatcagttgaaatgatcgtatggtttttgtctatcattctgttgatgtgatgtatcacactgattgatttgcatatattaaatcatctttggatctctggtataaactccacttgatcatgatgtattatttgattttcgtttccctgatgattagtgatgttgaacattttttcatatacccattggtcatttgtatgtcttcttttgagaattgtctattcatgtcctttgcccatgttttaatgggattatttgtttttctattgtcgactgagtttcttgcatattctgggtattagtcctttgttggatgaatagtttgcaaatattgtctgttgtgctgttgaattacggtttgctagtattttgttgaggattttacatctgtgttcttcaaagatattgacctatagttttttgttgttgttgttgttattatgtccttgtctggttttggtatcatggtaatgctggattcatgatatgagttagggaaaatttgctcctcttcaatttcttggaatagtttgaggaggattggtattagttctttgtgtgttcggtagaactcagcagtgaatctctccagtcccggcttttctttgttgggagacattttaattattgcttcaagttctcgttactggtcttttcaggttttctgtttcttcctgattcaatcttggtaggttgtatgtttctaggaatttatccattttctcttaagttttccagtttgttagtgtatcgttatttataatagtctattatgatcttttgtagttttgtggtatcaattataaagtctcctttttcattttttaaaaatttgggtcatttcttttcctggttagtctagctctagtggtttatcaattttttcttttcaaagaaccaatttttcatttcattgatgctttatattgcttttttagtatctattttgtttagctctgctcttatctttattatttcttcctttctaccaatttgtggtttggtttgttcttgctcttctagttccttgaggcatattgtcagattgtttatttagaatctttttactttttaaatgtaggcatttattgttttatatatctcacttactactgcttttgctatatcccacacatcttggtatgttgtttttccattttcatttcttgcaagaaatatttgtatttccatctgaatgtttttattgacccagtgtttgttcaggagcattttgttcaacatccctgaatctatggctttcaacattcctcttggttaaaacttctagttgtatttcattgtggtctgagaaaacatatgatttttattttgtttttttttttttttttgagacagaatctcactctgtctcccggaatgaagttcagtggcacgatcttggctcacttcaacctttgcctccctgattcaagcgattctttgcctcagcctcccgagtagctgggattacaggcacctgccaccatgccccgtgaatttttgtgttttgagtagggactgggtttcaccatgttggccaggcaagctggtcttgaactcctgacctcaggtgatccgctgcctcggcctcccaaagtgctgggattacaggcgtgagctaccatgcctggcctatgatttctgtttttacaaatttattgagacttgttttgtgccctaacctatggcccatcatggataatgttccatgtgctgatgaaaataatgtctattctgcaatttttggataacaatctctgtaaatgtctgttaggtccattaggtctgaagtccagtttaaatccaatgtttctttactgattttctgtctagattatttacctaatgctgagagtggagtgttgaagtctcccactatcgtgttggagcctctgtctccttaggtctaataatattttatttatgaatgtgggtgctctagtgttaggtgcatatattaatatatttagaaccattatatcctcttatcctcctcctggaataattactttatcattatatacttgtcttttttttttttttttttaccttattttgactcaatgtctgttttatctgatgtaagcacagctactcttgcttccttttagtttccatttgagtagactttttccattccctttactttcattctatatgtgtctttacaggtaaagtacatttcttgtagacagcaaatagttaagtcatttttttaattcattcagtgagtctatatctattaagtgaagagtttaattcatttatattctaggtggttattaatatataacattttgttgctgtcatatagtcaattgtttttggttcttttctatattttttgctcctttctcttttcttgtttgtcattgtgttttggtggttttctgtagttgtacctttctcctcctcatttgtgcttaagttttaaacatttgcgtattttcatgatggtagatggttgtcagtttgcttccaggtttaggactcccttgagcatttcttgtaggtctggtctggtggtgatgaattccctcagcttttctttgtctgggaaagactactttttcttcattttttaaggataattttgtttgctatggtatccttgactggccttttttttttatttcagcgcttggaatacgtcatcccattttctcctggtcagtaaggtttctgcaaagaaactcattgttagtctgatggttttttttttttttaattataggtgccgaaacacttttctctttttgtttttagaagtatttctttgtctttgactttagacaatttgactataatgtgctatgaagacctttttatgttgtatctgcttggggatctgagagtctcctgtatctggatttctaaatatcttgccatacttgtctgttatttcattaaattggttttctaaccctttcattctcccttcgccatctgggaccctggtaattcagattttggtcattttatgatgtctcacatatcacaaatgtttcactcattcttttttattcttttttatttttggtctgtgttatttctaaagacctttcttctgcttgttctactcttttgttgaagctgtagttccagaacttttgtctggttctttttttttttaatgatatctatctctttggtatatttctcattcatgtcctgaattatcttttgttttttgttttcagaattctcttatatctccctgagcttctttagaattgataattttcattttctgggatttcatgaatttctttttgattgggatgtttctggggaattattgtgtttctttggaggtattaatatttccttgcttttccatgttttctgtgttattacattaatatctatacatctcatataacagtcgcttctttcagttttttgaatttctggcttttatagaggaggacttttcctgaaaatgcatctatgatgttggttttttaggacactttggctttgattctgggtgcaggctagtagtataatctttgcatgatttctttaattgtaaacaacaccagtggtgtctgtgatttccttagtggcttagggtgtagttattagtggaggttgtgctggagtttttatggggatttggataccaaatagttcagtatttggggcctagtggtggcagtggtaggtttggtgtgcctgttcctgggcctcagagttgcatacaccagcactgatgttggcacgtctaggtgggccaatacttgggcctccaggtgacttacccaggtgttgaagccttggttccagcaagtgggcaggttcttaggcctctgggcagctagtgtggcatgggcaatgacagtgacaatggcgggacaaccctctggttcctgagcagtttgctttcatattgggttgctgcaatgggatgaacaggccagtctccaagccctcaggcagcatgtgcttgtagatgttagttgtagtggtattagttggatggaaaggcccaccctcaggcccatgggagtagtgttcagatgccaacaatggtggactgggctgggtactcccctgacccccagactctgctctggcatggagaaggcaaagcttggccaggtaggcttgtccttaggtcctctgatagtgagtgcaggtaccagccatgttacgcaggagtgggtcaatgcgcatgctaccgtcaggatgctcagctggtgggaggaagcagttgtgctgctgccttgacactgggaagggcgggactgccttcagtggcaggcagcctaggcctctccagtggcaaggcagcagcacaactgccttgtcactgggtgtactacttgcacctcagtcccagtggtgcttgtgcctcagtctcctgtgcagtagcccatgtttgctcatgtctaagccacataggcagctgccatgcttctcttgagcttcagccctggcactgttgggttccaggacagtacataatctgttgtagacagcactcaaaaatggtaccttgctgtagctgtttaggtctcagggagtgtgtaggacccagcatgagctctttcccctccttagagcagtgctgttgcacaatctcatggtgttaccctctgttagtttcagagcctgtaaggactgaggggttctcccaaagctaggatttcaggagtccatggtgggaatgtgatctactgaggatctttcaattaccttttccccacattggggagtagctctcagctccctgctgatcccagccaagcagtctgcctcccttcctttctccttgctttaggtatttcctgtcactttctgttaaatcccagtgttctctcttggatgatctatttgaagtatggttattcactcactattttggttcttcttagtggaggaagcaagtaagacaatcaaaaccaagatttttatacatacatacatacatacatacatacatacatacatacatacatacgtacgtttgtgtagggaacatgcagggtattaaaatcagcttgtggaatttttttttaaccagaaaaaaattttaattgaatctaataaagggttagaaaatgaagttgagcatatctctagaaaacagtacagagagataggaaataggatagacaataaaattagagaactcatagcagtaaaaagaacagacttgctacacataaccccatgggtgaatctgaatacacagttattgagtgaaagaaaccattcacaagggagtatatagtagacgctttcatttatgtgaagtataagaatagataacactacgttcatggtcataatagtggctacctattaaagatggctataatacaggttagttataacacaggaagatgggttgattcatatacctatcagagatggtataatacaggaagataaattgtagttcaccaagtatatatacatggaaaaattatttgtgctatatacttaagttttgcttattgtgtattataaacacaattgaaataatagaggaggaaaaaatcagagaagcagtctaagatgcacaacacttcagcaataagaatttcagatttagataaaaataggaaaaatatagggcagaaaaaaagaaatacatcaaggatgttttctggtattgaggacaagtattcaaaatgaaagggcacactagttatccagcatattggataaaattcaataaaaatgactgtgtggcttagacaccagccaggggcagctggttgcatctttagttcaagctacttggggggccaaggtggaagaattgctttaagctaggaatttgaggctgtagtgtgctttaatcacacctctgattagccactgcactacagtccaggaaatatggtgagatactgtctcgggggtggggggggggaagatataccaaaacatattattgagtaattgtggaaccctaggaataaataaaagatcttacaaacttccaaatgagaaaaatataggttttgctgttcaatagaaatactggaagaaaggagacaatggaacatcatcttcaatatctgagaaaaaattatttccaacctagaattttatacctagcaaaattaccaattatgaacatctccattcagcttttctcaagaagctactgtagtatgtttgctgccaaaaataagaaaacaagtagaaaggaagacataagatatagaaattagaaaatctagtatgagtaagagaggtgaaaggaacccttgggaagagggaaaggaaaattccaactcgacagctgattagagggcctattgagaaagcagtttagatcagaagtcagaaggatcacaggagttttttgttttttgtttttttgtttttttttttgggacacagtcttgctctgtcacccaggctggagtgcagtggcacagtctcagctcaccgcagcctttgcctcccgggttcgagcaagtctcctgcctcagcctcctgagtatctgggactacaggtgcgcaccaccacacctggctaatttttgtatttttagtagagacagggtttcaccatgttggccaggctggtcttgaactcctgacctcatgatccacccgcctcggccttccaaagtgctgggattacaggcatgagccactgcgctcagccagatgtttttcaagaagatgaaattgataaatattgagagtatttaaacacattcagggaagattcataaaactgggggactgttttgagtacatagaaaacagcaaacaaaaaacaagataggtatgaactgtggaggaaactgagaaatggaatggaaagacaatactatattatccagtcatgaatggattatgtaactacatgactctattaatagaaatatctcatccagatagtgtattacatataacggaatactataaagcagcaaagaggagttaatcacagatatataaaaaaaaatggggagtaagaaaaacaagttgccactaataccacttataacaagttttgttgtatttctaaaaactgataaaaaactatagaatataacatgataaatatccatgtatccacaactaagcttgagaaataaacactatagccgggcacagtggcttacgcctgtaatcccagcactttgggaggccgaggtgggtgggtcacgaggtcgggagatcaaggccatcctggctaacacagtgaaaccctgtctctactaaaaatacaaaaaattagccaggcgtggtggggcactcttgtaatcccacctagtcgggagactgaggcaggagaatcgcttgaacccgggaggcagaggttgcagtgagccaagatcgcgccactgcactccagcctgggtgacagagtgagactccgtctcaaaaataaataagcaaacaaatataatggaatccttccatgcgctcccctctggtaccatcgctcttcgtctttgtctgaaggtaaccactgttttaaagttcatacttgtcatttctgcatacgtctttatactacatacagttgactcttgaacaacatgggcttgcactgtgcaggtctgcttacatgcagattttcttttacctctgccacccctgagacaacaagaacaatccctcctcttcctcctcctcctcagcctactcagtgtgaagacgatgacgatgaagactttcatgatgatccacttctatttaataaatagtaaatatattttctcttccttatgattttcttagagtttcttttctctagcttactttgtgtgacaatgtagtatataatacatataacatacgaaatacgtgtttttgtttttgtttttgttttttgagatggagtttcgctcttgttgcctaggctggagtgcaatggtatgatctcagctcattgcaacctccgcctcctgagttcaagcgattctcctgcctcagcctcccaagtagctgggattacaggtgcccgccaccacacccagcaaattttttgtatttttattagagatgaggtttcattatggtggccaggctggtctcaaactcctgacctcaggtgatccactcgcctcggcctcccaaagtgctgggattacaggcatgagctaccgcgcccagcccacaaaatatgtgttaatcaactgtttatgttatcaccaaggcttctggctagcagtaggctactagtagttgagtttttggggagtcaaaagttatacatggatttttgactgtgcatagggccagtgccccaactcctgcattgttcagaggtcaactctgtgtgtgtgtgtgtgtgtgtgtgtgtgtgtgtgtgtgtgtgtgtgtgtgtccctaaacaatatttagcaagttgactgtttttaaactttatatcaatggtgtatattaaatatgatcgtctacagtttgcttttacagctcaatagtttaaaaacaaaacaaaacaaaaagctgcagtaatccccctgccgttattcatgaggattacatttcacgacccccagtggatgtctaaaactagattagtactaaatcctgtatacattttcctatacatatgtacctatgatggtttaatttataatgtttgcacgggagattaaaaacaataactaataataaaatagaataactagagcaggccaggcaaggtgactcacgcctgtaatcccagctctttgggaggctgaggtgggcggatcactggaggttaggagttcgagactggcctggccaacatggtgaaaccccgtctctactaaatacaaaaattagccgggcatggtgtcatgtacctataatcgcatctactcgggaggctgaggcaggagaattgcttgaccctgggaagcagaggttgcagtgagccgagttcatgccactgcactccagcttggatgacagagcgaaactctgtctccaaaaaaaaaaaaaaaaaaaaaaaaaaaaataattagaatagtatgccagtatcactaatcttgtacattgtactttggagcaattattagggaaaataagggttacttgaacatagcactgtgatattgtaatagttgatctgatgacagttgaatggtaacccagaaggtgactaacaattagtgtatacagtgtggtttgattcattgaggttatgctcacatcatggtcaaaagatgaaagtggaatggtttatatctccttgttctcaggaaaaaataaaagtttttgaatgccactgttcaacttgacaccataaggttaagtattgttttgttttcttgatctgttgcagttaagacaatttgcatgcatcttttaggtatagctgtaaaattttctcttttgaaatgtcatgagtcaaaattgaactgtgggaaataaaaaataaagaatttgtctctatttatttttttaatgaaaatctctttgtatctcagaatttcatgatggtctaggaggcctgaaactctgtaggtctagactgtgaggatctctgagaactgcatgctctgcatattataggtactcaatcagcactgattgctggtggcttaaactgcaagaactacgttatagccagcaagcaaagatgcccaattagtcagtgagtgatttgccaggggaagtctattttcagcctgggtagttactattaagagaggatcctagaagctgcactttttgcctgctaggtgttcggaatacttttgaaagaactgaagtgttcagttcagtggagacatcttagatcctctatatttacaaatttacagcccttcatttcccaatttcttcaacctttttccttcctggaagtcatgctttcatagtttaggggaaataattagttttataaaacattcagttcctaaaagattaataattccaaaggaaaatatattaattgtagttatgaaaaatgcactgacaacaggctatcagctttcagaattgcttcttagtttttcattaaaatagaaaactcaaaatgtctcatgagttttatagaaaaattgagcatatttaaaaattaaatatgtataattttataagaacaaaaaaggtttgaccttgaaaatttttttcttcagttttattctgttacaggacagtgcctgcacattagtaggcacttggtgaagatttgtgaaatgaatgtgatagcataatgttattggaattcatcattgctgaattaatgtatatttgtggtttctgtaggaaatcttgtccttatctcacctcaggtttttaccataacatttttttcctctttgcaaatatcttttgattggtattttaattattgataaggtgtgcacttggaacattcattcaaaatgaataattccagtgtcaggggaaaaaaaaaaacctctggaaatttaatgtatggctttttttaagtgtatatatcacttttttttccaaaggacagtttgaaagtgaaatactccaaagtaaaagcaattttaactttctgaaactgtgtatgtttgtttgcgtgtgtgaaaaaagatggaaaaaaggaaagatagaagaagggagggttgggagattgagagagggagagagaggagagaaatgtgctttctatgaaattttgacacatttccaggataactgagaatgataaattaagtaaaaagaaaaataagcattcttattttatgtgggaagaattatgctttttttcctttaaagaaattgatttttatgaaaacaagcaataatagctttaacaaatacataaaaatttttagatcaagctgataactgcttttagataatagcctaagtcactgattagaagggaaaacccatctttggaaaatatcttttggaaatcatcttttgtgtatcatgttaaaataaaaatttttcttagtcatttcaaggaaattttctaacattaggaagggaaatattgttaattcttttcagcagaaggtagagtaccggcattaatgacaaatacatttttaccttagaccttttaaataattacttttttccttttaatagagaaaaggacacatttagatattggatgtttattttacattttaaaacaattttctttggggaaaaaatagggtgaaagttcttgtaaaaccaaggaaattttgaatttgtagagcataagtagatactgacaatttttcttgctacatctgaagttagttatttgacttaaaaggccaacaatctcatttattggtttctttgaagtagttggttgccttttttctctcccacaccaaactataaagataatttcataaacctctttttagttgagcttttgggttttgctaatttttctgacttagatgaagtttcaattaaaaatagactataaacttatatgtgggtggcagttgaatgagttgctatgacagttcatattatgaggttgaaccaaatgcaaagtagcttaacagaatttgagaaacatagagctatatcagtactaatgattacccttctttaacctatgctgcgtataaaggaacatgcctttctctcagggtacaaaagttttactggagaaatcagtgaagcctgtaacccttatcctactgctactaagaacctattttcctaaggaacaccccactttcccacttgtggatattggtaaaaggtcttgggaatatcaagtctggtctgtattttcccatcctctacaggtaatctcagaagaggtgcttaataaatgctatacaccatcatccaattcttgctcctcctgttcctgaaagaaagtttagccaggcagggtggcgggcacctgtactactatggagagaggtgtagagtggtgctacctgagagcataacactaatgatctgccatcgtgtgaattttccatatttttctgcattgtttgtggtcattgtggaaaagtatgattctgatgcatgtatcaagatcttttaaagaacacaaaaaagttataatttttttcaactctaaaatcttccagtgaaactaacttttaaggaagatcttccatgagtatcaagtggcttcacataccctatgcaagagtattgttcaataagggctcacccagttagttactctcttccttagtccaccttttaaaaatgctgccagatgaatctccttgaagcttacattgttatgtaatttccttattttctttagaaacaaattcagaactccttagcttacctggtaatgctctctacaatctgccctgaacctccctttccaatcttagacctcatttctctcgtcatacgtgctgtggtacaacaatctctgaaccctgctttgggaaaaccatttctttgcttatgttggtacttccatttctctttgctgtgaacatttgaactatttccaaagtccagatcaaatgcctagtccctcttaggctttctcctgcttttcaacctaggagtagtaatttttctcttttttggtttctttgtaaatctcttctaaattttattagtatttaacccttcccttatagttctttacacatctttttgttctctgccagaatataaactacgtaagaataatcttttacatgtttccaaacccaacattgtctactctgtatcctgtatagtttgtgccctgtaaatgtctactgaattgaacttaaactttgaagtataaccctatagacataccactaatctagggacgtttgtatactctttcaatgctaccatgtactctttgaactgcatcttgacatttaatttttctatgacttagttttttttaacccacaaggtggttataatgatatttcactgtgcactataaaattgttatgttatctttcaaagaactactttgaattccctgggagacaaatggtcaaatatatgaaacccattatagaatttcacctctgacatatggcacaacttagagataattttgtttaaatgccaagtaacctggagctataagtcccgtaataccacataggtatacatgtttatgtatatgtaatcgttcatgtttataacctcattttgtagtgtgatagtaggctatggtaaatttgtcttaaaattttttaggaggccaaaattcttacagaaaaacatattagtgtagtgttgagagtctaggcactagagatagactgcctacgttcattaaaaagttaaataagttgcccggggtcacacaaaagactaaagggtgatttgaacttaagtttcctcatttatcattcagaataataagagctcctatttacagtatagttttcaagaataaattacctaatactggcccatagtaaatacatatttattatttttattatattttcatagataaatcatacataggcttagttggaggttaaacttagtggtaaagaacttagcatcaggtaaaccggggttttatttttgatttatttttttcatttcttttttttcttttttttattattttctttattatacgttaagttctagggtacatgtgcacaacatgcaggtttgttacatatgtatacatgtgccacgtgggtgtgctgtacccattaacttgtcatttacattaggtatatctcctaatgctatcccttccctgtccccacaccccacaacaggccctggtgtgtgatgttccccaccctgtgcccaagtgttctcattgttcaattcccacctatgagtgagaacatgcggtgtttggtttaaaatccttgtgatagtttgctcagaatgatggtttccagcttcatccatgtacccacaaaggacatgaactcatccctttttatggctgcatactattccatggtgtatatgtgccacattttcttaatccagtctatcattgatggacatttgggttggttccaagtctgtgctattgtgaatagtgccacaataaacatacgtatgcatgtgtctttataacagcatgatttataatccttcgggtttatacccagtaatgggatgtctgggtcaaatggtatttctagttctagatcattgaggaatcgccacactgtcttccacaagggttgaactagtttatagtcccaccaacagtataaaagttttcctatttctccacatcctctccagcacctattgtttcctgactttttaatgatcgccattctaactggtatgaaatggtatctcattgtggttttgatttgcatttctctgattgccagtgatgataagcattttttcatgtgtcttttggctgcataaatgtcttcttttgagaagtgtctgttcatatcctttgcccactttttgatggggtagtttgattttttcttgtaaatttgtttaagttctttgtagattctggatattagccctttgtcagatgggtagattgtaaaaattttctcccattctgtaggttgcctgttcactctgagggtagttccttttgttgtgcagaagctctttagtttaattaaatcccatttatctattttggcttttgttgccattgtttttggtgttttagtcatgaagtccttgcccatgccaatgtcctaaatggtattgcttaggttttcccctagggtttttatggttttaggtctaacatttaagtctttaatccatgttgaattaatttttgtataaggtatacggaagggatccagtttcagctttctacgtatggctagccagttttcccagcaccatttattaaatagggaatcctttccccatttcttgtttttgtcaggtttgtcagagatcagatggttgtagatgtgtggtgttatttctgagggctctgttctgttccattggtctatatctctgttttggtaccagtaccatgctgttttggttactgtagtcttgtagtatagtttgaagtcaggtagcgtgatgcctccagctttgttctttttgtttaggattgtcttggcaatgtgggttcttttttggttgcatatgaactttaaagtagttttttccaattctgtgaagaaagtcactggtagcttgatggggatggcattgaatctataaattaccttgggcaatatggacattttcaaaatattgattattcctatccacgagcatgggatgttcttccatttgtttgtgtcctcttttattttattgagcagtggtttgtagttctccttgaagaggtccttcacatcccttgtaagttggattcctaggtattttattgtctttgtagcaattgtgtatgggagttcactcatgatttggctgtttgtctgttattgatgtagaggaatgcttgtgatttttgcacattgattttgtattctaggactttgctgaagttgcttatcagcttagggagattttgggctgagatgatggggttttctaaatatacaatcatgtcatctgtaaacagggacaatttgacttccccttttcctaattgaatatcctttatttctttctcctgcctgactgccctggccagaacttccaacactatgttgaataggagtggtgagagagggcatccctgtcttgtgccagttttcaaagggagtgcttctggttttggcccattcagtatgatattggctgtgggtttgtcataaatagctcttattattttgagatatgtcccatcaatacctagtttattaagagtttttaggccgggtgcggtggctcaccacctgtaatcccagcacttttggaggccaaggcaggcatatcacgaggtcaggagatcgagaccatcctggctaacacagtgaaactctgtatctactaaaaatacaaaaaattagccaggcagggtggcgggcacctgtagtccctgctactctggaggctgaggcaggagaatggcatgaacccgggaggcggagcttgtagtgagccgagatcatgccactgcactccagcctgggtgacagcacgagactccgtctcaaaaaaaaaaaaagtttttagcgtgaagggctgttgaattttgtcaaaggccttttctgcatcttttgagataatcatctgttttttgtctttggttctgtttatatgatggattatgtttattgatttgcgtatgttgaactagccttgcatcccagggataaagccaacttgatcgtggtggataagctttttgatgtgctgctggatttggtttgccagtattttattgaggatctttgcatcaatgttcatcagggatattggtctaaaattctctttttttgttgtgtctctgccaggcattggtatcaggatgatgctggcctcataaaatgagttagggaggattccctctttttctgttgattggaatagtttcagaaggaatggtaccagttcctccttgtacctctggtagaattcagctgtgaatccatctggtcctggactttttttggttggtaagctattgattattgcctcaatttcagagccttttattggactattcagggattcaacttcttcctggtttagtcttcggagggtgtatgtgtcgaggaatttatccatttcttctagattttctagtttatttgcgtaaaagtgtttatagtattctctgatggtagtttgtatttctgtgggatctgtggtgatatcccctttatcattttttattgcatctatttgattcttctctctttttttctttattagtcttgctagtggtctaccaattttgttgatcttttcaaaaaaccagctcctggattcattgattttttgaagggttttttgtgtctctatctccttcatttctgctctgatcttagttatttcttgccttctgctggcttttgaatgtgtttgctcttgcttctctagttcttttaattgtgatgttagggtgtcaattttagatctttcctgtttactcttgtgggcatttagtgctataaatttccctctacacattgctttaaatgtgtcccagagattctggtatgttgtgtctttgttctcattggtttcaaagtacatctttatttctgccttcatttcgttatgtacctggtagtcattcaggacaaggttgttcagtttccatgtagttgagcagctttgagtgagtttcttaatcctgagttctagtttgattgcactgtggtctgggagacagtttgttataatttctgttctttaacatttgcagaggagtgctttgcttccaactatgtggtcaattatggaataagggtgatgtggtgctgagaagaatgtatattctgttgatttggggtggagagttctgtaggtgtctattagatctggttggtgcagagctgagttcaattcctggatatccttgttaactttctgtctcattgatctgtctaatgttgacagtggggtgttaaagtctcccattattattgtgtgggagtctaagtctctttgtaggtcactcaggacttgctttatgaatctggatgcttctgtattgggtgcatatatatttaggatagttagttcttcttgttgaattgatcccttcaccattatgtaatggccttctttgtctcttttgatctttgttggtttaaagtctgttttatcagagactaggattgcaacccctgcttttttttgttttccatttgcttggcagatcttccttcatctctttattttgagcctatgtgtttccctgcctgtgagatgggtttcctgaatacagcacactgatggttcttgactctttatccaatttaacagtctgtgtcttttaattgaaacatttagcccatttacatttatagttaatatggttatgtgtgaatttgagcctgtcattatgatgttagctggttattttgctcgttagttgatgcagtttcttcctagcctcgatggtctttaccatttggcatgtttttgcagtggctggtaccagttgttcctttccatgtttagtgcttccttcaggagctcttgtaaggcaggcctggtggtgacaaaatctctcagcatttgcttgtctgtaaaggattttatttctccttcacttatgaagcttagtttggctgaatatgaaattctgggttgaaaattcttttctttaagaatgttgaatattgtcccccactgtcttctggcttgtaaactttctgccgagagatccgctgttagtctgataggcttccctttgtgggtaactcgacctttctctctggctgcccttaacattttttcctttatttcaactttggtgaatctgacagttatgtgtcttggagttgctcttctcgaggagtatctttgtggcgttctctgtatttcctgaatttgaatgttggcctgccttgctaggttgggtaagttctcctgggtaatatcctgcagagtgttttccaacttggttccattctccttgtcactttcaggtacaccagtcaggtgtagatttgtttttttcacatagtcccatatttcttggaggctttgttcatttctttttactctttttttctctaaacttctcttcttgcttcatttcattcatttgatcttcaatcactgataccctttcttccacttgatttaatcagctgctgaagcttgtgcgtgcatcatgtagttctcttgccatggttttcagctccatcaggtcatttaaggtcttgtctatgctctttattctagttagccattcgtctaatctttcttcatggtttttagcttctttgcaatgggttcaaacatcgtcctttagctcggataagttcgttattactgatcatctgaagtcttcttctctcaacttgtcaaagtcattctctatccagctttgttctattgctggcgaggagctgcgatactttggaggagaagaggccctctgatttttagaatttttagcttttctgctctggtttctccccgtctttgtggttttatctacctttggtctttgatgatggtgacttacagatggggttttggtgtggatgtcctttctgtttgttagttttccttctaacagtcacgaccctctgttgcaggtctgttggagtttgctggaggtccactccagaccctgtttgcctgggtatcaccagtggaagctgcagaacagcaaatattgcagaatggcaaatgttgctgcctgatccttcctctggaagcttcatctcagaagggcacctggctgtatgaggtgtcggttggcccctcctgggaggtgtctcccaattagactactcaggtgtcagggacccacttgaggaggcagtctgtccattctcaggtcccaaactacatgctgggagaaccactactctcttcaaagctgtcagacagggacatttaagtctgcagaagtttctgctgccgtttgttcaactatgccctgcccccagtactggagtccaggaaggcaggcaggcctccttgagctttggtgggctccacccagttcagtcttcccggctgctttgtttacctactcaagcttcagcaatggcggatgcccctccctcagccttgctgacacttgcggcttgatctcagactgctgtgttagcagtgagtgaggctccgtgggtgtgggactctccgagccaggtgcgggatataatctcctggtgttccgtttgctaagaccattggaaaagcgcagtattagggtgggagggtcccgattttccaggtactatctgtcatggcttcccttggctaggaaagggaattccccaaccccttgcacttcccaggtgagcaatgccccacgctgctccttgggctgcacccactgtgtgacaagccccagtgagatgaacccggtacctctgttggaaatgcagaaatcacctgtcttctgcgtcgctcacgctgggagctgtagactggagctgttcctttttggccatcttggaacctcggttcaaacctgagttgtaatactcactcttcctgttgctgcctatgtaattttgtagaagttacctaattgcttccaagcttctgttggattttttgagaactgaatgacatagtacattttgaatgcttaatgtattgctttgtgcatggtattatttaataaatattagctttggttatacttgcaatgttctgttatttctctttttcacacatgttgcttgcaatctatatggcatctattttagcattaaagtagaaagttttaagtagaaaggttctgtcataaagaaaaaaagaatcttaagaagataaatctaagtggaaatttaaagaaaataaggcttttttagatctagcctgtaaactcctttagactcttgaatttgatattctggtagctcttccgagtattaggaaaaaaagtcctttaagctgctctaaagttgggtctggaagcaatactagaaaaagtagaaactggaaaaatttcacatctttagatcaatgatgtccaaagtgaagagtatactataaccaagtgggtgagagaacatattagaccacctacttacatatattttatctaaaaaattttaaagtacaggttgatagtagtgtatgtaggtagcctattaggtataaatatattgagatagtgactcagttttatttttaaaaaatagactattaaaccactgctctagagaatggctgtattaagccaaagttttagtataaacaaagtttagatatttgttgttcatatattttagataacacccagttctgtacatttatcagctctttgctttcctgtaatgtgccatttgtgataagggggaataggaacttttctctgaatccttttccatagaaggtgcttttaaagatgcctctttcagtccttgctaggtaagggaattagaaccattagaattgctttacaaaaattgaggaaaagattatttgtttagctatttgtttttagtaaattgcatcctttgcattaagataaagcagttggccgggcgcggtggctcacgcctgtaatcccagcactttgggaggccaaggcaggcggatcacgaggtcaggagatcgagaccatcctggctaacacggtgaaaccccgtctctactgaaaatacaaaaaattagccgggcgtggtggcgggcacctgtaatcccagctacttgggaggctgaggcaggagaatggcgtgaacccgggaggcggagcttgcagtgagcagagatcgcgccactgcactccagcctgggcgaaagagcgagactctgtctcaaaaaaaaaaaaaaaaaaaaaaaaaaagataaagcagttaaattaacacaaggccaatagggattttattaaatttcctttttaaaactgagttttgacatagagatttaaaattaaacagacctgtattcaaatcttcattcttgatcttgctagctgtgatgtttctttgtgtgtaaaaagttaggggtataattatagtagccttttcctgctaccacctggcatttagcagaccagttctcagtgaatgtgagcgttgattatttttaaggtggtagagagctgatgaaaagagcaagtaagcctgggtgcagtgactcacacctgtaatcctggtactttggaaggccgaggcaggaggatcacttgagcctacgagtttgagaccagcctaggcaatgtagcgagacctcatctctgcaaaaaaataaaaaattagctggatgtgatagtgtgtgcctgtatgcccaggtacttaggtggctgaggtgggaaaatcacctgagcacaggaagttgaggaagcagtgagctgtgattgtgctactgtacttcatcctaggcaacagagtgaaacactgtctaaaagaaaagaagaaaagaaatatatcttataccatagggcttaactttctttaaatgtgtgtaaattgaaagtaattctgtgttcttttagacatggggaatttatctgcaaagtttggatatggagtcattgtatttgtatttaaattgacgttagatgcatcagtttattacctattacatagtatttgaaaataatcatatttattttgtcttttagcaacagatgaaatttagtcttacaccgagacagactattcacctagttaaatatgaagggtctatgaaggtctccatgacaccctgtaaccagctgcaatttgacattagacttgatgttctgattacttatactttttgttttagttcctttcctgagcctgaattgtacaaatatgtcctaaaacaccaacttattaagaggcttaatgcctgttaaatgcgtcagtgctcttggcagcttagcatgagtgctttctttgcatgggaggttgcagtttagaagcaactttatggatcatttcccaggttgatgttacatatgttcattttacaacctgtgtgcataatctctcagggtgaaggtaattaagagaaagcataatctacagaattgaagccaagtaatctaagattctgtttttaaactctttgctatataacattagttaagttgtttaccctcttaatttatccatttgtaaaatgatagtttttgtttttaaagtgctctattacccttactttaaaagtcctgtctaccatatatttaaaactataagtggaaataatgaagaaactctgaacttgcttttgcttatatatggatatatcatattatatgcctaagattggagataaattttataacctgattttctcatggcagtgtacaaatgaaattattctgtaagtttttcaaaacagtaaaatcactatttttcatctttttgtgagatgtacttttttcatacccacagaaatttgcagagggcttctgcataccacccatcttccaatatttcagtatttggctaggttcccctcattttgcttaattattcattttggttggaaagtttaactgccactgaaacttcagattctatatccttaccactttcctgatttttaagtttaacattcagtaattatttgatgtttattttagctgcataggtttaagtaacactaaaagtatacctgaatctctaggtagcatatttacaagcttagttagaagtaccaaaaagggcttagaaaataatttaaaactacaatagtgatctaaagtttttaatgatttttcaattatgaaaatgttttactattgtgcttatcccatgaagatttaaaaatttagtggccgatacttgaaattgtataggtagataggatacagcatatgttattttcagtgtatctaaaaccatgaacttgggtcctgtgtgagtgcaaagtggatactgaaaactagtttaatttcctcagattcatctgataggttatatcctactcaaaaatgacaggaaagccaaaggctactatgttagccatttctgctgactcttattggtatcctgtaccctatacttcttaaacagattacattttttcagtatactagtagatctcaaaaggagatagaagaagcagggttatttctccagggtagagtattgttttgactatttcaattttttcttaatgtaaattatagaaagtaaactcaacaaaattttctttcagaggatgggaaagtggtggctgtaggtacttgaaagataacataagaaagcattaaagggggagactggattttaaacattggaatgcaatcctatttagatattgtaacatagcattcttgtaaagagaaaagccactgcaagtctctacaaagttggccaccattccaggctaaattttagaagtatgtagagatgaagtaaaaatctgagacttttagtaatagctcttgagatctcaagaaatggaacaagctgaagaagtaaaactattgaaaagccaagccaacttgttgctgaattccctaaaccaagaataatttcagaagcttaatttttttcctacaaatagtatagaagaattaacattaccattaaataggggttgagcactataccagtctgaaacccttgagattaaaactagctagaagacaagctgcagaagacaagacagtttataatcccttccttcagcctcacccaaggttttggaaataatcttatgacagctgagagtaagccaggtgcagtggcattccctgtagatccagctacttggggggctgaggtgggagcattgcttgagcccatgagttgaaggctgcagtgcactgtgatcatactgtaaatagctactacacttcagcttgggcatcatagtgaaaccccatctctaacaataataataacattttaaaataaattattaaaatttcacatttagaattatttttctactacagtaattggtacctcagtcacttaaaatggtaacactagttgagaattatacctccacaaatatatatctagataatccattatgttgtctctagcagatttttctgaggaaaaccaaaaggaggattggtaattaaaagtagttaatttttacattcaagaaaggaaaggactattctttgaacaaagtcccaagtcatgaataagtaatcaccagtaattagaaatcacttttgatcagtacacatgatgtgaaaatcagccaatcagtgacagcctcactccagtggccatgcttctgaaaatcatcgagtcaacaacagccttactccagtaactatcttctgcaaattagcaaatcaacgatagtcctaggcttctgaaagtcagccagcgactactcttgtatgttctgcatactgactcattatttgtcattaaaaattcaatggacaaaagaacaaagtatgtctgatgtggctgctttagaggccaggatctaaatggacccaagattcctagttagcatctgatagaacttttagatagaaagtcagcaaggatataaaagatctgagtaacacaaccaacctacagaatctaactggcatttataaaacccgctaccaagctgggcgcggtggctcacacctgtaatcccagcactttgggaggccaaggcaggtggatcacaaggtctggagattgaaatcatcctggctaacacggtgaaaccccgtctctgctaaatatatatatatatatatatatatatatatatatatatacacacacacatatacacacacacacatatatatatacacatatatatacacacatatatatacacatatatatacatgtatatatacatatatatatatacacatatatatatatatatatatatacatacacacacacacatatatatatacacacaaaaaattagcctggcatggtggcacacgcatgtagtcgcagctactcgggaggctgagggaggagaattgcttgaacctgggaggctgaggttgcagtgagctgagatcgcaccactgcactccagcctgggcgacagagcaagactccatctcaaaaaaacaaaagaaacaaaacaaaaaccactctacccaacaagagtagaatatgagtggaacatcaccaaggtagatcccatcctgggccattaaacaagcctcaacatatttaaaagaattgaaatcatatagagtatgttgtctgaccacagtagattcaaagtagaaatcagtaacagacaacaggggaaaaatgatccatgggtcaaagaggaagtctcaaaggaaatttaaaaatacatacaactgaatgaaaataatatatatcaaaatatgtgggaggtagttaaacctcccacatgtgtgctgacagggaagtgtacagcagtaagtgctcacttttgaaatgaggaaggttctcagatcaatagtgtaagtttctttctcaaggaactactaagtttctatgtaagagactagaaaaagaagagaaaataaacccgaagtaagcataaataaataaataatgaagacaaaaacagaaatcgaagaaattgaaaatacaaaaacaacagagaaaaaccatgaaacaaaagctatttttggaaaaaaaaattaataaaattggtaaacctttgacaagactgaaaaatctaagaagggaaggcctgaatcaccaatatcagaaatggaatagtggatatcagtacagatcctgcagccattaaaaagttaacaagaaaacactataaacaacttgatacccataatttagaagaaatgaatctcaattctttgaaaaccacagactaccaaaattcaaccaaggtgaaatagacaatctgaatagctatttaaccattgaagaaattaaaagctcctgaaaaagaaatcaccgtgtcaagatatttcttcttttttaaaaaagatattaatacatgtttaacaacattcattttatcctttccattttggcatggcacatgatcttcatctggatttatattttatgtgataaatgattttttaatttaagttcaagggtacaagtgcaagtttgttacgtaggtaaacttgtgtggtgggggtttttgtatagattatttcatcacccaggtattaagcctagtattcattagttgtctttcttgattatctccctccttccaccctccgcctccaccctccaaaaggccccagtatgttgtttccctctatgtgtccttgtgctctcatcatttagctcccacttataagtgagaacatgtggtatttggttttctgttcttgtgttagtttagtaaggataatggcctcctgctccatccatgtccctgcaaaggacataatctcattcttttttatgactgtatagtattccatggtgtatatgtacaccatggaaagaatgagataaaaaagaatgagatcctatacaccatgaaataccaatactctttatccagtctatcactgatgggcatttaggttcattccatgtgtttgcttttgtgaatagtgctgcagtgaacatatgcgtgcatgcgtctttataacagaatgatttatattcctccgggtatatactcagtaatgggtttgctgagtcaaatggtatttctgtctttaggtctttgaggattcaccacactatcttctacaatggtggaactaatttacactcccatcaacagtgtataagcgttcgtttgtctccataacctcaccagcatctgttattttttgactttttaataacagccattctgactggtgtgagatggtatctcattgtggtttcaatttgcatatctctaatgtaatgatcagtgatgtttagcttttttccatattatttttggccacatatatgtcttcttctgggaagtaactgttcatgttctttgcccactttttaatgaggttgtttttttcttataaatttgtttaagttctttatagatgctggatattagacgtttgtcagatgcatagtttgcacaaattttctcccattctataggttgtctatttaatctgctgatagtttgttttgccgggcagaagctctttagtttaattagatcccatttgttgatttttgcttttcttgcaattgtttttggcatctttgtcatgaaatatttacctgtgcctacaccgcaaatggtattgcctaggttatcttccagggtttttgcagttttacgttttgcatttaagtctttaatccatcttgagttgatttttgtatgtggtataaggaaggcatccagtatcaatcttgtgcatatggctagccagttatcccagccaagatatttcactagtgaattttaccacacattttaggagaaattaacttcaagttcacaaaatctcttccagaaaagagaagaggagggaacacttcctgactgattttatgaagctaatgttattactctaaaacagacagattgtacagaaaaataaaactatagaccattatttctcacaaatgtacatgtaaacattttcagtaagaatcataatgcagaaatcctcaacaagaatcatagaattagggtcaggcgcagtggctgatgcctgtaattccaacacttaggaaggcagaggcaggcagatttcttgagcccaggagtttgaaaccagcctgggcaatatggcgaaatcccatctctgcaaaaattagctggacgtggtggcacacacctgtagtcccagctccttggcagggctgaggtgatagaatttgggccggggaggtcgaatctgcagtgagctgagatcatgccacttgcactgcagccagggtgacagagtgagaccttgtctcaaaaaaataaagaagcatagaattagaaggaattacaatcaatattcctcctcttcaagattaataaagattgcaactttaatggcaacctcaattctgtgctgttttagttactcctcctatagtctgaaaatgaattgatttaaggcaaattcagtaggtttttacagtttcatttgtcatcagtgtttttcaaatataagtacttttgcaaattggaccaaattcttggtgcaatttaaaaacttgggccttctatcatttgcctattttgagaaaggctatttcccttttctttgattttctattttttagagtgttgaacctacttaatctgaagtttacctcccttttaaaggaagtgtctagaagtgtttctggcaatgtgttcataattaggttaaattttcctcttgataacctggtggctgtagaactgaaatcactgtgagttaaaataatcttagtgtgtctgtgtccccttggcatttgtaaatgagttccttgaaattttgtattggtatgttttaaaacatcagtacttttatttcaaagtaaaatatgccataatatgttttataggatgaagtgtttgttttttatttatacactataattacgtgttgtatcaccttctttgaaaagacatattttaaaataatatctcaattttaggcaaagcacattcctagaagtttaaaattaacattttctgtctaaattaaggagttaattttctgtgaaaataaaatgtttgtggggggtgagtcttatcacatatcacagatcatacttgttttaaaggaagaaaatgaaagtcatttttaaatttagttggtgacataagcagaaagcatgtttactttttgatacttaataacacttgaggtaataataaacaatgataatttcctaatcttttttgcattgttgtaattaagcttacacttggagtttccaaggccaacatgtaaggaattgctctttaattaggtttccaacagttagaataagcaaaaggatggctcatctgacattgcagtgtgtcctgatagagttcccttagttatggttaatgcagataaagaaaacagcaagcatactttcacaattttatattttctgtataaatgagaattcttatttttagagaagtatattgaaaagtaataacacaaattaaataaatggaatagactataaatttagggccatttaaaaaggattacatgtatgccaaggtacaaattatctttcatactcaatttcagctgttactcatcactgcttaacctactcttgagtaataacaacattctttaagctttaaaacattctctaatgtgtttttaatatagacagaatacccatcattagctttatggcaaaagcccttgcaatcatttatttcccttaatcacgtaagcatcaaaaatttattgatcacctggtctaattatatgtagtgttgtaagtatgtctcaggattcattcaacaaacatttgtcgagcatttattatgtaacaagaaaaatgtatgtcccccccccaaaaaaaatgtatgttccctttctttaatgtttactgtgaatagtgaagatatagatatacatagaaagactaataattcatggaaggaaattatcagtgttgactctcaatttggggaagagttttgaagagaaaaaagatcacttttggtttgcagtggatattgatagtctcaaaggtgatggaatctctgtgtaaagatgattttgataaaggaaggatttagggactacattatggtagagaaccgagagtgaaattataggaatgggaaagaatatgtctcctattctttttcaggagaagtgactatgtcagtttgtttggagtgcaaagttcatcacagtagatgaatgaatggttagaaaagaaaggtattagggactggatattgtaggactatgtttggatcatatagtgggaatgaaatataaaagctgagttcgtttgccttttttttttttttttttttttaagatggaatcttgctctgtcaccaaggctagagtgcagtggcgcgatcttggctcactgcaaccttcacctcctaggttcaagcgattctcctgcctcagcctcctgagtagctgggattaaaggtgcccgccactgtgcccggctaatttttgtatttttagtagaaatggggtttcaccatcttggccaggttgttctcgaactcctgacctcatgatctgcccactttggctccacaaagtgctgggattacaggcgtgagccaccactcctggcctcttttgactttgaaaaattatttcattacatatgttcattttagaaagattagaatatactgatgaagaaaaagtagaaaataataacacaaaatcaaagtttttagaaatgcttatttggtgttatccaggatggatgaaataaaaggatgactgaaggtgggaggccagttaggaggctgttttggtagtcttctttccctcttccccatcctgtactcttctcttttatcaaatggttgtactggtggcaaaagcttgaaatttgaggagtcagagccaaaagaaggatgcagcctgaatagtaactctgggatcaggttacacagttgaaataatagacattacacattacttttctttcctgggtcttgaggaagttctttagtgagggctcaagaaatttggaaatatttgtagatggatgaagtaagttcaactttggtgatggctttatgcagtttgataagtgcacatttctccgagtacaaacttatgggaacattattggtggtgagaaggaggaatctggagatttgtactaatgagttagtggcatttttgtagagggagattcacatctctgaattcttcaaccatcccaaaattgagcatgtcacggaatctttctggctaacagtaagctgtaggttgttacatcctttaatgccatatgtctgcaaaggatcttatctcatctatatatactcttgaatgacatgaactggcacatttatgactagtgcaaagggactaactcgcattcgcatgcaaatttctgtggctggaaaggtcagcccgactggcttgtgcagcaacctttgccattgcccttgtttgataatgctgtgaatttcccatgattttcctaagtgtagcttggaggttccactcaagatcaagcctgagattccccatgaactcttcaggactatggcaggtctaatatcttcaatttggacattatcaactgccttgctgatgccttgattgaggctgagtgataccagtgtgtatctgctggatacaaatatcacttctgtcattccgatggccatgtgtatctcttgcttaggtagcatttctggcctgaaccagtgataggctatataccaccagagtatcctccagaaattcttctccttacttctgtgaccctaccccatccccgtcattctacttctactactttggggaactgtggctccaccataaccttgatgtaagagcaggtgctagcaccccattgaatatttccacttagatcatatcagagactgtacctgaattatatcatcctgttgttctcatggccagatatgggggcagccagcccaagctaggatcccagtggtttctttagctttataccaagcttgaatgaactagagatgttgcccaagaattctaagcctctggagactaaactgcctgtctaaatccttataggaatacagactcattcttaggagttagagttttacatccttcaggatatacattggaaaagaacaattgctctgccaggagggctgctgctttttgattgagaaagatgatgcggccatggaaagcacatggaccacatcaacttggggtcagggttatcagagggcaggcagttccagtgctaccacctgagcactcttcttcagaagaaaaagaaagcactccagcttaatccttgtattttaactattcccaatttaaagagttacactgcagccttttgcagccgcttccttatcccctgaaggggaatgggataaggaaaacattctcctttccctgaagagtttcccttgaaaattgaagagagaaaaattttaagtcatcagataaaggcaagggcagttcatccgtattactctttgaggcacggatatatctcaattaaaatctgtgttaattttcccacagttcagttgtattgacctttttcattcaaaaggtccagcctggggctgcatgccagccaacttggtgctttctgtaaaagccatgatgttttctctcagcctaaggaaattctttgtgctgttttatagctttactgccagagtaagttataattgccattgaatcaatatatatagcttaataagtttgctgctttacccagtttaatcttgtctcattttcaaagtttgccaagagttaccctagagagacaaatattctttctgtgtcttctatcattctgttgaccttcatagttgatttggctgatctttctaaacaaaggaagaccaattaatggttaaaggtagaagtatctggacctctactccaaataaaagctttcaagttacatttggagatgatactcttgaatattttttaaccatactgtgtctcttaaacaaatgctgctgcttacccataacatgctaattaataccttatatatctcattcctgataatgaaaagttactagtaccatggtgttgggaggttcattcccgtgggcattatatgaggctagaagaaaacaaagacatgacaaatctatagacttatggttcaggcagatactttctttagtttttttctcagtcattatgaatcttgcattctagacaaatgtagatgtatttctctcagagtaaagaatggaagaaacctgaaggtagctctctgttgacagagaaagaaggaattacctatctggaaataatctgttcagtatagttttattgtcagagtaagttaaaatgaatgattctgccaaaatgtcaagaatgggtcacctaggcatcctttccagaaaaggggcatctagtcagtcatcctttccaagctatgcttttgttacttaagtattcactgaaatgtaaataccatgtgttttatcattttttatactctgaaagtatcattttactaatatgtttttgaaataggtactatattttctattgctcatattatcataagtcttagaactttatctattcaaggtaataaaaatttcaactttggtctgcccagactgtagaaaaccaagcattgacacacacataaaaatatgtatatacacatacagaacatttactttatcaaaaagaagagtgcatagggacttcagatcactgtattgtgaagggacttatccgcatctttgataatttaggatagagtatcttaaaataacctttttatgttctagacaccaaactgtgctggactggtaacatattaagaatatgcttaaaacattctctcaatggaaatattacctttttaaaatattttaaatttcaagacggtagaagtccattttcttgtactgttgagtgagattgaaaataagactagagaattgagtggaagaaataatttcatttgagccattccatttcacgtctttcctaaatggtcagttcttttggttctggttctattgaagtcctcatgatgagaaacagggttagtaaagccaaaagcatgacctgggaacaataatgggttattgattctgccagaagtccacctaccagtggccctggcactgtgagaatagagcaggcacatgtatccaaaaaagttcccttttggccgagtgtggtggctcacgcctgtaatctcagcactttgggaggcctaggagggcagatcatgaggtcaggagttcgagaccagcctggccaacatggtgaaaccctgtgtctactaaaaatagaaaaaattagccaggcgtgttggcacatgcctgtaatcccagctacttggggggctgaggcaggcaattgcttcagcccgggaggcagaggttgcagtgagctgagaccacgccactgcactctagcctgggcaacagggcgagactctgtctcagaaaaaaaaaaaaaaagtttccttttatgaaagctgtatttcagtattgacaattgcagttcccttttgggtttctgtgtcaagaagacttttttttctaccacgtttcctcatcctgcagactgcactaaactgtgtctccaccttcaccccctcagaatatacccaagtgtagtattcatggtagtcccatatatcagttcttttttcagtcacatcaaagttatgcaactggtgggtgccccatcctatgagttaagaatttaagaactgtgaatagaaaagaatattgcgactggtgggtgacacagtaaataagtaagctgagaataggggcaggggaatctactttgtaagtcgtgttaattgtgatgattctgggaggcagaattgctgctgatggagaaccactactttatttatttacttttttcagcttttattttagcttcaagggatacatgtgcagattgttacatgagtaaattgtgcaatgctgaggtgtaatgtacaaatggtctcatcacccaggtagtgaacatagtacccaataagtagttttttggccatcctccccttcgcaccctcccccttctagtagtccttagtgtctgttgttcccatctttatgcccatgtgtactcagtgtttagctcctgattataagtgagaacatgtggtatttggttttctgttcccgtgttaatttgcttaggataatggcctctagctgcatccatgttgcttcaaaaggacatgatttcagagaaccactgctttaaatcacataaattatttacggaaacatacttcttgtaatgcaattagtcttattttgccacagtggagttacttatgtgtgtaaataaaatttagagccagggtgaacaaacaaggccctgaggtcaaatctggcctgccttgtgttttgtaataaagtttgtctctgtttgcagatgacatgatcgtatatttagaaaaacccattgtctcagcccaaaatctccttaagctgataagcaacttcagcaaagtctcaggatacaaaatcaatgtgcaaaaatcacaagcattcctatgcaccaaaaacagagagccaaatcatgagtgaactcccattcacaattgctataaagagaataaaatacctaggaataaaacttacagggatgtgaaggacctcttcaaggagaactagaaaccactgctcaaggaaataagagaggacacaaacaaatggaaagacattccatgctcatggataggaagaatcagtatcgtgaaaatggccatactgcctaaagtaatttatagattcaatgttatccccatcaagctaccattgcctttcttcacagaattggaaaaaattactttaaacttcatatggaaccaaaaaagagcccacatagccaagacaatcctaagcaaagagaacaaagctggaggcatcatgctaccttacttcaaactatactacaaggctacagtaacgaaaacagcatggtactggtaccaaaacagatacatagaccaatggaacagaacagaggcctcagaaataacaccacacatctacaaacatctgatctttgacaaacctgacaaaagcaatgggggaaagattccgtatttaataaatggtgttgggaaaactggctagccataagcagaaaactgaaactgaaccccttccttacaccttatacaaaaattaactcatgatggattaaagacttaaacataagacctaaaaccataaaaatcctagaagaaaacctaggaaataacattcaggaaataggggtgggcaaagacttcatgtccaaaacactgaaagcaatggcaacaaaagccaaaattgacacatgggatctaattaaactaaagagcttctgcacagaaagagacagtatcatcagaaggaacaggaaatctacagaattggagaaaatttttgcaatctatccatctgacaaagggctaatatccagaatctacaaagaacttaaacagatttacaagaaacaaacaatcccatcaaaaagtgggcaaagcatatgaacagacacttctcaaaagaaagacatttatgcagccaacaaacatatgaaaaaaatgctcatcatcactggtcattagagaaatgcaaatcaaaaccacaatgagataacaatctcacaccatttagaatggcgatcattaaaaggtcaggaaacaacagatgctggagaggatgtagagaaacaggaaagcttttgcactgttggtgggggtataaattagttcaaccattgtggaagacagtgtggtgattcctcaaggatctagaactagaaataccatttgatccagcaatcccattactcagtatatacccaaaggattatcagtcattctgctataaagacacatgctcacgtatgtttattgcggcactattcgcaatagcaaagacttggaaccaacccaaatgtccatcagtgatagactggataaagaaatgtggcacgtatacaccacggaatactatttagccataaaaaaggatgagttcatgtcctttgcaagtacatggatgaaggtggaaaccatcattctcagcaaactaacacaagaacagaaaaccaaacaccgcatgttctcactcgtaagtgggagttgaacagtgagaacacagggacacagggaggagaacatcatacactgggatctgtgaggggctggggggctaggagagggataacattaggagaaatacctaatgtagatggtgggttgttgggtgcagcaaaccactatggcacgtgtatacctatgtaacaaaactgcacgttctgcacatgtactccagaacttaaagtataataaaaaaagaaataaaaatgaagtttgatattatcatttacatatcatctgtagttacttttgtgctacagagtcagagatgagtaattcctgtagacataagtactggccaccaagcttgaaatatttactatctggctctttaccacaaaagtttttcaacatattagagtgttttagagtttgacagtgcatcctttgctatgcactgagtcgtgagctgtagtgagtgcttaaacttaaaatttatgtttggttttatgtgaaagctttgatgaaaaaagatttcaatttgcacaagtatgttaattagatatgaaattaacagttattgcatatatttgtgctggctgccatatggatatacaatatagtacattaattaaaagagcagaaactttggagccagactgctttggttcaaatcctggctctacttttctgtcatctaaggcaagtcacttatcctttgtgtgccccagttctcttaaccataaaatgaggataatattaaaacttgcaaggactaaataaattagcgtatgcaaagcatgtagaaaatgttttccatgtaataaacactaattattactgtgataaccgaagggttccaaaatcaactcaatttttggcctctttaattcattacatagcaatgaagtacaaaggtgtgaatgtgtaatagttgttttcagagtaaaatgggggaaaatgatttcacttaatttgtttctttccctaatgctagcatctccagtggcacagaatataccttttctgttctggtccgcaaaattgtacagaaatgaatgaatggggggaaagctgttgaattggcatctacccaggctacacatttaactccagccagagattaaagtcacagaaaaaaatgttgttaccccaggtcttgccactagtagaaaacatgacctctaaaaaaaattatgcctttttcaaaatatttattactttcaatgccttccctgggatggttactccagctcctgcaaagctctgccttgtagtaataaggggtatccatcagagtttgtgtgccccagcaagtctcctcttcttgcttcttagaaatgcacattttagtataattttctatttatggtatatcattgttcccaaaacacaaagatgattataaatctttttaatctcatatcatatctaacagttatcgtttccttatttttctttttggaaaaccacaaacaagattggtaaatctcaagataaaatttttattcccatttttttcccctgagacatactggttctgttagatctgtcacatatattatgattgatcagcttgcaactaattattgaactcctttgtatgcagttaatatttaccatttaggatatcagctactctaccaggtgctttgcatgtgttgctttgtttaatcctcacagcaacccataagatacaactattattatcaccattttacagttgtgtatagtgaaacacagagaagacaagtaactttttcagctcacacatctggcaaagtaggctgccagggttaaacttgactgtgtctgattctgatattttcaatgactcttattctgcttcctgtactctttttcctacttgtttgaaacacctcagatcccctgggcagagtagatagatgtaattcagggactctggttggatttcaggcagcccaagtgccttggaaagcattttcctggcttagagatgtcaacttcagagatgtgaaatatatgtaaaattagaggagaaaaaaacttatttaatatttttagaattctctagatcctatggataggaaaattgttttaaaagtagtatacctgaataaggtgggccaccctgaacacataccaaggattagctgtcttctagttcccaaatacaatacaactcccccctgcccgaaaaaagttattttataatatcatgctatgtatcttcttgagtattgtgatcattttctcctagaatatcaaatatttgccataactttaataattctttttaaaaggacagagagcatttgttattgagtatgcaggcagtatgctttgaagatagaggtcacatttagtgagggattcgtggtttaatagattggaagaagggattattagatgggatgggtttggtggaatatgtgagttttctaaagtcattaggtgttttatgcatgagaacataaaagagctggggctggaatcaattttattctaatctaacagatgtcttctactcttaagacacctgtgtaatgaaacgtggctttccccatatctccctactttcactccacttaattaatatacgtggctgtacattgacatactatatcatctattcctaatagaggggttttgcttccttagattttaattatcaataacttcattgcagtattctctgctttcttggtttccagctaattgccccacttgttttttgtttgactagttactttcttcttcatttatgacccctgtctgtagcttatcttggcttctactttctcttatgttctcccctgaattcctttacgtatgttaatattaagctgattgtcataatatttataaggttttcactgtctggacttgacgcagtttggaattttcctagcacatctgaagttaaattttaaataccaaacaaagttgtgctggtttgtatagcttaaacaccagcattttaaataaatgcaaaatgcaataaatgttttcagacaggtaattgttgatttgttgtataacattgtattaataatttctcattcctgattaggttaaatttctttacaattcattccaaaaaatacaaagatatctcagtgatacttacagttggtgaatcctttacatttttttttttttttttttgagacaggttctggttctgttacccagtctggagtgcagtggcaataccttgctcactgcagccttgacctcccggcctcaagtgatattcccacctcagttcctcaagtagctgggaccacaggcacatacatgccaccacatccagctaatttttgtagaaattaggttttaccacgttgcccaggctaatactttactttttattgagtcttttttctgtggtgtcaagcttttggtaatttcattgttgttagctatttgtatcaccaatagaagttaagcagagagcaagagaagaaattccaatttgctgtttgtcagtaactggagaggaagtgaggggtgggagacggagaaagatctggctggagagctgtagtttcacctacaaagagtttttttgtttgtttgttttaatttcgttttttcttttaatttggggagcttgttggatgctatagggaggaaaggtggaggagaacttctggtggtaattgttattcaccctgctctgctttagtctctgatagaattagtgtcatggttgatgttttgtggcattttttaagactgcataatccagcaacttatgattccctgttaggcaaggaaccatagctttcagtgtatacttacagagtgactgagacagtatcacttcttctctttatgccttatattcttcatttataaaatggagattatagacttgtccttgaatacctattgaagtaattgcaaaaattccatatgtatttgagtctttgcgaggccttgaacgtagagtttaattaaacaagaccgtactaagagtcttttgtatttatgtgcaagagttttttcctgatggcactattgatcatgttgggaaagcaaggcctggttagtggatttattgtttaggtgttttacagttatgatagttttcatttgctattggccacaggtttgaaaagagtatgaaacaactatgtagaaaattttctagcatctcccagtcccagaaaagcttcatcagccttcaagagtctatgaagtatgactataatgtaatgtgcctgatattttttattgtggtaaaacataatatttatcattatactctgtgtatacatattgtatactgataagtgtataattacactgataagtgtataattcagtgacactaaatatgttaacagtgttgtataaccattaccactatctatatccaacactttatcattatccccaacaaaaactatgcccattaaacaataactcccacccttctacctctccccacagcccctggtaacctactctactttgtctttatgaatttgcctattctaagtacttcatataggtacaattatacattattttccttctatatctgccttatttcactaagcataatgttttccaggtccatccatgttgtggcatatgtcaaaatttaatttctttttatgactgaatattattctgttatatgtgtaggtcacatttgggttagccatttatctcatgccttatattttaatttataaaatggtttcataataaaaggctgtgatttaatatctaaataaaggataaaggaagagtatattttgttagaggggaaatgaattatggaagatgaatgagtagtaatatggcttagcagttttaaatgaggataattatggtctaagttataggggttgttttgaggattaaagagttagtatatgtgtcttaacaacaatgtagtattataacagtataagtgctatttggctgtttgctatcattgttattagttgatgagagcttcgtagtagagatcacaaatgaggcagaccttaatgcaactctgcaggatttgattagaaaaggaattttaaggtaaatgtagagagaaagcagatggcatgtttttacaataagaaagatgtcacactggttaaacacatagtttttgagaccaacagacctgtgctccagtctcagcattgccgtatatttactgtgtgacttggaatataatctttctaagctttaattgtaatctataatatgtggatatgtgttaattcattcttgcattgatataaaggaatacctgaaactgggtaatttataaagaaagtacgtttattttgtcacatgatccgggaggctgtacatgaagcatagcaccatcatctgcttctggtgaggaccccaggaagctttcagtcatggcagaaggtgaaggggagccagcgcatcacatgatgaaagagagcaagcagggtggagaggcaccacactctttcacacagccagatctgtgaacctagatgagtgagaaatcactgatcaccaaagggatggtgctaagccatttatgagggtctgccccccatgacccagtacctcccactaggccccaccccaacactggagattatattttaacatgagatttggagggaacaaacatataaaccgtatcaggataataatgataacatcaaagtattattatgaggattaaaatgagtaagacacttggcatgttacctggcaatgacaaaaaactttcaaacagtgatagcctctattaatttaatacttttggtggttaccattttttatcattgttagcattatccacattggctcatagtgggtgacacctttggaaaggtattagggaaataaagaaagaggagttgtaagtgattatggcatacctttaaaataggagtgtgcacttgaatttaggcagtgggatgccactaaagttttatttgagagaaagactgagtgtgtgtgtgtatttgtgtgtttgtgtaagtgtgtgtacatgtttgtgtattttggcaggaacattaataagaagaggggccttgctgaaagcagtgatttgtaaagatctgtttacactatgcagataatttgggatttggaaaagaatagataaacaaaagggaacaaaattgcttatacaatttttaacagttagaaggaaattagtaagagaaaaaaatctgaagaaaaatgtttacatgtgttgggtatttaattgtatgccaggcactttgctaacctctctatgttgattactaccatttcatgttcacagtaaccttataatggaagattctattattgtctccattttatagatgagaaatcaaggacataaagtggttacggtcacacagatagtgtggcagagacagctagtgtccccaaatcctttctcaccttttccccatactaacaacattttcatctgggcatgtgatgactccaagtgaaaaaccacatttcttaatctcctttgtagtgaagtatgactgtgttgtgcaccccacccagccctcaaaaaaagagttgtgaataattttggagaactttgagagttggcttgtaccatctgaccttcttcccttccttattctgccttcctcctgttacagacatgtgacagtcatagctcatcttagatcatgaaggccagggctgcacggtagaatggtagagcgtaaagcagggagggagctggatccctatggaacttggaaaacagagcatccacaccaatcctgtactgccaacctttgggcatttacattagaaagaaaaataagctgctctctggggtttcctcttactttttcacctgacacgaatccttactaacaaagatcagagggcactctcatccacagtgtatactctttaccttggctactctcagatgcccaacagtttttataaggaattgtaaagatctaactcttgtattgtatagctcagaaagccaaatttactgaagttaggcccatgtccagagatggattcaagaattcagtggtgtattttctcagctttcttgagtaaaaattaacgaagtagagaagtttgaaagctctgctgcttcttccttctgctagacaaggttgtttgcatttctttttactttgcataaatatctctaattttgagaaaagtaaccttagcagataaggaaagaagttgaagggtagtttgtttaattatcaagagcaatgatgtataaatggcttttgggaaaaaatgatatctaactttaagttaagaacctgtgtagttattatggaatgaagtgaattctgtaaaaccattgatataaggtaagtgtgcttttagatgctgcatgttattctatgatttttattttgagcaataacaaaaagatgttgaaattataccagttgaccagttgctgacaggcaatcctaaagtattggctggaactgataagaggttaccagcattacatattcatagatattctcaacttgaagtactttctaaagcaaacagttctgtcatcatcactatgcatagaggtataacggtgatgcagggtggttttcagatagactaggtttttattttgcctctatactggacaggttgagtgaccacagagctttatatcttagtgactagtggttaaagagattgcatttgcattatcctaagtgaattagcacaggaacagaaaacctaccactgtgtgttttcacttataagtcggagctaaacatttgatacacacgaacataaatatggcaacaatagacactggggactgctggagaggggaagaggggaggagagtaaagattgaaaatgaactgttaggtactatgcttactacctagaggatgggattaatcatacccccaatctcagcattgtgcaatatactcatgtaacaaacctacacatgtcccctctgaatctaaaataaaagttgaaattataaaaaataaataaaaagacaaaaaaactatagtgagatatcatctcatcccagttaaaatggcttttataaaaaagtcaggcaatacccaatgctagcaaggatgtggagaaaagagaacccttgtacactgttggtgtataaaattagtacaaccaccatggagaacagtttagagattcctcaaaaaactaaaaatttagttgccatatgatgcaccaattccactgctgggtatatacccaaaagaaaggaaatgagtatatggaagagatacctgcacttccatgtttgttgcaatactgtttacaatagctaagatttagaagcaacctaagtgtgcatgagcagatgaatggagaaagaaaatgttgtacatttccacaatggagtactagccagacataaaaagaaggagatccagtcatttgcaacaacatagatggaactggagatcattatgttaagtgaaacaagccagacacagaaagacaaacatcacaggttctcacttatttttgagatctaaaaatcaaaacaattgaactcatagagagagaatagaaggatagttaccagaggctgggaagggtagttttgggaggcagggttgcaggggaggagggatgggcaaaaaaaataattagaaagaatgagtaagacctagtatttgagagcaccacagacactatagtcaataataatttaattgtacactttaaaataactaaaatagtataattggattgtttgtaacagaaaggataaatgcttgagggggatggatacccagttttccatgatgtaattattactcattgcatgcctgtaccaaaacatctcaattaccccataaatatatacacctactgtgtacccacgaaattaaaaataaaaaaatttttaaaataaattatatttcataatcagtggtgtatgcatgcaatataaatgcttgttcctagaggatttcaagatcatatggtctttctaagtcacatactataccaaagctcttcagacaagagcttcttatacagtctgaatttgtgcagaatctcaaaagggcaataaaattttgaaataatgtgattaactccaaattcattacgaattatgtagtttccgtgctgggaaccaaatgaattataaagtatgtttacactgcttcaacacggtggctccattttagctgcaaacagaaattcttatcatttttttcaggattagtcccaaatactcaagtttaagttatcctaaatctttctttaggaacgcctcacaaataaaatataagaaattttgatattgtactcttggcaaagttttgctctgcttccctaatctaatgggacagtgacagcttacaatgaaacattttcaaaaacattccctgctaaatcaaactgaaatgcaggggatttacatggacatttgagatcgtttggtgtaatagagcatggactgtcaagtaagaagtttcacatggactacggagtaagaccagtccttctaccatcttggaacttgacctttttttgtaaaattggaaacataacagctcaccatcttgttgagaagactaaatgaagtaatgtgaaagttccttaaggaagaaatgttaaatgttattacgcttgacctgttttcttgttaacatcttatatcttgaaattttctttaaagcctctaaatgttgtttttgtttgtttgtttgttttgacggagtcttgctcagtcaccccaggctggagtgcagtggtacaatcttggctcactgcaacctctgcctttagggttcaagcaattctatctcagcctcctgagtagctaggactacaggcatgcaccaccacgcccagctaatttttgtatttttagtagagacggggtttcactgtattggccaggctggtctcgaactcctgacctcgtgatctgccctcctctgcctcccaaagtgctgagactgcaggcgtgagccaccctgcccagccaacgttgtgtttttaaatacgttaaagttacagcatatggttttaaaagcctttatttctccagtcaaatattagaaactcaagaaaaaggatgcactaagttgaaacttgctctactactttggcagccacacttaaggcagaaaagtaagttaaagatcttatacctttgagtttaaaaacaaacagtgatttttctcatttagcagccctgtgcagaatcatagcagaatcatctcatctctcttgggagaaatgttggcagttaattaagccaattccttcattttgtggttaagtgcactcagatccagggattaatcgactttgccaaagtcatttatctagttaactgtagaaaaggcagaacctcttgaattccaagctagtggctatttcacttagctagtatttttaaaatcattgactttagtgtgtatatatatgtatacactatttatgtgtgtatatttttaaaatcattggctttagtgtgtatatacactatatgtgtgtgtatatatgtgtgacatatatacacactatatatgtttatatgtatgtgtgtatatatgtgtgacatatatacacactatatatgtttatatgtatgtgtgtatatatatatataatttgtgtgtgtgtgtatatatataacttttaatgttattttccagtgtcaagagaccatttgaaattaaatctggcttcaaaaaatgttaccatcaaaagtcattaagtgttttctggttttgatatttgtattgcgattatataagagaaggtccttgctcttggtttacacagaaatattttgtgatttaaaaatattaatgattactgcccaccaatttttatgttaggtatttttcaaggcactgggatttttcttttgaaaatcttatccttgagagatttgatctattactatgttatggtatatttttgccttatagtgattatgatttttttctttctgcttctgaaatgtggtagatatgtgtagaaatcataagaaatggccattcttggtgtcaaacttgttttatcttcaattatcataataaactattgaatgcaaaaaaaaaaataaagttgctgagagtagtaagtgcttaacagaaatatttagaaaaaagtaaaaccaaacccagtaaagacctcattaatttaaactctattaaagaaggattgtgaacagtacttgaactgaaatttagttttggatccagaattctatttaattgcctatgcaaaataataatgtgaacaagattagaaagggaatgttttcaatagttaaaagaacaaaatgtctctgagcagccagccttcagtagttgagaatgctgattaacatacacataagaggcatgctaattacgggcagccttatcgggtcattacagcaggtcccccaggacctttctgttactgggtagaacttgaaagtaataaatttgcttttctttacaattattctataattagaaattccacagatttaagccattttctcatggaactgcccttattaaacaattgatttttagcaaatatccacacatttcctgatatataatacaaaatagatactgatatgtgtaaaagaaagatggtgaccctattagaaagcatcatcctttttagtttttccacactcattttgatgagaaactttaaaatcccttttagttttttttaatcgatttacgtctgaaggctcatatcgatcttgttctcaatgaaagtcaacatagtattcttaggtcttaggtctagtctttttattcttcgatgaaacagatagaaatttgtctctcctattgatgaaaagattgaagctttaaacagaagggagataccagtaccattttttcaaagaatatgcccatatttaaattgtacaagttttgtttttctgtgagtacaacaatcagatattaaaatggcatgtttttttaacttaaaaagagtattatgtagttattattatgcacgttgatgtggcactttttctcaactgttagagtattcttcttagatatcattaccaaacaactgattggccatttaattttggtcatatttcacttttcctaatacctaaatggcacaaacagacatgaaaatagtgtaaggctcagacttcattgtacctaagaaatcagtgaagcttttcatcaggtggaaggaagagtagactggattttctcttagatctgtctgcctttttctttgaaaagtttgtttgtttgtttgtttttgagacagagtctcactcttgttgcccagactggagtgcaatggcacaatctcggctcactgcaacctccgcctcccaggttcaagcgattctcctgcctcagccttccgagtagctgggattacaggcatgcgccaccacacctggctaattttgtatttttagtagacacggggtttctccatgttagtcaggctggtcgcgaactcccgacctcaggtgatccacccacctcggcctcccaaagtgctgggattacaggcatgagccatcatgcctggcctcttttaaaagtttttgtagttttttccagatgggataactttttacctggataatatatttggtaaaaaacataccattttccaaagtgtttatatcatttcggttgttgttttgacccttctaattatttagcagctctatccatggagactactgggggaagtcttgagttttgcctattcatggaaggcaggaagtaagccagaaggaacctcattccatccccagatttgtttatctgaaagacccatcatcagttgtgaaatgtggaaattttaagcaaggtcttgtatataaattttatagatgggaaaactgttgaaaaaagaaaatgcaactgagagatattactggtatttttgtcattgacaaccaaggataacaattgcattgctcccttgtttgtgatgtatagagacatctatacttaaaagacattttatttgagcaccaaagtaattataaatggtttattgtatttattgtgggatctggccagcagcccgcaatgcagcggggctctctttcttttcccaggcagatcggcaggtcgataaataatagacacacacaagatagtgaaagctgggtccaggagggtcaccgccttctggtcctgcaatgctgccaatgcactggatataccagcatttattattaagtttagtgagggcaggggtaggttagtgagggatttagggttgtttgattataaggtgagatggtcacgtggggatgaagtaattctttaacataacatctgtatgcagaagtacagtatacagagaaaagaatttacagtatagtgtgtgcatcagtaatttctaacagagccttaaaacagaaacacagtctttccgtaacctatgatcagcaagatattaatcagcagtaacagttgcagcaaaagctggttacaaacaatccatagaaacaggatgtgaggctagacaactggttagaccagaaatactcagaagggagtatgccttaaccctaaagaggcctagaagagccatggcaagatgagggcatttatagccctatcttatccacatgaacaggcgcccctcatgcgtccgtttataggctctccacaagggtcacattccctcatgcgtccgtttataggctctccacaagggtcacattccattcccagagctatgaacatctgcttttctgggataggaatcttggtgatgtgaaacctccctgactgcacatccattcataggctctctgcagggggaagcaaatcacacgctgttggctcattctggcagtccaacctggcattgtctttacacaatcctgcatgcaattttatatttacaataatcagaagcatttcatcttttattccatagcagtagtttcagggggtctccctacatatatttataactttttccctatttatttatgctgtttatgtttaagtatggttccctgagagctcacctgatatatcacactgctgaaactgagctagatctctaaagctttctccagatttaacatcctatgattcactgactgtgtaaattaattctaaccactgatgttgaaaatgtcttctcatggatctgtaaaggttatgcagaaaaatctagttgctaaataacggagctatcttcaggaatgaaaactggtaaagaatattattggctgggtgcagtggctcatgcctgtaatcccagtgttttaggaggctgaggtgggaggattgcctgatgcctggagttccagactagcttgggcaacataaccacatcttacataaaacaaaaaacaaaaaactagctgggcattgtggcatgcacctatagtcctagctactttagaagtctgaggtaaggaggaccccttaagcccaggagttagaggttacaatgagctatgatagctccatgatagcaccattacattccagcctgggtgacagagtgagaccctgtctgttagggggaaaaaatacacacacacacacacacacacacacacacacacacacacacacacacacacacattgagagtcagtgatatgtatagtcaatggaagaatttagtcaatataaatatatttatatatatatatagtcaatataaatatgtacatatagtcaatggaagaatttccatacatttttggtccctaagtgtacaacttcactgggttattaaaaatattaaaaaacacctataaagtgcttagaacagtacctggcaaccttgtaagtgctatgttaagtgtttactgttactgccaccaacaccactgaggatccagcagaggattctatgataagttgtctttgtcctaaaaatagtatatcctcttgcagtcattggaaataatatggccagtaatctaaaatatatagtttcctagtagctataggctattttgaagtcattctaaaaccaaccattaaacctgagcgtaatctgtttaacacatgaagaaagctgtttcataagactctgaaagagatttataaaatgaaaatgctgtggcatcaaatattaatattttgctagcagcaggtagcccaaatgttgatggctggtatgcatttgaaggcctacttaactgtgaattttattaggaccattcctcagagctggagttacaaatgggcttataaatgagaaattaaccacccctctagggaacagcagtttctttgaaatcttaattaaccaatcacactgatcttctcttttttcaattgccaacacttggataaatgttgaataaaacattgtctaattggaaatagcttaagtactgggaacaccattcttttatatgttgaaataagtatagtggtaaaatgaaataaattttaaaaagtagtgcatatgtgcctgtttgaatattttcatttgtccactatacttttaaaaaaattaaactgtaaaaaaattacattgtgaaactaggtttttttcttttttctttattgagacagtctcactctgacacccagggaggagtgcagtggtgtgatcaggactcattgcagccttgacctcccaggctcaagcagtcctcctgcctcagcttcctgagtagctgggacaacaggtgcacagtactatgccctgctaattttttgatttttttatagagaggagatctcactattttgccctggctggtttcaaaagcaattttcccaccttggcctctcaaagtgctgggattacaggtgtgagttaccaagcctaggcagaagttgttttttttttaattggaaaataagcataagaaacataggatgtttcatgttcagaaagaccattacttacaatatgactttgtagtatcactttattttcttccacacagaacattacaagtagaggcaacacatttgtgaagaggttaattttaacaaaatataaataaactgatccactgtaaagtgttacctagaaaagatagtttatgtagtggaatggaaatacatatataggtgaaaatttaatgacctttctaattgaattttttgaagaaataaacattgtattttctaagataaattcttctatgttatattattactttattaaaatggatactgcagtcaatatgattttcttaaatttataagaacatagagaagatagttttgtgaacagttaggtctcccttaggcttattatttctttgaaattgttttatttgtgctgtatagttttcatacatatgagactttccaataatagctattgaatggaaaaaatacatatagaacacagtcatttaagtcgctcaaatttctagaaataaaatatggagacctgctttcccaaatatatttgctatgtcctttttcagatttagcaaacattatgccttctatatgccatacacatttgcatagttatatttaatgttgagtacaatgttgtaaactggagatatgtgtttcaagcagaaggaataacatgtaggtacaaagggatttgattataatgagcatggcacgttggatagggtcagagagtttttaatgctaatcagtgggaagggagttggagaccagatgactagtaggctaaaatgatgggttagggcagttcctgttggacattgaatggcaaaggggagtccacaagagtttatattttattcttttgtctgagggtccttgaatgggctttagtccattgtgaatctctttaaattacgtatgtgtatgtgtgttagtatgcatatgcacttgtacgtccgcatccactgaacacacgtgctgtggaaagggtttgtagttttcattagattctgtaattccacaaagttaagaatcactgcagtagatatgacacatcctattagagattctaattatgtgatgatggagtaagaattgttggttgtttgctttttaagaaagatcattttggcagcaagaccacaggtcactatctcacatcatatacaaaaatgaactttaagagctaagactgtgatgctcttcgaagaacacaaaggggtaaatcttcatgactttggatttgttttgttttgttttgagatggaatctcactctgttgcccaagctggagtgcaaggcactatctcagctcactgcaatctctgcctcccaggttcaagcaattctcctgcctcagtctcctgagtagctgggattacagtgtgtgccaccacgcccaactaatttttctatttttggtagagacagggtttcaccatgttggccaggctggtcttgaactcctgacctcaggtgatctgccttgcctcggcctcccaaagtgctgggattacaggcatgagacaccgtggccagccatgactttgtatttaatagtggtttattatatatgaaaccaaaagtacaagcagcaaaatataaaacataaactggacttccttaaaacttaagacttgttgtattaaacgacatcatcaggaaaatgaaaaggcaatctagagaagaggaaatttgcaaatcatatctctgataaagattgagtattcagccatttgacccagcaatcccattactgggtatatgcccaaaggattataaatcgtgctgttataaagacacatgcacacatatgtttattgcggcactattcacaatagcaaagacttggaagcaacccagatgtccaacaatgatagactggattaagaaaatgtggcacatatacaccatggaatactatgcagccataaaaaatgataagttcatgtccttcttagggacatggattaagctggaaaccatcattctcagcaaactatcacaaggacaaaatctaaacactgcatgttctcactcataggtgggaatcgaacaatgagaacacatggacacaggaaggggaacatcacacaccggggcctgctgtggggtgggaggaggggggagggatagcattaggagatatacctgatgttaagtgacgagttaatgggtgcagcgcaccaacatggcacatgtatacatatgtaactaacctgcatgttgtgcacatataccctaaaacttaaagtatagtaaaaaaaaagattgagtattcggaatatatcaataatttttataactcaataaaaatgtaacccaactgaaaaattagaatcaatatttctccaaagagaatatttctccaaagaagacatacaaatggccagctagcacatgaaaagatgcttaacaccattagtcatcagggaaattcaaatgaaaaccacgatgagataccacttcacacccactaatatggctgtaatcaaaaagtcgagtgttggcaaggatgtagagaaattgggacccttatacactgctggttggaatgtcaaaatgctgtagctgccttggaaaacagctgacacttcctcaaaagattagatatatagttaccatatgacccagcaattctatttataggtaaatagccaagagaattgaaagcaaagcaacacaaaaacttctacacaaatctatttagcaacattgttcataatagccaaaaaagtggaaacaaccaaaatgttcataaagtgctgaagaaataactcatccattcatagcacatccaaaacgttatagtcatatgaggaatattactgagcagtaaaaaggaatgaagcattgatgtatgctacaacgtggatgtaccttggaaagatgctaagcgaatgaaatgagtcacaaacactacattttatatgattctgcatatatgagatgttgagaataggcaaatttatttgagatactgaaagtagaggctaccaatggcctctgctttcagtaggagaatcagaattattggagggtgatgacaaaaagatacgatgtttattttggaggtatgaaaatgttttaaacctcgacttgtgacaaatatacaactctgaatatgccaaaagtcatggaattgtacgctttaaacgggtaaattttttcgtatgtgaattttatcttaataaatttattttttaaacaaaaagattatttataatatttctgggagacaaagctcaggtcctgaaataaggtaggagcaatagaagtggagcaatgatgatggatttgagggtcaataataagaaacaacaggtaaaatgttttaaattgctttgacactaaaaggaaggagaatgcatatatggtaattcctagatttctggctagcagggctagatagagaatggtgccattaccacagtggggtaggaatatggaaaggaaagaatggtttggggaaaagatgatgagttattgttttaagtaggctgactttgacttagctgtcggacaaccaggtggaggtgctcagtaggcaatttaacatgtaggtcccagactaggtgaggtagctcacacctgtattcctagccctttgggaggccaaggcaggtggattgtttgagcccaggagtttgataccagtctgggcaacatggcaaaaaacccatctgtacaaaaaaatacaaaatattagctgagtgtggtggcacgctgcactccagcctgggcaacagagtaagacttagaaaaataaaaataaaaaatgtagatctgaagcctagagacatgctttgaaaaaaaatcattagtgaacatcttgaagttgaggctttgtgtatgaaaagctgcaaagagatgagatgaaaatcaggcaagaggtattctggagcccatgaaggaagaggttcaagaagaatggagtggaacctggcagtggtgcgtgcctgtagtcccagctactgaggaggctgaggcgagagaaattacttgagccctggagtttgaggctagtctgggcaacacagcaagaccccatctctttaaaaagagagagagatggagggaatgtttagctttgtcagtcgctgtccacttcatacaatatgagtactgaaaaatatcctttgtgcgtggcaattcagaggtaaccttaatgagcagtttcagtggagtgttgagggtataatctagaagggttcaaaggaggatttctttaaagataggatattgttaggtttataaaagacaaacttgttttccctaatccttttatgccttactactaggactttttcctttaatccaagcatttccaaaccatggtgcttcattgtttagaaatcacatgtgctttaataattcaggttggtttttcttttcttaaccaaaaatagcaatgcaaactatggcgtatgtattatacactttattagggatttcaaattatgtaaatctctaaattaacacacaaaaaggatttatatcagattctatttatgaagtcagaaaaattcctttttccagagccttaactcttatatttcccaagtgcttttatgaagaaacagtcattaaggaaaaaatgactgttttattcagtgaagatttcatgtcatctagttagcaaactatactttgtcttagagtcatttgaaggtagttggacttaacacagacatattgaccaaaattacgatcattatatccttattctatgtccatatgtcagagcccatcttttacagatctctcatgattgccctaaaaattccatttcaagggagtcaaaggctctcttctttcctgcccatctgcatctcctaggaagtgagttttggggctccttgaaattctagtgtgttctaagatagtggtgatcaaactttttttaccctccccatacatatatgtatgtttgcctgtgagtcagatgcaaaagttttcagtaattattctatgagatgctatggtattcactatctcttttttccttttcattctgttatgagctaacatgctgagtagtaggtcataatcatgattcaccaatggagactaaaagttcccatagctcatagaggagtcccaggaatggccatgtatttgctaaaccctaatttgttcaccgtgaattcatcttagaagttttaggtgtgatctggcttcctggtaacatcagaatgctctaggagttgcccagtttccagatactagacttattgcccttgtgctgtagagaaagagcaaaagaattttaggcttaataataccttactatgtttactatgtgtcaggtgctatgattggtatagataatatctaatcttaaaacaattttgaaaattagaattagcatcacaattgtggtgggttagtaggggaaatgaagaaaacaaagcttggcgacattgagtaacttgtctaagagtatacagtgtgtaggtggctttaaaacccgagtttttttcacttccataagctttctgaaacaggcattccattatgaagggtcagcctcagtgcttgtccctattgtgcctaaagaagattgagaaacatggggtggggcggggaagtcccaaaatcatcttggatagcctaagcctttatgcattctcactgcttaaatggagaactctggcaatgtcaacataatcagatcactgccatctcaatacaggattaaataaaattgctctcatattttttggcagtctgtgggtaaaaattatctctgagatctgtacaatcatatgtggagttcatttaagccaaagtctataaagaatgtttaagaccatgcccctgtttgtgctttttactggtgtttctctattagcctggagtgataggatcagtccttgttaattataactgatagggaaacatggctaagaaatatcattcttgggtcaggcacagtgtctcatgcctgcaatcctggtgctttgggaggccaaggcaggaggattgcttgacttcaggagtttaagactagcctgggcaacatagcaagactccatctcaacagtgacatttaaaaattagctaggtgacagagtgagcttctgtgtcaaaaaatatatatatcattcttggtgatgggcttggccactttgtaagaaaccttggtatctcagatgatagatagaagaagcaaaaccgtgagcatttttctctgtaatgtttagttgtgaggccaataaacttaacactcttggaggcaggttttaagaacttcttttctatcattttcttcttccctgtttttactcccctactcaaaagatgtatgtgtatgtgtttttttttttaatccctcctacagagagaaaagcttgtggcaaagggagctaaggtataggatgtagcttctccgttaaaatctagtcctgccctgtccaatgtaataaccactagccacatgtattatcaagcacttaaaatgtgaaaagtcagaattgacaagtgttgtaagtataaaatatttcatactatatttgaaagacttagtattaaaaagagaatgtaaaatattaatagtttttaatatagattacatgttaagataatatttcacattcattgaattaaatgtcattaaaatttctcctgttgctttttactttttaaaatgtggctacagtaaaattttaaattatatatttgtcttgcatttgtggttgtattgtatttctttttgacagtattgattctagggcaatactgcagctactctacccagccatgctttggaatacagctcattatctaattttaggaccccccacccaaagagggctaaattttgcccagccttttcttcctgtccacctgctacctcagcttgaaagagtatatagtgctttactggacaggtaaggcacataaaaataaatcaagttttccccaattggaagtgagaacagatggtcttggatggggtgggacaccagactggtagggcccagatccagtagatttgctgaggatattctgtaaagcaacttgaagaaagtataggaaagttcacatttttcccattatgagtacttcagtggttttgtttttgtttgaaatatcaaattcttccaagacagttttgctccttttcagggcactgtttccctgatgcgctaagcatgtgcttagtctgtgtgatatacttccaaagaccaagcccttgataagtccaccctggagtggtggcatggcaagttgtcaatacctgagccttgggagctatactccttcagtggttggttgactgattgcaggcaaaaagatagaagttgccaatgaaaattgtttcaaaggaagtagtgtatcatgtgtgcatgtctatgtgtgtgtatttattaaagaagattctgcttaaattatttctactttaaaattctctattttaaccattgtggaagacagtgtggtgattccttgaagatttagaaatggaaattccatttaacccagcaatcccattactggatgtatacccaaaggaatataaatcattctattaaaaagatacatgcatgcgtatgttcattgcagcactattcacaataacaaagacatggaatcaatccaaatgcccatcaatgatagactgggtaaagaaaatgtgatacatatacaccattgaatactatgcagccataaaaaggaatgagatcatgtcctttgcagggacatggatgaagctggaagccattatcctcagcaaactaacgcaggaacagaaaaccaaacacctcgtgaacagaaaaccaaacacctcgtgttgtaagtaggagctgaacaatgagaacacatggacacagggagggcaacaatacacactgggacctgtcaggggagggtgggtaggggagagcattagggaaaagagctaacacatgctgagcttaatacctaggtgatgggttgttaagtgcagcaaaccaccatgacacacgtttacctatgtaacaaacctgcacatcctgcacatgtaccccagaacttaagaaaaaaaaatgaaattatttttaaaaattctccgtatgtatatatgtatgtatgtatgtattatttattgagatagagttttactctcattgcccaggctggagtgcaatggcacgatcttggctcactgcaacctccacctcccgagttcaagcaattctcctgcctcagcctcccaagtagctggtattataggcatgcacaccacacccagctaattttgtatttttagtacagacagggtttcaccgtgttggtcagtctgatctcgaactcttggcctcaggtgatccatctgctttggccccccaaagtgctgggattacaggtgtgagccactgtgcctggccaaatgatctgttttaaaaagtacaatatgagtgtgatgttccccttcctgtgtccatgtgttctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatggtcctttgggtatatacccagtaatgggatggctgggtcaaactgttgtggggtggggggaggggggagggatagcattgggagatatacttaatgttagatgacgagttagtgggtgcagtgcaccagcatggcacatgtatacatatgtaactaacctgcacattgtgcacatgtaccctaaaacttaaagtataataataataaataaaataaaataaaataaaataaaatataaaagtacaatatgagaagaaaaatcacgtcttccaattaaataatatacagttaatcaaagagagagcaagaatttgttcaactgtgtaccattataatcagacactataaagggattccaaaagtttgtgggaaaatgcaattaaaagaataaaataatgtgaacttttcttcccaacataagctccatcagggtcaagacactttccaaataaaaagtaatgagtacatagtaggtatatatatttatggggtacttgagatattttgatacaggcatgcaatgcatgacaataacatcaggggaaatgaggtattcaccatctcaagcatttatttctttgtgttataaacattccaattatactctttagatttatttatttatttattattttttgaaacagagtgtcactttgtcacccagactggagtgcagtggcacaatctcgactcactgcaacctccgcctcctgtgttcaagtgattcttctgcctcagcctcccgagtagttgggactacaggcgtgcacaaccaggcttggctaagttttttgtatttttagtagggacagatttttgcaatgttggcccggctggtctcgaacttctgacctcaagtgatccacccgcctcggcttccaaaagtgctgggattacaggcatgagccaccatgcctggcctatttatttatttatttagagacagtcttgctctgtcacccaggctggaatgtagtggcatgatcttggctcactgcagcctccgcctctggggttcaagtaattctcctgcctcagcctcctgagtagccaagattacaggcatgcaccaccatgcctggctaaattttgtatttttagtagagatgggggtttcatcatgttggccaggctagtctcgaactcctgacctcaggtgatccgcttggctcagcctctcaaaatgttaggattataggcatgagccaccacgcctggcccggcctagttatttttaaatgtacaataaattattgttgactgtagtcactttgttttcctgtcaaataatagatcttattcattctatctaactatatttttgtacccattaaacatctccactttgcccccactactcccgctacccttctcaacctatggtaactatcattatattctccatctccatgaattaattgttttgtttttttagctcccacaaatgagtgagaagattgtctttttctgcctgttttatttcatttaacataatgtcttttagttctatctatgttgttgcaaatgacagaatctcattcttttttatggctgaatagtactccattgtgtacatgtaccacattttctttatccattcatctgttgatgaacacttaggttgcctccaaatcttggctattgcaaatagtaccacagtaaacataggagtgcagatatctcttcaacatagtgacctccattcttttgtgaatatacctagcagtgggattgctggatcatatggtggttctgtttttaattttttgcagaacttctatactgttcttcatagtggttgcactaatttacattcccactaacagtgtacaagagttcccttttctccacatccttgtcagcatttgttattgcctattttttggataaaagccattaaaacttgggtgagatgatatctcattgtagttttaatttccatttctccagtgattgatgatgttgagcacttttttatatacctgtttgatacttgtatttcttcttttgagaaatgtttattcaaatcttttgcccatttttaaattggattattagattttttttctattgagttgttggagctccttatatattccggttgttcatcatttgtcagatgaagtttgcaaatgttgtcttccattttgtagattatctcttcacttcgttgatcatttcctttgctgtgaagaagctttttaacttgttaacttgatatgatctcatttgtccattttttctttggttgcttgtgctcgtggggtattactgaagaaatttttgcccagcttgatgtctttgagagtttccttaatgttttcttgtgttagtttcatagtttgaggacttagatttaagcctttagtccacttttacttgatttttatatatgtcgagagaaaggggtctagtttcattcttctgcatatggattattcagtcttcccagcaccatttattgaagagactctcctttcaacaatgtatgttcttggcatgttgtcaaaaatgagttcaatgtagatgtatggatttacttctggattctttattctgttccattggtctatgtgtttctttttatgccagtcccgtgctgttttggttgcagtagctctgtagtataatttgaagtcaggtaatgtgagttctccagttttgttctttttgtttaggatggcttaggctattccaggtctttcatgggttccatcaaaatttacgattatttatttatatttctgtgaagaatgagattgatactttgattcggattacactgaatctgcacattgctttggacattttaacaatattgattcttctaatccatgaacatggaatatctttccattttttgtgacctcttcagtttcttttttttttttttttttttttttttttgtgagccaaataaacttcttttatttataaattaccatgtctcaggtgttcctttacagcaatttaaaatggactaatacacaaagttaatgctctaacaacttttggttaaataaatgaatatgagactgtaaagttattttttaatacctcctttgttttagatgctgtattgtttttttttctttttttttttatttattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgctattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctcatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcatctttctacatatggctagccagttatcccagcaccatttattaaatagggaatcctttccccattgcttgtttttctcaggtttgtcaaagatcagatagttgtagatatgtggcattatttctgagggctctgttctgttccattgatctatatctctcttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttgactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttgggttgtgtctctgcccggctttggtatcagaatgatgctggcctcataaaatgagttagggaggattccctctttttctattgattggaatagtttcagaatgaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatctgtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtgatgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgtctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttgaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgcgatgtgaggtgtcagtgtgcccctgctgggggctgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccctgctgctttgtttacctaagcaagccttggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcacacacactggcctgcgcccactgtctggcactccctagtgagatgaacccggtacctcagatggaaatgcagaaatcacccgtcttctgcgtggctcacgctgggagctgtagaccggagctgttcctattcggccatcttggttcctccctcctcttcagtttctttcatcagtgttttgtagttcttattgtacagatctttcacttctttggttaagttattcctagataatttatttgtagctgttgcaaattggattcttaaattttaaatttctttttcagattgttcattgttggcatatttaaatgctattgattttcatatattgattttatatcctgtaattttatgtaatttacttctcagttctaataatttcttgattaagtctttaggtttttctaaatataagattatatcatctgcaaagaaggataatttgacttcttccatttcagtttggatgacctttatttctttatcttatctgattcctttagctaggatttccaggactatgttgaataacggtggtgaaagtgggcatctttgtcttgttccagatcttggaggaaagattttcaggttttacgcatatgtagatgtggttcttttctatatggcttttattgtgtgttgaagtatgtttcttctctatccagtttttttaggtttttttaaatttaatcatgaagagatggtgaattttattgaatggtttttttgtatcaattgaaatgatcatatggtctacgtccttcattctttttatatgatgtttatattgattgatttgcatatgttgaaccatccttacatcctggggataaatctcagttgatcatgatgaatgatgtttttaatgtgttgttgaatttggtttgctagtattttgttgaggattttttgtatcaatgttcgtcagaaatgttggcctggaattttctttttttgatgtgtctttgtctggttttgttatcagggtaatactgccctcatagaatgagtttggaagtattcactcctccattattttttggaatagtttgaataggattgatattagttcttcaaatgttttgtaaaattctgcagtgaagccatcattttctgggacttttcttgataggagactttttattacatctcagtctcattacttgttaagggtctattcgagtttttaattttttcctggttcaatcttggtaggttatatgtgtctaggaatttgtccatttcttctaggttttctgatttattggcatatggttgttgatagtagcttctaatgatctttgaatttctgtggaatcagttgtaatttttttttaatctctgattttatttatttgtcttctctctttttttcttaatcttcctacaggtttgttgattttgttttcaaaaaacttttcgaacttttcgaaaaatttttcaaaaaactaaccttttgttaatcttgtgtattgttctttttctctttccaatttcatttatttctgctttcatcttagttatttctttgttctacattttaatgtaggcacttactggtataaactttgctctcagtattgctttcactgtattccagagatattggtgtgttgggtttccattttaatttgttttaaggaatttttgaatttccttcttaatttcttcattgactcactggtcattcagcagcatagtgtttaatttctatgtgtttgtatagtttccaacattcctcttgttgttgatttctagttttattccattgtggtctgagaagataattgatatgatttcaggttttaaaaacattttaggccaggtgtggtggctcacggctgtaatcccagaactttgagaggccgatgggggcagatcacgaggtcaggagatcaaggctatcctggccaacatgggaaaaccccatctctactaaaatacaaaaattagctgggcatgttggtgcatgcctgtagtcccagctacttgggaggctgaggcaggggaatcccttgaacccgggaggcggaggttgcagtgagccgagatcgcatcactgcactccagcctggcagcagagtgagactctgtctcaaaaaaaaaaaaaaaaaaaaatggtctgtctttgagatctatgcactgaggagaagcatatgtattctgcagctgctggatgaaatatctattaggtccatttggtttatagtgctaagtccaatttttttgttgatttttcagtctggatgatctgtccagtgctgaaagtggtatgttgaagtctccaactattactgtattggggtctatctctttcttagctataataatatttgctttatatatctgggtgcttcagtgttgatgcatataaatttataactatttatccttttgtcgaattgacccctttatcattatataatgaccttttggtctcttttcatagtttttaatattgaattctattttatctgatataagtgtagctactcctttttttggttttcatttgcatggaatatcttttcccattcctttatttttagtctatgtgtgtctttattgatgaaatatttcttgtagccaaaagatcattgggtcttttttttatttttttaatccattcagccactccatttcttttgattggagactttagttcacttacattcaatattgttattgataaactaaggacctactcctgctattttgctgtttgttttctggttgccttatgatctttctccctccctccctccctttctctctccttcccttccttccttttcccgttctgttgtttttgtgaaggttctcctctctgatggtgttttaatttcttgccatttttgtgtgtttgtatctgttgtaggtatttcagggttaccacaaggcttgcaaataacattttgtaaccaatcatttaaaactaatgacaacttaacactgcttgtaaaaccaaacgaaaaagcagaaggaaaactaataaaaattcacacttttattcatctctcccactttttaacttcttgttgtttctatttaaatcttattacactatctcttaaaacactgttgtagttatttttgatagttttatcttttgatctttatatggaagatataagtagtttacagaccactgttacagtgttatcatattctgtatttgtctatgtacttcctattagcagtgagttttggacctccagatgatttctttttgcccattaacatcattccctttctgattgaagtacatcatttagcttttcttgtaggataggtcagcaattaatgaaatccctcagtttttgtttgtctgggaaagtctttatttcttctgcatatttgaagtatattttcactggataaaagtttttttttccttcagcacttaaaatatgtcatgccactctcctgttttgtagggtttccactgagaagtctgcagccaaacttagtggagctccattgtatgttatttgtttcttttcttttgttgcttttaggattgtttctttatctttgacctttgggagtttgattattgaatgccctgaggtagtcttctttgggttaaatctgcttggtgttttataaccttcttgtacttgaatattgatatctttctctaggtttggaatgttttctgttattatctctttgaataatgctgtctaccctggtctacctctcactacctcctctttaaggccccatgtattagtctgttttcatgctgctgataaagacatacccaagactgggaagaaaaagaggtttaattggacttacagttcgacatggctgaggaggcctcagaatcatggtgggagacgaaaggcacttcttatatggcagcagcaagagaaaatgagaaagaagcaaaagcagaaacccctgataaacccagcagatcttgtgagacttattcactatacaagaatagcacgggaaagaccatcccccatgattcaatcacctccacctgggtccctcccacaataacgtgggaattctgggagatacaattcaagttgagatttgaatggggagacagccaaaccatatctttctgcccctggcccttccaaatttcatgtcctcacatttcagtaccaatcatgccttcccaacagtcccgcaaagtcttaacttatttcatcattaacccaaaagtccacagtccaaagtctcatctgagacaaggcaagtgccttccacctatgagtctgtaaaatcaaaagcaagctagttacttcctagatacaatggggtacaggtattaggtaaatacatcctttccaaatgggagaaattggccaaaaaaaaggagttacagggcccatgcaagtccaaaatccagtgaggcagtcaaattttaaggctccaaaatgatctcctttgactccacgtctcttatccaggtcacactgatgcaagaggtgggttcccatcatcttgggtagctccacccctgtggctttgcagagtacagcctcccttctggctgccttcacaggctggtgtttagtgtctgcagcttttccaggcacatggtgcaaactgtccgtggatctaccattctggggtctggagtatggtggccctattctcacaactccactaggcagtccccctgtgggcactgcctgtgttgggactttgactccacatttcccttccgcactgccctatcagaggttccccatgagggccccaccctgaagcaaacttttgtctgggcatccaggcatttccatacatcttctgaaatctaggtggaggttcccaaacctcaattcttgactttggtgcacccgcaggctcaacaccacatggaagctgccaaggtttggagcttccaccctctgaagccacagcctgagctgtacattggcccctttcagccagggctggagtggctgggacacagggaaccaagtccctaggccgcacgcagcacaggtaaccctgggcccagcccacaaaactactttttcctccggggcctccaggcctgtgatgggaggggctgctgcgaaggtctctgacatggcctggagacattttccccatggtcttgggaattaacattaggctccttgctacttatgcaaatttctgtagccagcttgaatttctccccagaaaaatgggtttttccaaacactgcatgttctcactcataggtgggaattgaacaatgaaaacacttggacatagggtggggaacatcacaccccggggcctgtcgtggggttgggggcagggggagggatagcattaggagaaatacctaatgtaaatgacgagttaatgggtgcagcaaaccaacatggcatatgtacacctatgtaacaaacctgcacattgtgcgcatgtaccctagaacttaaagtataatttaaaaataaaataaataaataagaaaaatgggtttttcttttctactgcattaggctgcaaattttctgaacttttatgctctgtttcccttttaaaacagaatgcttttaaaagcacccaagtcacgttttgaatgctttgctgcttagaaatttcttctgctagataccctaaatcatctatctcaagttcaaagttccacaaatctctagggcagggacgaaatgccaccagtttttttgctgaaacataataagagtcacctttgccccatttcccaacaagttcctcatctctacctgagaccacgtaagcctggaccttattgtccatatcactctcaggcttttggtcaaagctattcaacaagtctctgggaagttccaaactttcccacattttcccatcttcttctgagcccaccaaactgttccaacctctacctgttacccagttccaaagtcacttccatattttcgggtatcttttcgtcaacgccccactctatgggtaccaatttactctattagtctgtttttatgctgctaataaagacatacctgagacttggaagaaaaagaggtttaattggacttacagttccacattgctgagaaggcctcagaatcgctgggaggctaaaggcacctcttaagtggcagcagcaagagaaaatgagaatgaagcaaaagcggaaacccctgataaacccgttagatctcgtgagacttattcactacaccagaatagcaggggaaactcgtgagacttattcactctgcaagaatagcagaggaaagaccacacccccatgattcaattacctccacctgggttcctcccacaacacgtggaaattctgggagatgcaattcaagttgagatttgaatggggacacagtcagactatatcaggccagtaactcatagatttgcctttttgagcctattatttagatcttgtaggcatgctccattgttttttattattattttttgccttttctgactatttattttcagatacatgtcttcaagctctctaattctttcttcttcttgatcagttcgactattgagagactgatacattcttcagtgtgtccattgaatttttcagctccagaatttctgcttgatatttaaaacttattgtaatctctttgttaaatttctctgataggattctgaattctttttctgtgttgtcttgaagtttgttgtgcttcttcaaaataggtattttgaattctcttgtctgaaaagccactatctctgtttctccaggattggtccttggtgccttacttagttcatttttgaggtcatgttttcctggatggtgttgatgcttatagatgtttgttagagtctggacattgaagagttaggtatttgttttattgtttgcagcctgggcttgtttgttcctgtctttttggagaagattttccaagcattctgaaggaattgagtattgtggcctaagtctttgatcactacagctatatctgcattagggggcatctcaaaccagtaacactatgactcttgcagacttgtcaagatcaccttgatgttctttgataagatccaagataattttctggaacaagaggcaaagactcttgttctctttctttactttctccaaagcagacagagtctccgtctccatcctgagctgcctggtattggcaaaggggtgacacaagcacctggtggctaccatcacttggactgtggtgagtcagacccgaatccagcacagtactgggtcttgtccaaatccggaggcgaccactgcctggtaattgccaatcttcattcaaggccagaactgccattcgggaaccagggccaggaatcaggaaccttaggattctacctcctgctctattctactccacctaagctggcacccccaccacaagacaaagtctttcccactcttttctcttctttcctcaagtataaagagcctgttgtaatggccaccacagctggtattgtgctgggtcacatctgaagccagcacagcactagttctcacccaaagcccacagcaactaccgcctggttacaactgatgtttattcaaggcccatgcagatgatgaatgccgccagaactgggttctcccctacaaggcagcaggttcccttctggcccaggatgtgtctagaaatgtcatcccgagctagatcctgggatgtgggcctcaggacactgcttggtgccctattctactgtggctaagctggtgtgctaattgcaagacaaagtcctttttactctcccctctcctctcctcaagcagaaggaaggagtttcttctggagctgtgagctgtgctgccttgtgttggcgaagagctgacacaagtactcctgggctggcctagctggtgtcttatagcttgtgtgtaccccatgtcctctggctcagggtccagcacagcaccaagacttgaccaggaattgcagtccttgtggcctagactgcctttcatgtttatttaggaccccaaagcactttagttcacagtcggcctagctggaactcagataccaaccactgggaaggatgattcccctctggctgtgactggtctaaatgctccctccattggcactggctgaattctgccatgtgtttcttttgctgtgacagatagcactgagttccaaagcaaagtcccacaatcactgtcctctccctctgcctatcacacatactgtctctctgtgccatgcagctaatgctaggggatagaggtgatgttgttggcaattcaagactgtcttttctaccctcttcagtgcctttttccttgatatgatgttaaaaccaggcactgtgattgtgtacctgatttttgattctcatgaaggtgcttcattatgtggatagttgttcgatttggtattcctgtggaggggataatcattagaggattctattcagccatcttgctccaccaccttctctccagacacttttgtaagtgatgataccagtcatttagtccatccctaaaaaactgaggattctgggaatttaccatgtcaatgccatctttgtaagattattacctaagaaaaatgggtgctctttactttaagagtagaaaacaaaaagaagtcagaagtagccacatcaggactgtaaggtggatgcttaataatgtttcatcaaaactcttgtaaaattaggctgggtacagtggctcacaactgtaatcctaacacttcgggaggctgaggcaggcatatcacttgaggtcaggatttcaccagcctggccaacattgtgaaacccactctctaccaaaaatacaaaaatttgctgggcgtggtggcacatacctgtaatcctagcttctcaggttgctgaggcaggagaattgtttgagcctgggaggcagaggttgcagtgagctgagatcacaccattgcactccagcatgggcaacagagtgagaccctgtctcaaaaccaaaccaaaacaaacaaacaaacaaacaaacaaacgaaactcctcctgtaaaactgaccttgtttgatgggaggaatgagcaggaacacttgtcatggtgaggagggaccctctgatgaagctttcctaggcatttttctgctaaatctttgactaagtgtctcaaaatgctatcataagcagatgttattctttatctctcccagaaagtcaacaagcaaaatggcttgagcatctcaaacacctgttgccatgatctttgctcttgactggtttacttttgcttttactggaccacttcctcctcctggtagctattgctttgattatgctttgtcttcaggattatacttgtaaagccttttttttttaatctcctattacaattcttcgaagaaatgcttcagattttgattccacttgttcaaaatttaattgaaatctctgttgttgtctgaagcggatctggtcacaaaagttttggcacccatcacatggaatatttactcaactttaatttttagtcagatctatataagctgaaccaattgagatgtctgtggtgttggcttttgtttctgcaattaattgttgggccctttcaattagagcacaaacaagataattttgttcttgcaaattgatatggatggactgccactgcaggcttcatctttaacatcatctcattccttcttaaagcgaattttctatttgtaaattgatgatttatttgggggcattgtcctcataaacttttcataaagcatgattgatttcaccattcttacactcagtcttcaccctgaatttgatgtttgttcttgcttcaattttggtggaattaatgttgcactgaaaggggctcttttcaaatttatgttttattcttcttagtgcctcagactagatcctatttagacatgttataacaagttagggagaatttattttggtgcaaatttttttgacattcatgcatagcttttaataatgtacactatccatcaacattttgaagactcctcatatagtatctactagtttatgaaatttcaataaaaatttaaaaccttcagaaaaataattacaaatggctaagtgtagatgttaattgtttaaaatatgcaactcataaattttgatttttcctgaattcatagctgtatataaaggtgcttgtccctagcctgccacacccactgtctttcagattgtgccctgatactccttcacatcattatttgcaatgacaatactagagaaataaattgtccattgataaggcataccacgggtttatttcattatgccaattttaaagctactttcttctgtgaccagaacattttttaagacgttaattggttggtctttatttggcatttgatcagaggagagacagtgttgacaaagcagacattttcagtatctttgtcatttattcactagcgggaatctttatctgttctctgccttcatgtctttggtaacctcagaccagtctggtatatcttaatttgatcttgttttccaagccaaaattcagtttttctgtgcctcacaggcttagtattctcactaatgatgatgtctatccattgttatctcaaagtcctcattttcctctgtcttacagctgagatcagatttttctgattctattcatagcagtatctgtagcttttaactagtatttttgcctcttaattaaataaatgtaacacagctagcgtctgaagtaaaatgtgactagtttatattaaatatggtaactttcataaataaatattaaaacctgtttaatcaagaataaaacccaagtatttatgaagatacttgggaattgcttttcccaacactatgatattagtaatctgggtaggactgccagatgtagcaaataaaaatacaagacacccacttacatttttgtttcatataattaaggactaatttttaatatcagtatgttcaatgcagtattaaattccatgtggtttcactgggcattttatattttaactgtcacccctaaattttcttcataggggcattgattcttgtagtagttgccctactgaaatccttcagtaaaatagaaacaaagagctaacaagttatgaattcttttcatgaaatattatcatgccctccacttatgtaatctttttcccccatcactttgccaaagttgccttcagtctctacgggcagtggtcctgtggtgttgcaatacctgctctcagagggtagggccagaccactcttttgccccacttagcccagtctcatctccatctctccctaactgttgggttacagacattcctctggtggcaaaagcagaggtgtcctctgggctgatacccaggatcacaatgctgcatctttgttgtttaaagactcaaaatcagccaccactcctttgtgctctctgtggctctcaaatttgctgcatttgtgaaaaattatctggtttacactattccagttttatttcagggctgtatcacttacattaggagattgaatacaatatcacagccatgattttcaggaaatactaacttggaagagtgttatttccagtggctatttggataattggagcataacatcctcttcataaagcattttagcctaggctgagttgaataaagatttaagcaaaatgtgtgttttagaaacctgtgtaaaagcttctttggttattctttcctatacatcaggaagatagtattgagaactacagtgtgatgacttgctctagggttacctccaagcaacccttacgaaagtgtgattttgaacaatgagataatttgtttcatgtgggtacaaatgtcgtgaatcatggcattgattatgggagtagttccattggataacattctgccttacaatggattttataaactctcttcctagggagacagctcaaagcatttcgcagggcagatgtgagtgcccaacaaagaaaaatttgccccatcctagctttcatatgtgcctaagtgtgaggcatgactcaccttccacttaagcagcaatataacctttttcttcatactctgcctttctgccttggttcaccattttcttctttctatcatatggatcgtttataataataattattcaacaaatatttgttcagcccctactacatttagggtactagatgtgttactataaggtgctgcctgtagtggccaggagcttatctttcagttagtggaagtaagatatgtcttagcccaaggcaatatgtaaaaaagtattatataagtatatacaacttggtattacagtaagtaacataagggaaaaaggtgtttttacctgggtgttttacattatgaaagcactatggaaggaatctgatgatctgtatagatgagcaagatttcagtaggggaaaatgtgggatggaggatcattcagacagaggaaattacacaaaagccttgaagcttaaagaaaagcacaactttgcagaatggaatgtgattcagatggaatggaataagtcctttttttctatttgagggtaacgggacaatattacagatggatttgaatggtatatgggaacaaaatagtgcttcaggtagattaacctaaaagtactgtacagactgattgaagggcagaaagtttaggaaattgattatttgaaatagtttaggcataaagtgataatatcctgacctattaaaagatggtagtgccaaaaaagaacacatggtttagctggcccaaacaatggttagtttgtctacttagacaatatattgaataatattctctatttttcataatattttcatattgtgaactacttaacacttataccgaattacctcaacactaataatattttcatattgtgaactacttaacacttatgcctaattaccttaacacttataactaatcactatgcaaagtaagaacagtcttgtatatgtaatttgttatcaaccacttaaaactttggaaaaatgaaagagtttttatttgtagaactggttctaaataaaaaggcaaggccagacaaatacctggaaagaaaccttctcttagccctagagccactgaatcaagtcaaaataccttccacaaatggcaacttaatacttaaggaataagtgaagttacttttacagtttcttaacagcagttgcattttctttctttttattacaaattcagactttaaaattgttctcttagctgcatgagagtcaattaggaaaaagttacataaaaatcattgttcctcatgacatacatatcaaaagcaaaaatgtatattgattaaaggggtagaagggaatttcaaacgagaggaggactgtaaccataaactgtttctgtctcatatggtattaagaacagcaaagaacctgagcctgttaagcactataatccagaggtacactgaatgggaattttctgatccttacctaaccttcatgtcaatctactacttcaagctatttttctgtgaaaaagttaacatgtaaactaagacagatacctgagatttaaaaacaaaatctattgtaatttgcttctaacagtgttttatacaccttaattatgtaattcatctgtcactttaataagagtgattttaaaataatgcagggattgaatgtatctttatcttttgtacttcttttcatataaaatgaagtaaagctcaatgagcaaaccccaaacagttttttaaattattttggatgaatcaaataatagtaggattttccatttctgttttaagatagagatccattttgttttgttcatagtttatataatatgtaaaattatttttatatatcatctttgatattagaaaagacattttggtatgcgttttttttttctttttttaaatttattttattattattatattttaagttttagggtacatgtggacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcatagttcaattcccacctatgagtgagaacatgcagtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtggacaataaacatacgtgtgcacgtgtctttatagcagcatgatttatagtcctttgggtatatacccagtaatgggatggctgggtcaaatggtatttctagttctagatccctgaggaatcgccacactgacttccacaatggttgaactagattacagtcccaccaacagtgtaaaagtattcctatttctccacatcctctccagcacctgttctttcctgactttttaatgatcaccattctaactggtgtgagatagtatctcattgtggttttgatttgcatttctctgatggccagtgatgatgagcattttttcatgtgttttttggctgcataaatgtcttcttttgagaagtgtctgttcatgtcctttgcctattttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattactttttgtgttttagacatgaagtccttgcccatgcctatgtcctgaatggtattgcctaggttttcttctagggtttttatggttttaggtctaacatttaagtcttttatccatcttgaattaatttttgtataaggtgtaaggaagggatccagtttcagctttctacacatggctagccagttttcccagcaccatttattaaatagggaatcctttccccattgcttgtttttctcaggtttgtcaaaaatcagatagttgtagatatgtggtgttacttctgagggctctgttctgttccattggtctatatctctcttttggtaccactaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacgtcccttttaagttggattcccaggtattttattctccttgaagcaattgtgaatgggagttcactcatgatttggctctctgtttgtctgttattggtgtttaagaatgcttgtgatttttgcacattgattttgtttcctgagactttgctgaagttgcttatcagcttaaggagattttgggctgagacattggggtttctagatatacaatcatgtcatctgcaaacagggacaatttgatttcctcttttcctaattgaataccctttatttccttctcctgcctaattgccctggccagaacttctaacactatgttgaataggagtggtgagagagggcatccctgtcttgcacctgttttcaaagggaatgcttccagtttttgcccattcagtatgatattggctgtgggtctgtcatagatagctcttattattttgagatatgtcccatcaatacctaatttattgagagtttttagcatgaagcattgttgaattttgtcaaaggccttttctgcatctaatgagataatcatgtgatttttatctttggttctgtttatatgctggattacatttattgatttgtgtatattgaaccagccttgcatcccagggatgaagcccacttgatcatggtggataagctttttgatgtgctgctggattcggtttgccagtattttattcaggatttttgcatcaatgttcaccaaggatattggtctaaaattctcttttttggttgtgtctctgcccggctttggtatcaggatgatgctggcctcataaaatgagttagggaggattccctctttttctattgattggaatagtttcagaaggaatggtaccagttactccttgtacctctggtagaattcggctgtgaatccatctggtcctggactctttttgattggtaagctattgattattgccacaatttcagagcctgttattggtctattcagagattcaacttcttcctggtttagtcttgggagagtgtacgtgtcaaggaatgtatccatttcttctagattttctagtttatttgcgtagaggtatttgtagtattctctgatggtagtttgtatttctgtgggatcggtggtgatatcccctttatcattttttattgcgtctatttgattcttctctcttttcttctttattagtcttgctagtggtctatcaattttgttgatcctttcaaaaaaccaggtcctagattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacagtgctttgaatgtgtcccagagattctggtatgttgtgtctttgttctcgttggtttcaaagtacatctttatttctgccttcattttgttatgtacccagtagtcattcaggagcaggttgttcagtttccatgtagttgagtgattttgagtgagtttcttaatcctgagttctagtttgattgcactgtggtctgagagacagtttgttttaatttctgttcttttacatttgctgaggagagctttacttccaactatgtggtcaattttggaataggtgtggtttggtgctgaaaagaatgtatattctgttgatttggggtggagagttctgcagatggctgttaggtctgcttggtgcagagctgagttcaattcctggatatccttgttaactttctgtctcattgatctgtctaatgttgacagtggggtgttaaagtctcccattattattgtgtgggagtctaagtctctttgtaggttactcaggacttgcattatgaatctgggtgctcctgtattgggtgcatatatatttaggatagttagctcttcctgttgaattgatccctttaccattatgtaatggccttctttgtctcttttgatctttgttggtgtaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttattccatttacatgtaaagttaatattgttatgtgtgaatttgatcctgtcattatgatgttagctggtgattttgcttgttagttgatgcagtttcttcctagcctcgatggtctttacaatttggcatgattttgcagtggctggtaccggttgttcctttccatgtttagcgcttccttcaggagctcttttagggcaggcctggtggtgacaaaatctctcagcatttgcttgtctgtaaaggagtttatttctccttcacttatgaaacttagtttggctggatatgaaattctgggttgaaaattcttttctttaagaatgttgaatattggcccccactctcttctggcttcccccactctcttctggcttgtagactttctgccgagagatctgctgttagactgatgggcttccctttgtgggtaacccaaccttcctctctggctgcccttaacattttttccttcatttcagctttggtgaatctgacatttatgtggcttggagttgctcttcttgaggagtatctttgtggcattctctgtatttcctgaatctgaatgttggcctgccttgctagattggggaagttctcctgaataacatcctgcagagtgttttccaacttggttccattctccccgtcactttcaggtacaccaatcagacgtagatttggtcttttcacatagtcccatatttcttggaggctttgctcatttctttttattcttttttctctaaacttcccttcttgcttcatttcattcatttgatcttccatcactgataccctttcttccagttgatcgtatcggctcctgaggcttctgcattcttcacgtagttctcgagccttggctttcagctccatcagctcctttaagcacttctctatattggttattctagttatacatttgtctaaatttttttcaaagttattaacttctttgcctttggtttgaatttcatcctgtagctcggagtagtttgatcgtctgaagccttcttctctcaactcgtcaaagtcattctccatcctgctttgtttcgttgctggtgaggaactgcgttcctttggaggagaagaggtgctctgctttttacagtttccagtttttctgctctgttttttccccatctttgtggttttatctacttttggtctttgatgatggttatgtacagatgggtttttggtgtggatgtcctgttttgttagttttccttctaacagacaggaccctcagctgcaggtcttttggggtttgctggatgtccactccagaccctatttgcctgggtatcagcagcagtggctgcagaactgcggattttcgtgaaccacaaatgctgctgtctgatcgttactctggaagttttgtctcagaggagtaccctgccatgtcaggtgtcggtctgcccctacttgggggtgcctcccagttaggcttctcaggggtcaggggtcagggacccaattgaggaggcattctgtccattctcagatctccagctgtgtgctgagagaaccactgctgtcttcaaagctgtcagacagggacatttaagtctgtggaggttactgctgtcttgttgtttgtgtgtgccctgcccccagaggtggagcctacagaggcaggcaggcctccttgagctgtggtgggctccatccagttcgagcttcccggctgctttgtttacctaagcaagcctgggcaatggtgggcgcccctcccccagcctcgctgccgccttgcagtttgatctccgactgttgtgctagcaatcagcgagactccgtgggtgtaggaccctccgagccaggtgcaggatataatctcctggtgcgccgttttttaagcccgttggaaaagtgcagtattcgggtgggagttacccgattttccaggtgccgtctgtcacccctttctttggctagcaaagggaactccctgaccccttgcacttcctgagtgaggcaatgtcttgccctgctttggctcgcacacagtgcgctgcacccactgtcctgtgcccactgtctggcactccctagtgcatgaacctggtacctcagatggaaatgcagaaatcacctgtcttctgcgtcgctcatgctaggagctgtagacagagctgttcctattcggccattttgggtgccccccgttggtatgcggtttgctgtgaaattttggtttggaagtctgtgaatccttgtcattatctttggttatggtacaaattattagcttttgctactcctgttgtctaaatgatgttgggagagaatttaaacttcaaagcaaacattttaaaacttgagtctgtctccatcttggggaatagatggttaccctgcctgcttctctaattctgatttattcagtactcatttacctagtgcctactaaagtctcaggcaccagggaaacaaagtaaataagaattggtcatggtcgacctagaggtggcaatcaaatgggggtattcagacatggacactagttaattaaaatagcagagtgaaagcctagaggacgaattgattaagtgaggaaaagggagacaagacttccaaaataattatttgtatgtcagcttagtgatgggagtggaagttcactccattgcggttgagaataaaaaggatacttgactatgtggataattctgaattgagttttatacttcagttttaaatgtggaatgaaagttctgttagaccagtaattctcaagtaacagtttgtggccttttgctggtggctacatagacacttgttaaaaatgcagactgcctggaggtactatgttctgaaaaagcatctcacgtgattcttataattagtaaggtatgacacctactttaataaagatccaggagagataaaataaatggtagttgaagtcacaggaatggataagatttcccttgaaagtgtggagagtaagcaaagcagaagacaagaagtaagtagagaaggagccagcaaaggaactaaaaaggaatatactgtgtccagcagctaggatgtatatttacctgagtcttccagttcttagaatggtaatcctcatttctgaattgatatatagagaaaaaatgtagaagaaaaatctctagactgctatttatgatttggctttattctaaaagggattaatcaagtttcagctttgccctatctccaaatattatgcctacttctggaggaagtataatcacaaaatctgtagcagaaacagcaactgaccctctcgaatagtgaaaaatgaagaaagtagagtatcaggaaagaaagttgtaatattaaccaggctttgtaaaacaaaaaatgctccatcatacagttactggatggaatgaggatatttaatttactgaagtgacctttataattgagaactagaactgttatagtctctcaggaacaaatccttctgttcttagccattcctattcttttgtattgatgttgttgtgatccatgcatcttctacttttaggtaactaaaaccttatgttaatggaaatgtgctgttataaaagggcatacaatggcaattatataacctgaattggcataaaaattaattgtctttttcaaaatccacatccccagatagaatacctgttgatcctgaaggatttttaaaacatatacattaccagggggtgcagccaagaggccaaataggaacagctccagtctacatctcccagcgtgagcgacgcagaagacgggtgatttcgcatttccaacagaagcactgggttcatctcactggagagtgtcagaaaatgggtgcaggacagtgggtgcagctagtcaaagaaaggggtgacatatggcacctggaaaatcgggtcactcccacccgaatactgcacttttccaatggtcttagcaaatggcacacctttagattatagcccgcgcctggcttggagggtcctatgcccacggagcctcactcattgctagcacaggagtctcagatcaaactgcaaggcagcagcgaggctgtgggaggggcgcccgccattgctgaggcttgagtaggtaaacaaagcggctgggaagctcgaactgagtggagcccaccgcagcttaaggaggcctgcttacctctgtagactccacctctgggggcacagcatagccaaacaaaaggcagcagattcctcagcagacttaaatgtccctgtctgaccgctttgaagagagtaatggttctcccagcacgcagctggagatctgagaatggacagactgcctcctcaagtgggtctctgacccacgcgtagcctaactgggaggcaccctgcagtaggggcagactgacatctcacacggccgagtactcctctgagacaaaacttccagaggaatgatcaggcagcaacatttgctgttcaccaatatctgctgttctgcagccaccactgctgatacccaggcaaacagggactggagtggaactcccacaaactccaatagacctgcagctgagggtcctgactgttagaagaaaaactaacaaacagaaaggacatccacaccaaaaccccatctatacgtcaccatcatcaaagaccaaaggtagataaaaccacaaagatggggaaaaaacagagcagaaaaaatggaaactctaaaagtcagagtgcctctcctcctccaaaaacgcagctcctcagcagcaatggaactaagctggatggagaatgactttgacgagttgagagaagaaggcttcagacgatcaagctactccaagctacaggacgaaattcaaaccaaaggcaaagaagttaaaaactttgaaaaaaatttagacgaatgtataactagaataaccaatacagagaagtgcttaaaggagctgatggagctgaaaacgaagacatgagaactacgtgacgaatgcacaagcctcagtagccgatttgatcaactggaagaaagggtatcagtgatggaaaatcaaatgaatgaaatgaagcgagaagagaagtttagagaaaaaagaataaaaagaaatgaacaaagcctccaagaaatatgggactatgtgaaacgaccaaatctacgtgtgacaggtgtacctgaaagcgacggggagaatggaaccaagttggaaaacactctgcaggatattatccaggagaacttccccaatctagcaaggcaggcaacattcagattcaggaaatatagagaatgccacaaagatactcctcgagaagagcaactctaagacacataattgtcagattcaccacagtggaaatgaaggaaaaaatgttaagggcagccagagaggaaggttgggttacccacaaagggaagcccatcagactaacagcagatctctcggcagaaagtctacaagccagaagagagtgggggccaatattcaacattcttaaagaaaagaattttcagcccagaatttcatatccagccaaactaagcttcataagtgaaggagaaataaactcctttacagacaagcaaatgctgagagattttgtcaccaccaggcctgccctaaaagagctcctgaaggaagcgctaaacatggaaaggaacaaacagtaccagccactgcaaaatcatgccaaattgtaaagaccatcgaggctaggaagaaactgcatcaactaacaagcaaaataaccacctaacatcataatgacaggatcaaattcacagataacaatattaactttacatgtaaatggaataaatgctccaattaaaagacacagactggcaaattggataaagagtcaggacccatcagtgtgctgtattcaggaaacccatctcacgtgcagagacacacataggctcacaataagggacggaggaagatctaccaaggaaatggaaaacaaaaaaaggtacgggttgcaatcctagtctctgataaaacagactttacaccaacaaagatcaaaagagacaaagaaggccattacataatggtaaagggatcaattcaacaagaataactatcctaaatatatatgcacccaatacaggagcacccagattcataatggaagccgttagagacctgcaagagacttagactcccacacaataataatgggagactttaacaccccactgtccacattagacagatcaatgagacagaaagttaacaaggatatccaggaattgaactcagctctgcaccaagcagacctaacagccatctgcagaactcttcaccccaaatcaacagaatatacattcttttcagcaccacaccacacctagtccataattgaccacatagttggaagtaaagcactcctcagcaaatgtaaaagaacagaaattataacaaactgtctctcagaccacagtgcaatcaaactagaactcaggattaagacactcactcaaaatcactcaactacatggaaactgaacaacctgctcctgaatgactgccaggtacataacgaaatgaaggcagaaataaagatgttctttgaaaccaacgagaacaaagacacaacgtaccagaatctctgggacacattcaaagcagtgtatagagggaaatttatggcactaaatacccacaagagaaagcaggaaagatctaaaattgacaccctaacatcacaattaaaagaactagagaagcaagatgaaacacattcaaaagctagcggaaggcaaaatataactaagatcagagcagaaatgaaggaaatagagacacaaaaaacccttcaaaaaatcaatgaatacaggagctggttttttgaaaggatcaacaaaattgatagaccactagcaagactaataaagaagaaaagagagaagaatcaaatagacgcaataaaaaatgataaaggggatatcaccaccgatcccacagaaatacaaactaccatcagagaatactacaaatacctctacacaaataaactagaaaatctagaagaaatggataaattcctcgacacatacaccctcccaagactaaaccaggaagaactcccattcataattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccatactccccaaggtaatttatagattcaatgccatccccatcaagctaccaatgactttcttcacagaactggagaaaactactttaaagttcatatggaaccaaaaatgaacctgcactgccaattcaatcctaagccaaaagaacaaagctggaggcatcaagctacctgacttcaaactatactacaaggctacagtaaccaaaacagcatggtactggtagcaaaacagagatatagaccaatggaacagaacagagccctcagaagtaacacggcatatctaaaccatctgatctttgacaaacctgagaaaaacaagcaatggggaaaggattccctatttaataaatggtgttgggaaaactggctagccatatgtagaaagctgaaactggatcccttccttacaccttatacaaaaattaattcaagatggattaaagacttaaacgttagacctaaaaccataaaaaccctagaagaaaacctaggcaataccattgaggacataggcatgggcaaggacttcatgtctaaaacacaaaaagtaatggcaacaaaagccagaattgacaaatgggatctaattaaactaaagagcttctgcacagcaaaagaaactaccatcagagtgaacaggcaacctacaaaatgggagaaaatttttgccatctactcatctgacaaagggctaatatccagaatctacaatgaactctaacaaatctacaaacaaaaagcaaacaaccccatcaaagagtgggcgaaggatatgaatagacagttctcaaaagaagacatttatgcagccaagagacacatgaaaaaatgctcatcatcactggccatcagagaaatgcaaatcaaaaccacaatgagataccatctcacaccggttagaatggtgatcattaaaaagtcaggaaagaacaggtgctggagaggatgtggagaaataggaacacttttacagtgttggtgggactgtaaactagttcaaccattgtggaagtcagtgtggtgattcctcaaggatctagaactaggaataccatttgacccagccatcccattactgggtatatacccaaaggactataaatcatgatggtgtaaagacacatgcacacgtatgtttattgcggcactattcacaatagcaaagacttggaaccaacccaaatgtccaacaatgatagactggattaagaaaatgtggcacatatacaccatggaatactatgcagccataaaatatgatgagttcatgtcctttgtagggacatggatgaagttggaaaccatcattctcagcaaactgtcacaaggacagaaaaccaaacaccgcatgttctcactcataggtgggaattgaacaatgagaacacatggacacaggaaggggaacatcacactccggggtctgttgtggagtgagggaaggcaggagggatagcattaggaaatatacctaatgctaaatgacgagttaatgggtgcagcacaccagcatggcacatgtatacatatgtaactaacctgcacgttgtgcacatgtaccctaaaacttaaagtatattttaaaaaataccgaaatttttgtaggtatgtagttattattcaatttttttgaaatgaattagcgactggaatgcattcacttttctttgaagtttcaggtggtactttatgaaaaggaatttccaagatcattttaatagttatgtgatcaacttttcacttaatattcttccttgcactgatctgatacagatttttcacaacctcagtgaacaagtggtaaaatggtcaacagtggttctaatatatttagctttggaggttctacattaaaggttatttttagaaagttttcataattaacacagtcttgaggaactattttattatgaataatattttgttaatgtcagaggaaaagttgaacaatgatacgtatatctaaatagagaaaatttactcgtgagaataccacagtgagatcttcaaattttttgatggccaatttgtggagtctaaccaacagcaagttagggagaacacaatccacactgccctcagttctgacaccagttgtaaattcagggagttaccaaaaccacccttaagttcataattaattaaacatgctcatggaagctgacagaaagctgttatactcatagttacagtgtattacaactatagaatagagattaaagccagccaagggaagaaacacaaagggttgagtccaggagaagcaccaaatatggagcttcctttgtcctctccccatgagtaatggatgttacttttctggcatcagtgtttgataatacacgtggagtactgccagctagggaagctcacccaatccttgttgcccagattttttgttgaggctctgtcacatattacctatgtggctgacctttattctccggcctctctgtaggtaaaacttgtatggcatggtccaaagtcttagtcataaataacattgttagactattcagtgtccaaggcccccatgccttggacccccctcatcaggcatgatgttccatgggctagaagtcacctattactagccagtggcaaaggccaaacttctctttgagtaaggttaatttttcactacactctatgtcattcagatagtaaaagcagatgaaaccaaactggaaccaatggcttaacaaaactgagacttcagagactatgacagatgaaatggctccatattgtccacaggattaagttaaagtgtttgcattgaaaatcacctttctgtatcctggttctctctcaacttgttcttttatgaattcccttctgcagtcaattagagtcacatctactgggcatgccaagtgctttcctgctttggagggtttgtttataccacactcgctgttaatatattcactcatgatctgtaggttttgttgagcccagcccaggccccatctcctgtggaaggccactttcaccactttaccacttttgcagacattctccactgatttcccatagctaacattgcccatatagttttttttggctgttagcatatatttctttccattgatatgtatacctatatcttgtctttacaagttgatcttaagccttttgcaatttaaggaaataatggactatgccctgtgtttttttgagcccccagatcctattacaatgtcttgcacataacaaatgttaaataaatatttgaatgggaagttttcatatagacttgcaagtaggagtatattattcaaatatatgaattaaatcatcttgtaaaaatgatgtaaattatacttataaatttctgaggtaagttaatccagaaaaatattggaatcatttttggcaattcattgaagacactggaaacataaaggtcagaaaaatgatggaaaatggtaagagaagtattgccattccacttccacttcagggcctttcacattgctttcccctctgactgtaacactctttctctaaatatttctctaaataatctcactcagagaggcaaaaccaccctacctaataggtcagccctttcctcactatctctttatcttgccttttttttttttttttggatggagtcttactctgtcacccaggctggagtgcagtggcgcagtcttggttcactgcaacctccgcccccctgagttcaagcgattctcctgcctcagcctcccaagtagttgggattacaggcacctgacaccacacctggctaatttttgtatttttttagtagagacggggtttcaccatcttggccaggctggtcttcaactcctgatctcatgatccacccacctctgcctcccaaagtgctgggattacaggcatgagcaactgtgcctggcctatcttgctttatttttatattactttttactaaccaatcaacattatatgcttaatgtctttcttccctactaccagattataggctccgtagagtcagagacttattcttgctaacagttatatcttctacatctagaatagtgcctgattcttagtaagtgctaagaaaagtttttgttgaatacatgaatgagtttgtactattcagcaaacagaaagcttaatttttatatacgttcactttttgtggggtagtgtgtgtgtgtttgtttgttttcagagtgggccttactctgttgcccaggctggagtgcagtggcatgatctcagatcactggagcctcgcctcctgggctcaagtgatcctcccatctcagcctaccaaggtgctgggattacaggtgtgagccaatgcatctggccttacagtcactttttgtattattcaatttatgaaaacataattgagcttgaagaatttcaaagagaagcatctaaagtgattgaggaagtggtagaatgttttctaaaattactaaaaattattcagcttataaaaataattattaactttggccatatatggatgcacacatggtcaaagttataaaattataaactgtaataattaggttaaaataggcatgtttctcaaaccctagttttatcgaagcactctttaaaagtttttcagagaagtaaaggaatattatttttatacagtggataataaacatggagctctttcttaaaatttgtatgtatttcaaaagagttcaaagagctgttttgataaaaatcacaattttaaagataatgcaaaatgagaaatatttataacttcggaaagtaacagcatggatttcagctatggtgctttatcctaaaaggagttgcaggtttcattattgcctgttgatattaattccaaaaatgtcaagttccccagttgggacaatgaacagtcagcaaccctgagaacgaaggcatatccaaatgtgaccacaggagtattgggtaggtgtaactggagtctaaccccacatgtttgtggtagacagtcatctggaactctgacctagattacttagaatctgtgggaaatccaggctatgcccataggcctcagtgcctcctagtcttatagtctttaaagaatgctttgttctattcaagtattttccactggaatcccagcacttccttcaagaacaaggtacacatcatgaatattgactgctctcgaaatacgcttcgtcctctcctctctacacgcctccctttagttctcattgtagcttctttccctgaagagatttatttctacctgaagctagaatatggcttatatttttgaccattgtgtctggctttgattctgaagtgtttggcagcatttgtgtgcagtgactgggaagcagtttgttcacaatatgattttattgaggttttttcctttgcttctgtatttccacacttaagactccccccaccccatattcaaggaacaaaggctggcaatgatccagcccttttgtattattgtctctagttcatgattttagtagcatgtttgcaactagagtacacttttatattttctcttttcatctctgcctctatggatttttggcaaacatcaaggtgaataaatcagaccgaccactgcaaacccatctgctttcaggaacatgttagcagaccaatttgtgatgttttatcatccaacatagaactaaaggaggctccctgtggagtaagaatagaaggcaaagtctgaggtcaaagagtttttcagctttgaattatttatctgcctactgattgtgctagggacagtctatactggcatttttaatggcactaacagattggtacggtataatacttataaagttgaaatgattttgtggtagatttaaagtgaaaatacagcttatactttggatttgataatagggattaataaaaaaagatgctgtcacagtttttaaaatgtggcaaatcaaggtacacagtgttcatttgacaggatattacttttacacttcagccgctgctaaggttacatttgaaaacagtcttcctcactaaaatacctttctagttgttgacagcccagaaattggtcataaaaaataataggctgtggtcatacaaagctgtcttcctaatgcttgttgacacttcaatgctgcattcatttctttctcacaatgagcaagtaagtgatgattctctttgaaaaagaattaagagaattgcaaacatgtcagtgtatatacgttatactgggagaacagttcatgtaatactcttgataacaggcactaaattgaacctactttaaattgatcaaaagttaagcaagctgcttatatctcatagagttgattttaagctgatcttcaacaagctaaattgtattctctgctggactatgattttatccagtagagatcaatgtctttttttgagaataagtttagtcttactacctaatggtttggaaattaaagagaacccttgaaaggcagatttagtttctctgtgatgataatgtcaagggcatggggtatgggagatgtaactcagtttttcagactttatgacaaacttctttctactttgtgatctgagtcagcttttgtttatagaccaacctgacagaggcaggagaaaggatactctcaagaactttgcctatgagttacattcttggtggtgatggtccagaaaggaggcatatacttgtgatagtggtttttgtcctttccatacatgacttcaactattttttatctttaaaagctaaattctaaagtaatgatggaaatggtgactgctctggcaaatttagattctactgtaccctgtccttcctatccttcttctggacatatttgtgtacatctttctttattgtgtgggttacatgcaaagctggggccagagtgtgtattagttgataaaagcagtactttatctgaatagttgttcactgttgcttttatgaatggattcatagaaaaaagggtaatttaggacacataaaatacatgattggaaattaaacagagtgtgtgtgcattaatccatcattgtgttgtaaatctctaaaggaattggtttcataatcataatgtaacagaaaacagttgtttatttaggtatacagatacagaaggatgtctaaaatgtatattcaccgaaaattttaaacagttgaataatggttcttatggaaatgggaaaaatatttcttgtcattaattaataattttatttatttaacaagtactcagtttatactaggcaatatgctaagtacttcacatacattctaaataatgttattttaagtaacattatgcatttgatattatcatcccattttacacatgaggaaactgtagtttagcaagattaaataacttgtctgagatcctataggaattaagtgaggaaagtggaaatagaatcaatgagtttatctggcttcaaggccattataatatcgtattggactctgaggtacaaaatgggagatacacctgctgagaagtaagttgtggagcaatttatgcgtctagatattagtgaagtggctgccctaaaggaatgacttgttccctcttctcattctggagaaaactggcaggacttagggagcccgtgcatatatgggaatcttctcagaaaatgaattcatatcagttttggttgtgctataaaatgttttcagccatataaaaataaaatatcataagaaagcccttagctccagatatttagatgatgaattattgagcctctttttgtccttcctctttcttcattatatttcttgtaaaaattgaccactacaatcagaataagtctaaaaagaaaggaattaatattgaggagaaaaattgttttgttttccttttgcagaatgttaggttttgtaactttcttgactcaaatatttgttgaatgagtgagtgagtgaatttggatgattagatgtgcattcctgaaacataaactctttctactctcaactgttatgggtaattggaaggtgggttgacattagcttttgcttcaaaaacacaattattttcttttgattttcacaagttcagtacacaatttcattcctattaggctgtttacgagaatctgttctatctgttgacctttacttatatgagatggatcagtgactaatgtagcaaaataccttatttagtctataaagtgaagttctagaaattattcccttagccaaatgagagcactgtataagaagaaaactctaggaacacatatgtattaaacatttaaaagtaatcctaggaaggggaattttattttaattaattttttttttgagacggagtctcgctctgtcgcccagtggcacgatctcggctcactgcaacctccacttcccaggttcaagcgattctcctgcctcagcctcctgagtagctgggattacaggcatgtgctaccatgccgggctaattttttgtattttttagtagagactgggtttcaccgtgttgccaggctggtctcgaagtcctgagctcaggcaatccgcccgcctcagcctcccaaagtgctgggattacaggcgtgagccatcgcgcctggccaggaaattttattaagtaaggacaaggtgattttattttcatttgattttgtcctttatttcttaaatatggaaggtcaagtgtgcatagaaaaaaattactcagtattgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttcggcatctattgagataatcgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattgattttttgaagggttttttgtgtctctatttccttcagttgtgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacagtgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattatggaataggtgtggtgtggtgctgaaaaaaatgtatattctgttgaattggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtatgtctctgcacgtgagatgggtttcctgaatacagcacactgatgggtcctgactctttatccaatttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctgtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgccttaacattttttccttcatttcaactttggtgaatctgagaattatgtgtcttggagttgctcttctcgaggagtatctttgtggcattctctgtatttcctgaatctgaatgttggcctgccttgctagattggggaagttctcctggataatatcctgcagagtgttttccaacttggttccattctctgcatcactttgaggtacaccaatcagacgtagatttggtcttttcacatagtcgcatatttcttggaggctttgctcatttctttttattcttttttctctaaacttcccttctcgcttcatttcattcatttcatcttccatcactgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccggctttgttccgttgctggtgaggaactgcgttcctttggaggaggagaggcgctctgcgttttagagtttccagtttttctgttctgttttttccccatctttggaagttctggccagggcagtcaggcaggagaaggaaataaagggtattcaattaggaaaagaggaagtcaaattgtccctgtttgcagatgatatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgagtaggaagaatcaatatcgtgaaaatggccatactgcccaaggtaatttatagattcagtgccatccccatcaagctaccaatgactttcttcacagaattggaaaaaactactttaaagttcatatggaaccaaaaaagagcctgcatcaccaagtcaatcctaagccaaaagaacaaagctggaggcagcacactacctgacttcaaactatactacaaggctacagtaaccaaaacagcatggtagtggtaccaaaacagagatatagatcaatggaacagaacagagccctcagaaataacgctgcatacctacaactatctgatctttgacaaacctgagaaaaacaagcagtggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaacccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccttactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaagcaaacaccgcatattctccctcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtatctaacctgcacaatgtgcacatgtaccctaaaacttaaagtataataaaaaataaaataataataaaataaaaaaataaaaaaagaaaaaaaagaaaaaaattactcagtgttaggcaaatttactctctagatttttttctttttaccaatttttcttttcctgaatcagactattggaaccatttaaacacagcataatgctaaatgcataatcagttcctagggaatacagtccaacgatttctctctcttaatgtcctgaaaagtacaaaaagagttatcctgcgggccaataggcacatatttacccctgaaatatttcagcaatggcagtagtaacatttttattcctcatctttcaggtagtttataagtggaaactattaacttatcggaagagagctcttctgttggagaaaacctggcagtgaaaactttggtttgcctggttaccagatttttgtactcaagactccagacaagataaaagaaatgtttcataatatatcactttatataatacctttatacttaccttattctatacccccaccccaccctgcagttttctttatcattagaaactacatttaccttggcaaatataaattttctctgtatccttttactgaagttatggtgattttttaaggctctattttaattcaggtttagcatttcattcctgtaagccatcagaatttcctctggatcgatttgtaatatgttcaatgtttgctaggaaatttggaagtttttggtttgcttcctctctttctgtatataagatctaattaccacccagcatgaaatagcaactgaaatgaaggcagcaagaaagggtagtggcttaccttagagctaatcaaccacccccttcttgtatacttcgcagctatcaagagaaagaaaaatggcattcattaaaataacatatattaaactttttttctttcttgatttgagactgaagagaaagtttcttcaaatctttatggaaataagacattaagcaattcttttaatttgcaattagtagtctgatgtgaattgtacaaaatattttcaccatcagtgttgctataagtagccccatactattttcttgacatttaaaaagataaacatttctaggaataaaataaaatcaagagaatgtttaatcatttttataaggctagaatttcactcaatttggggttttggtttctaaatttgtcttcaacaaatatctaggcttatctttaaagaagatatcatccttcacacctgtaatcccagcactttgggaggtcgaagtgggtgaatcacgaggtcaggagtttgagaccagcctgttccaacacagtgaaaccccatctctactaaaaatacacacacacaaaaaaaatagctgggcgtggtggcgggcacctgtaatcccagctacttgggaggctgaggcaggagaatcgcttgaacccgggaggcggaggttgcggtgagccaagatcgtgccattgtactccagcccgggcaacagtgtgagactctacttcaaaaaaaaaaaaaaaagagatcatcttaatatagtagcctgtagcttcctgttttgtggaatcagtttgttgggtaattaacctgggaaagattgacagtatttttactttttaaatgaccatggtctgagtttttatcagattgtcagatttaaaaattagataatttgtggtattagacagatgagaaatacatactctactattgtttggagtatgtattggaatgacagttctggagagagagagtacattcatcaaaattggaaatgcatgtaacttttgccttagcaattaaacctcaaggaatttatccttgaacacgtgcataagccatgtataaaatattccttatgatattgtttgttatataaatagaaaaaaatgcaaagaagatggtcattaataggagaatgttcagtaaattatgatatatctatatccagatataccttatttttaaaaagtaaccactcctacagagaataaactatatgtacatgtcttgataaggaacactctatgttatcccattaagtgaaagaaacagtctagtttgcttcaatggagatgtatgtatacaacttccctccatccctgccccttctccccatataaacatacatacacacacaaatatgtatagatagatgggtgaaaagatacaaaggagctgttggtagcacttatcttgggtataggactatgggtctgggatagaagggaagtttttatgtttttctgttgtttacttttcttgctgtttgagttttttaccatgtgtatatattatatttcataactgggaaaaaatttaataaccaggtctattttctttcttttttaggactcagcccaggagagtgttattactcgagatattcatcgtacatttcccgcacatgattactttaaagatactggaggagatggtcaagaatcgctctataagatctgcaaggtaggactctcttcctcactttttctaaattattttacagagctatattttagaaacccatttaaggatttttttactctgtcttcatttcttatttgcactatgccatgttttctgctttgcacacacgctatgagatcctcagtactgatcccagaaggtgacttttcggttgcatgtttcgtgcctcctcatgagggaggaggcgcagcatagcctcagtttggctctcctgctaacaggaaaggaacaaaaggtcctctgaggctatgctataaaagctcaaaagagtcctagatgactctgtccttctgacaagatcatgcagcaattgtctccatttttctgacaacaggcaagtgtaagaatcagtgtgcttattgttgaatactggcaaattattggatgttgttgatatattctgagttacgtcacatcatatatttttgtacggtttttatatcccattttgaaatcttttttctccctcattataagtaggcctggaaaaaacctgtttcctgattttcagtaaatgtgctctgcttggatacagaagattctgtctctgtcagtatagaatagccatcaagttattaattttatcagaaatgcagaatgaagtgtggtgggtatactcacattgttgatatctaacattctaaagagatggttaatgaataatgaactgcacaaaaatttggtaataatatggagaaaaaggcaaacatcatggctaatttgtaagttaggtaatcagttcctgaataatccaatttagcctttgtaatgagtagcaaatattagccagtgtggaattaagaagtatattcacaaatctgtttcattttatatttactgttttttaaaaacagcacttataaaagcactcacttctccagcatttaagaggatgtggagaaataggaacacttttacactgttggtgggactgtaaactagttcaaccattgtggaagtcagtgtggcgattcctcagggatctagaactagaaataccatttgacccagccatcccattacttggtatatacccaaatgactataaatcatgctgctgtaaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaagcaaacaccgcatattctccctcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtatctaacctgcacaatgtgcacatgtaccctaaaacttaaagtgtaataaaaaaaaaaaaaagcactcacctacatattctaaccaagtaggattaatgtttaattctgcaaatggcacgactttcattaaagtccttgcatgttggtggttttggcctcttcacactcctgtctctttttttcttactttttctctctctcatatttttttatctaaccattttggaggattataaatatatgctgattagaaatctatttttatatgaatgtgtcattcagagctagaaatatataacttataatctgagagtatactgatctttagaaagtgatatatcatctactttgaaaagtaccaaagaccattggatgccacaaaaaaaggtatatgttcattatatgcttgtgaaagacaaaagtaattatttaaaacatttttctactactttgaaattctgcaagctgattaacactggcttttgtaaagaggttaggaaaatttatatcatttccaagtttatttaagagggtctggtttatggcatatgcaacatttttttcccctagcatatagtatattttcagccagtcagtgactttcccttcagcttttctctgattgatactagatactttcttcacataactaaaacagatggttctaatgtgcttgcagcttctgacttaacattttgctccattgtagtaaaaatagtatttgccttgttatgtaatatttagaggggaaataatctgaaacattaccaaacacaaaaataaaagttgaacgattggcacttttaaatagttgatacactttgatttggtgttgcaaataataatgcaaccttgaattcatttgaaaatactcatcagtacattcccagagctcatgtggccattttagattatcagtatacattttacaacatgactaaaccattttaaaactctttctgaatgaagaatattgtaaaatgtatatctgagatactttattatcgaaaagtagcttaaatcacactaaattttgtgaagatgtagaaaacaaaattacattagacatagtattaaataaaagcaataaaagtttttaaggattttaatgctgtactgagctgtatatacataaaaataatttcacaacagtctttggtaatggatatgagcagagatgtatacatcctaccctgtagaccgcttggtttgtgattgacccggttccttcccatcttgatttactgttatttagtatctcatgccaggaaaccttaagtttgatgatagctcacaaataggatagcatatctatgagtaatttagtatagcatacttatgagtaatttagaatggaatattattctcaagcttccacatccacttttctttgctttttgtatccaatttgaaccacagtcttttattttatgacccccatcccatattcccaaaagctgcctgtgtgtaacctttaaggcttaaaggtagtctaaccatttaaaggtagtctaaggcttaaaggtagtctaactgtgtagtctaactgttctaacattgtttctagaaacattggttctagaataataactagcattatacctcacactcagccgtccacctctgagtttctattctggacaccccgcgcagaactgaataaacattaataacaccttgatcttatctcagctgctttgctatatgtaaataaggacagttttgcttttcctttaccaatccttattctttttctatttgtctcttgtcttattgcactgaccacacctttagtatagcgttcaaataaagctatcatagcaaacatccttttcttgctcctgatttgaaaggaaatgcatctaatgattaaccactaagaaagctgcatcttcttcacatcagcaacacaattgtaggcctttttttttaaaatagtgttttctatattaaatataatataatatattatatttaattatattaattaaatataattttagattatattaattaaatataattaattaaaataattttacatttgcagagtactttgacatatattacctcatttatttttgacaattcctcatcaatggagcctacactggagatataatatgctgtgctcttaaattgagcagaaattaagagaatttcagtgacaataagtttagaaatcaactctgttttcaaggatacaacaatctgactttgtagttgaaaagttttctgtggctctggtgaaaggagaaatgatttgaactgtcacattagagggaagactgttaaaaactcattgtcatgttttaatggccctgtcaattccagttttgcctcttaatatctttcttcagagtaggaggaaatcgaaatgattcaaagcttcttctgttgtcattaatttgtatgggggaagttgagctgaaagtattagtagaattcataggtttctgcagatgaagaggtttgcaaattaatagatttctgcaaatgaaagtttctgaaaatttggttcttccctctttctctccctgtctttcctattggttaggtcaataacatattttaaaagaatgtccatgagacagggaagaatatactaccaccccaaatatattttgcatttttattatttaacatgagatgtaaaaatctgctataagttgggagacaggttggtatagtttaaagcactgggcatcaggaaatctggttctggttttgattctttcactaagtagatctaagaatgagggaaatttgtaagggtgtggtgtcataagattgttccggttccaatgttctgtgattctcagtgttgttcaaattttttttcctgacatataacacataaatgcagaatttagcagttaaatcctgcgtcagttattagctctggctctcaatactaaagatgtaaaagggtcttctccttaaatctgaagattttacctggccttctgttacagtgttcggtttgttacatcaaatggagtgcattagtagtttagttttagatatacatctctttataagacctaagaccagttagtcatagtaatcaggtaaaatattattcagaacaatatgatttaaagtgatatttgatgtacaatttaatttgtgcatattgctttttctcattttttgtttggtgtaaatgctctctgaaaaaagaggatactgctattaacttaatgggagagattgaatatattatacagagattaatacctttgtttatctggattaataatttgatagcataatggtttataggaggacaaaaataaacttaacccttattttaccaaatatttttatcaaaaagattggatttattataaaaactagagcagttaaagtattgttttgatactaatgatgagttatctgctgcataattttggagaatgcaaataatcactgactcttaaaatgacatgtaatcatacattatttatattgctttctagacatagggggtatttgtgattatgaggatgaattatttttcacttagttgatattattttcaatacaattttctagccatttgactacttttaattcaactctttcttgatgtgtctgaatgagccctagttgaaatgtcagcatttactgaacaaattatagtcctctctcctctcctctccccaccctctcccctcctctcctctcctctcctttctctgtctctctctcttttctttttctctctctctctctcctctccccctctccccctctccccttcttcccctctctccctctccccctctcctctcctcttctctcctcttctcttcggggtcttgttctgttgcccaggctggggtgcagtggtgcaatcttggttcattgcaacttcagcatcccaggctcaagcaatcctcccacctcacccttccaagtagctgggattacaggcacgcaccaccactctgggctaattttggtctttttagtagagacagggtttcactatgtcaatcaggctgctcttgaatccctgaattcggacaattcgcctgcctcggtctctcagagtgttgggattacaggcgtgagccactgtgcccagctgctcagccccatattctttacatagcactgactaagcgctcctcctacttctgtggaactccttccactcatatctttggaatcggatggattccagagtaggagccatttgttgtgtgatgataggtgttcctggatcagatggatccaaaaggatttagtttggagcagtgcttttgaggaatcaggaagcacttggacaatcaagcagatttttctattctctgtgtatctcctatctctcccttgatttcctagtaagctgctttgaattatggcaaccttctaatgcagatccaaatatgggctgccaagaaatcctttgaacccctggggccacctgctttgccagcacattctaatgagcagtgaaataagtgattttaacagacacttagagacagcagcatattctccaagcaaattaacttccttacggaacagtgaattctttcaggtcttataagaaagacttggagaaccatcctactgtggatcaacataatcataacagtaatagtaaaaatttgtaaagccctgtggttttgaaagcattttttgcatgtcgttatttgatccccacagttactccattagaataaagaaggtaccaaatttgcatactgataaatattaatctcttagagtcagagtttgatttagtttttttcctttttaaatcttttcatattattcattttagatgaattgtccaattctgctttattgccaagaacaattatgtttatatctatttagaacactaaatatatgcacacacatataaataaatcttagcaacccaaagttgaaaaacttcacttatataggggtgtgtgtgtgtgtgtgtgtgtgtgtatgtatgtatgtatgtatgtatgtttggggttaatttcatacttaccctttactcacaagatttcaaaatcatttattgtatttgttagtatcattatagtcatacaaaagggttattttgggggtttttttggtcctctttaatatacgtattagtaggatagactttatgagtcacagctcaactgagaagatataatgtgattttaaaatatagatttttcttctgagactgtgaaaggtcagggtttgtgaagctagagtcctggaaagagaatgagtgatttataatactcttcagagtgcctaaagagatttttaaatttcttcatggtcttagtccctaagagctttccttgaaatagctttttagtttctgtgaagcctgtagtctttcaactgaaagcctgattgaagccatcacactcttactaggatacagaagagaaagggtgggattttgaggatgataaaaatggataaacttagaataaagggattggtgtgacgcctaagggtttgattatagtcactctttttaaaaaacactactctttcaggaggaaaaggaaagtaagattactatctaaaatacaaaagaaaaaaaaaactaacctgcaaagatgaaacacagggaaccttcaaataaaatgctctttatggtgcctcctgaattatgattttttttcatatttgagatctatttctatactatattcaaatggcttaaatatcctagacaaaaacttgtagttgttcttgaatggattattttatgttacagaattatgaggatttatctcctggttactaattgttatgcagttgacaatatttttataagtgaagcctcctcttcccgcacctttaaagcctcttctttaatcagaacccttcgtcctttctccctagaaataatgtgaatctgaattgccctactcctccttcccatctgtccaaatcttagttgtccatctcccttataaaggtagtcctacgcactatacccacagtgatttatagattaaaacaaatctggagatcaaatgtataacatgagcactatagttaataaaattgtattgttttagggatttttgttaaataagaagattttagatgctcttgttacacaaacaaaaaaaagtacgtgagatgatagatatgttactctgcttcactgtagtaaccattttactataaatatatatcacataacgttgtgttgtaaaccacaaatatacacaataaaatttatttttaaaatattttataaaatttagattatgtattatatatatcttttcaattatactttaagttctgggatatgtgtgcagagcatgcaggtttgtttcataggtatagatgtgccatggttgtttgtagcacccaatcaacgtgtcatctacattaggtatttctcctaatgctatccctcccctagccccccaccccccaacaggccccagtgtgtgatgttcccctccctgtgcccatatgttctcattgtgcaactcccacttatgaatgagaacatgtggtgtttggtttgcagagaatgatggtttccagcttcatccatgtccctgcaaaggacatgaactcattcttttttatggctgcatagtattccatggtgtatatgtgccacattttctttatccagtctatcattgatgggcatttgggttggtccaagtttttgctattgtgaatagtgctgcaataaacatatgtatgcatgtgtctttatagtagaatgatttataatcctttgggtacatatccagtaatggggtggctgggtcaaatggtatttctagttctagatccttgaggaatcttccacaatggttgaactaatttacactctcaccaacagtgtaaaagtgttcctgtttctccacatcctctccagcatctgttgtttcctgactttttaatgatcgccattctaactggtgtgagatggtatctcattgtggttttgatatgcatttctctagtgaccaattataatgagctttttttcatatgtttgttggccacatacatatcttcctttaagaagtgtctgttcatatcctttgcccactttttgatggggttgtttgtttttttcttgtaaatttgtttaattaagttcattgtagattctggatattagcccttggtcagatggatagattgcaaaaattttctcccattctgtaggttacctgttcactgatgataagtttcttttgctgtgcagaagctctttcatttaattagatcccattcatcaattttagcttttgttgctattgcttttggtgttttagttatgaagtatttgcccatgcctatgtcctgaatggtattgcctaggttttcttctaggatttttatggttttaggtcttatgtttaagtctttaatccatcttgagttaatttttgtataagatttaagtaaggggtctagtttcagttttctgcatatggctagccagttttcccaacaccatttattaaataggaatactttccccattgctagtttttgtcaggtttgtcaaatatcagatgtttgtagatgtgtggtgttatttctgaggcctctgttctgttccattggtctatatatctgttttgataccagtaccatgctgttttcgttactgtagccttgtattatagtttgaaatcaagtagcatgatgcctccagatttgttctatttgcttaggattgtcttggctatacaggctttcttggttccacatgagaaatttaaagtagttttttctaattctgtgaagagtgtcagtggtagcttgatggggatagcattgaatctaaagattgctttgggcagtatgaccatttttgcaatattaattctttctatccatgagcatggaatgtttttccatttgtttgtgtcctctcttatttccttgagcagtggtttgtagttctccttgaaaagggcctccacatcccttgtaaattgtattcctaggtattttattctctttgtagcaattgtgaatgggagtttactcatgatttggctgtttgtctattattggtgtataggaatgcttgtgatttttgcacattgattttgtatcctgagactttgctgaaggtgcttagcagcttaaggagactttgggctgagacagtggggttttctaaatatataatcatgtcatctgcaaacagagaaaatttgacttcctcttttcctatttgaataccctttatttctttctcttgcctgatttccctggccagaacttccaatattgtgttgaataggagtggtgagagagggcatccttgtcttgtgccggttttcaaagggagtgcttccagcttttgcccattcagtatgatattggctgtgggtctgtcataaatagctcttattattttgagatatgctccaccaatacctagtttattgagagtttttagcatgaaggagtgttgaattttatcgaagccctttccgcatctattgagataatcatgtggtttttgtcattggttctgtttatgtgttggattacattgattgatttgcatatgttgaacaagccttgcatcccagggaagaagccgagttgatcttggtggataagctttttcatttgctactgggttcagtttgccaatattttattgaggattttcgcattgatgttcatcgggggtattggcctgaaattttctttttttgttgtgtctctgccaggttttgggatcaggatggtgctggcctcataaaatgagttagggaggagtccctctttttctatttttgaaatagtttcagaaggaatggtactagctcctctttgtacctctggtagaattcaactgtgactccatctggtcctgggctttatttggttggtaggctattaattactgccttagtttcagaacttgttattggtctattcagggactcgacttcttcctggtttagtcttgggagggtgtatgtattcaggaattcatccatttcttctagattttctagtttatttgtgtaaaggtgtttatagtattctctgatagtttgtatttctgtggaatcagtggtgatatcccctttatcattttttattgtgtctatttgattcttctctcttttcttttttattaatctgggtaatgttctatctattttgtaaatcttttcaaaaaaccacctcctggattcattgagttttttttgaagggtttttcatgtctatctccttcagttctgctctgatattagttatttcttgtcttctgctagtttttgaatgtgtttgctcttgcttccctagttcttttaattgtgatgttagggtgtcaattattgatctttctcattttctgatgtgggggtttagtgctataaatttttctctaaacacgctttaactgtgtcccagagattctgatacattgtgtctttgttctcattggtttcaaagaacttatttatttccaccttaattttgttatttacccagtaaacattccacatgaagttattcagtttccatgtagttgtgcaattttgagtgagtttcttaatcctgagttctaatttgatgacagtgtcgtctgacagactgttatgatttccattcttttgcatttgctgaggagtgttttacttccaattttgtggtcaattttagaataagtgcgatgtggtgctcagaaaaatgtatattctgttgatttggggtggagaattctgtagatatctattaggtccgcttggtctagagctgagttcaagtcctgaatatccttgttaattttctgtcttgttgatctgtctgatattgacagtggggtgttaaagtctcccactattattgtatgggagtctaagtctctttgtaggtctctaagaacttgtgttatgaatctgggtgctcctatgttgggtgcatatatatttaggatagttagctcttcttgttgaattgatccctttaccattatgtaatgcccatctttgacttttttgatctttgttggtttaaagtctgttttatcagagactaggattgccacccctgcttttttttgctttccatttgcttggtaaatattcccccatctctttattttgagcctgtctgtgtctttgcacatgagatgggtcttctgaatatagtacactgataggtcttgactctttatccaatttgccagtctgtgtcttttaattcgggcatttagcctgtttacatttaaggttaatattgttacgtgtgaatttgatcctgtcgttatgatgctagctggttcttttgcccattagttaatgcagcattttcatagtgttgatggtctttacaatttggtatgtttttgcagtggctggtaccagtttttcctctccatatttagtgcttccttcaggagctcttttagggcaggtctggtggtgacaaaatccctcggcgatggcttgtctgtaaaggattttatttctcctttgcttataaatcttagtttggctggatatgaaattctggttgaaaattcttttctttaagaatgttgaatattggcccccactctcttctggcttgtagggtttcctcagagagatccgctgttagtctgatgtgcttccctttgtgggtaacccgacctttcactcatgatttggctctctgtttgtctgttattggtgtataagaatgcttgtgatttttgcacattgattttgtatcctgagactttgctgaaggtgcttattagcttaatgagattttgggctgagacaatgggtttttctagatatgcaatgatgtcatctgcaaacggacaatttgacttcctcttttcctaactgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtgtgtcatagatagctcttatcattttgagatacgtcccatcaatacctaatttattgagagtttttagcatgaagtgttgttgaattttgtcaaaggccttttctgcatctattgagataatcatgtggtttttatctttggttctgtttatatgctggattacatttattgatttacgtatattgaaccagccttgcatcccagggatggagcccacttgatcatggtggataagctttttgatgtgccacttgattcggtttgccagtattttattcaggatttttgcatcagtgttcaccaaggatattggtctaaaattctcttttttggttgtgtctctgcccggctttggtatcaggatgatgctggcctcataaaatgagttagggaggattccgtctttttctattgattggaatagtttcagaaggaacggtaccagttcctccttgtacctctggtagaattcagctgtgaatccatctggtcctggactctttttgattggtaagctattgattattgccacaatttcagagcctgttattggtctattcagagattcaacttcttcctggtttagtcttgggagggtgtacgtgtcgaggaatttatccatttcttctagattttctagtttatttgtgtagaggtatttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcctggattcattaattttttgaagggttttttgtgtctctatttccttcagttgtgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccggagattctggtatgttgtgtctttgttctcgttggtttcaaagaacatctttatttctgccttcatttcgttatgtacccagcagtcattcaggagcaggtttttcagtttccatgtagttgagtgattttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtgaagagttctgttgatgtctattaggtctgcttggtgcagagctcagttcaattcccaggtatccttgttaactttctgtctcgttgatctgtctaatgttgacagtggggtgttaaagtctcccattattattgtgtgggagtctaagtctcttggtaggtcactcaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttctgttttgagcctatgtgtgtctctgcaggtgagatgcgtttcttgaatacagcacactgataggtcttgactctttatccaatttgcaagtctgtgtcttttaattggagcatttattccatttacatttaaagttaatattgttatgtgtgaatttgatcctgtcattatgatgttaggtggttattttgctcgttagttgatgcagttttttcctagactcgatggtctttacaatttggcatggttttgcagtggctggtaccggttgttcctttccatgtttagcgcttccttcaggagctcttttaaggcaggcctggtggtgacaaaatctctcagcatttgtttgtctgtaaagtattttatttctccttcacgtatgaagcttagtttggctggatatgaaattctgggttaaaaattcttttctttaagaatgttgaatatcggcccccactctcttctagcttgtagactttctgccgagagatccactgttagtctgttgggcttccctttgtgggtatccctacctttctctctggctgcccttaacattttttccttcatttccactgtggtcattctgacaattatgtgtcttggagctccatccagttttgttcccttgctggcaaggagttgtgatcctttggaggagaagaggtgttctggtttttggaattttcagcctttttccgctggtttttcctcatcttcatggatttatctatctgtggtctttgatgttggtaacctttggatggcgtttttgcgtggatgtcctttttgttgatgttgatgctgttcctttctgtttgttagttttcctctaacaggcccctctgctacaggtctgctggagtttgctggaggtccattccagaccttgtttgcctgcgtatcaccagcataggcttcagaacagcaagattgcttcctgttccttcctctggaggctttgtcctagagaggcactcgccagatgccagccggagctctcctatatgagatgtctgtcgacccctgctgggaggtgtccccagtcaggaggcacaggggtctggaacccacttgaggtggcagtctgtcccttagcagaactcaagcacagtgatgagagatctgctgctctctttacagccggcaggcaggagtgtttaagtctgctgaaggtgtgcccacagcctccccttcccccaggtgctctgtcccagggagatgggagttttatctctaaggtcctgactggggctgctgcctttctttcagagaagccctgcctagagaggaggaatctagagaggctgtctggctacagtatcttttctgagctggggtgggctctgcccagttcgaacttcccagaggctttgtttacactgtgaggggaaaaccgcctactccagcctcagtaatggtggacgcccctcccccaaccaagctggagtaacccagggcaacttcagactgctatgctggcagtgagaatttcaagacagcagatcttagcttgctgggctccatgggggtgggatctgctgagctagaccacttggctccctggcttcagccccctttccaggggagtgtatggttctggcattccaggtgccactggggtattaaaaaaaactcctgcagctagcttggtgtctgctcaaatggccacccagttttgtgcttgaaacccagggccttggtggtgtaggcatccgagggaatgtcctggtctgtgggttgcaaagaccatgggaaaagtgtcatatctgggccagattgcattgttcctcatggcttcccttggctaggggagggagttccctgaccccttcacttcccttgtgaggtgacaccccaccctgcttcaggttgcccccgtacccactgtctaaccagtctcaatgagatgagctggtacctgtgttggaaacgcagaaatcacccgccttctgcgttgatctagctgggagctgcagactggagctgtttctatttgttcatcttgccagccctatgtatcatattttgaacaatatctgattactttcatttaaatgttttctgcattgtgttcagtgtttgagggaagaagctatctcatattttctttgtcctagagagccaagtgtagtactagtaacattgtgtcaatataattagctctgtgaatttgacttgatgaaaatgagtatgttagttcagatcctctgagaagcctgtcaccaagacaggattaagtgtgtaagaaatgtattatgggaaatggttgtaagagaaaatagggaaggagctgggagagtctcggagagccattggatcacaacccaagtctgactccaagggaagaagaaaggaaagttaggtgcaaatattgtagatgtagtttgtttctaaggaacatttgaaaagaccaatggtgagtcgtcagccaaagttactaattaggtcccatttcctcagaagctggcccaccttaatattcctgctgtgctcagtcacagctcctgggaacctcatgggaactatggccttggtacaaacgcaggaatgattttacagcatagcagtcagttgggccctcgttcaattacagcctcttctgttggagacctaatgtgtatttttatggccagaatacagatattttagatgaaaatttaatgcatataaaccctaaaagagcattctatttctatcacttacttcttctgtgaagtacttttattcataaaaacttttcaggctacattccttagggcaaggctatagcttttcttcattttgtatagttcatgagtggtgtcctgtattagaccctatttaaaaatcaaaagtccaagaatgtaaactaaacactctgagtaatttaccatattcagttagtagtttacttgtaatgaggacattacaatttttttaaaaaaaatatggtgttctagttgttttacatttctgtgtctttaaaaaaagtatgtgaattcacttttaaattgttgccaaagggctttttttctttgcaatgttacataaaaggaaacttacatataggaattttgccagctatgttagataagaaaattgctttgtgagtgtatatttgtgagtacatctagttttctacatttattgtctccagtgtttatttcacatcactgaatctatttttagagcttatgttgatactctcctttttccccagcatataggacaaatgtaataaccttttttaaactcattttttatgattagattcaacagagaaaatgatactgttaaatttatatatacatatatttccagatttctgtgtatttttaacaacctcaaactcataaaagctacaagttcagaattttgttttcctaaactgtttgagagtgatttgctaacataatgcctcatcacccctttaggatgtttttcttataaacaagggtattcttctacataatcataatgcaacatccaaatcagtactacctaatctatagacatcattcagtttttactaatcatccaaatgttcttgatagattagaaaaaggatccagttcagaatctcttatttcattaagttgtcatgtctgtaattcccttcaacctggaaccatttcttactctttcattcactttcttgaccttgatgctttcgaagattacaggccatttttttgaatatccctcaatttgggcatgtctaatgttttgtcatggttagattcaggttatacatctttggcaggaacaacacggaaagaataatctgttcttatttcttccactcaggtaatatgtatgcagtttcattttttcccattattggtgatgattagtgtgatcacattaataaggtgtgtctaccaggctactccacgatgaaattactcttttccccattgtaattaataggtattttgtgtagagatacttcataactatttaattgccccatttctcatcagactttcaatttattagtttatttatatgttatatcaatatggactcatgaattctcattttattcaatggattgtatttccttgctatcattatttgttttggtgttcaaattgtccccatattgtccagtgggaagacttcaagctggtttctgtgtccttttaatatattccatcatcctttgagccttgcctttctttatggttcagaaagatgttccaggcttatgtctctgtcccagctctagaattagatctttctccaaagagccttgtttcctttagtcaaaatattaagaaaccaagatctgcttggtaaatatgtttattgttatagagttgtcattgcttacaagtcatctcattgtatagaactaaggaatctatatgtatatacatatatgcatgtgtgtgtgcatacaaacatgtatttatgcccatttttttttattaatacataattcacataacattcacccctttaaagtgtacaattcaggctgggcatagtggcttacgcctgtaatcccagcactttgggaggccacggcgggtggatgacctgaggtcaggagttcgagaccagcctgttccaacatggtgaaactccgtctctactaaaaatacaaaaattatccaggcatagtggtgggtgcctgtaatcccagctatttggaaggctgaggcaggagaatcacttaaacctgggaggcagaggttgcagagagccgagatcatgccactgccctccagcctgggcaacagagtgagactccttctcaataaatagaatagaatagaataaatgtacaattcattgagttttagaatttacagagttgtgcaaccattactactgtttaatttcagaacatttccatcagtccaaaaagaaaccttatacccattagaaatcaatcaccctttattacccctgccctcagcccttggcaatcattaacctatattctgtttttatggatttgtctggtgatattattgtttgttgtggcagttgtttgattggttactgacttttgtgaactaattctgtagagtttgtattctttgtcatgtctgtccactgaaatctctgcttggtggtcagctaatgattgaatagacatgtccttaaatttctggaaccagtaagtctaccagtctttgccaaggagttctgtgtgtgtttgaacatgcgtttgtattactcaaccattcatttgaaaactctgtcttgctttcacctcctgcttgtatagaacttcaaagtcagccaaaggcaagagtgtagagccttctcaggactttcctaatgcacaaagccttgagcatgtacatagccctgcacatgagcattgctctctaagttctcagaaatatatctgagtctttcaaagcctttatggatgtctcattccccagcatttccttttaagctttttgattagtgtatttgccacaattttttattgtgtatagttagggttacatagtggtattttgatacatacaatgtaaaatactcagatcaaggtaattagcatttccatctgaaatatttatcatttctttgtgttgagaatattcaatatcttccttccagctatttgaaactattattgttagctatagtcatcctacagtgctatagaacactagaacttatttctcccatttagctgtaattttgtacactttaacaaatctttctctccacccccttctctctacccttccaagcttctagtatcctctattctacttctttcttctatgagatcaacttttttagcttctgcatatgaatgagaacatgcagtatttaactttctgttcctggcttattttatttaacataatgtcctcctttttcatgttgccataaatgacaggatttcattcttttttgtggcttaaagtattccatttggtatatataccacattttctttatccattcatctgttgttggacacttgggttgatttcttatcttggctattgtaaatgctgcagtgaataaaggagtgcagatatcccttcaacatcttgatttccttttctttggataaattcccagtagtgggattgctggatcatatggtagttctatttgtagtttttttaggaaactccatactgcttgtgtagtcgtttgccccaatttgtatctaccttctcagacagccacaaaattaaacagttgcctgtaactgcttttgacaaatgcccccaggaaaaaggcttttcatattgggtgagtcttgcaagtggagtgttccagggaaccaccattcaggtcaaataatgataattctctgggaataaggctttgcatttcactgtctctgatgtctgccagactgcttgtcattgcaaatgcaagctgttagttttcaaggttatcatggagctggagggtgggagatgggaccaaagcaagttaaaaacgccacaaagctccctgttcttaccaagattcagttatttttctggaataattaccctccaggcagctgcaggtatttggtcaatttctagagttctgaaaaagttgattctgattatttttgtgatatttcctgctattgtggaggagctaatttttggtgattcttgctctgcctttttgctgatgtcactgcccatatttttttctatatataaccatttgtgttgaaaactagggattcatagcagtatttccaattccaatccaacagcagaagattaatctagtgttctcccttcctatatttgtaactaacttctctgacagggagaaatgtagctcccattatccttaatatatttatctttttgagcagtatctctctatatatccaatctctcattactgctgccagttctcttgtgtgcaaataccctccttaccatagtaagctctaacaccctgtgccaggatgtcaccctaggtgaactcctccttatcttgtcatacattgattctccattcttggccacccacatccccacctgggtgggcttgtcattttttttagggtctgacactccacaccaggccacccctgtgtgaatgttctatcttgctctgcctaatggtttcaggaagggaacaggaagcttaattactttttaaagatgaattttattaccctttccgttcttcatgagttttacttatgagagtttgcaaagatatgttagacctaaatcagtatctctggcttcaagaatggaaggaaggtacacaaaactggtaaacaaattgatttttgttttaggcacctgtaaagaaaaactgattattttcaagaaggaagtgaatctaagaatccataagaattttagcaatgagtaagaccctatccaggcagctccatattcattcctgacgataaatcaaatgggttatttgaaagaaagacatagtaattttccttgacatcagccagtcattactgccatttagtcagcacatccctgtgtgctaggcattgtgtttaatccttaagtttgtatggtggtttctatttttacctgtgtgttaccgatgaagatacctgctttactttaccaaaaaaaaaaaaaaaaaatcctcaaaagattgatctatagttgctgttactgattcctctcttcttactttttattaaacccttttcatttaggatttcacctataccacttttctgaaaatggtgtggtcagaacacaaatgtattccatatcataactctaattattaaatctcagtcttcttcctccagacctgtcagcaccatcgtgcactgttgatcactcccttgttcttcaagcactttcttcacttggcttctactactttttttcttgcagtcacttttgctcatgctttctctttttctcaacttcttcatttcagtctttggacatctgttttctatctacatttattgcattggtagcctcattcagtctcatggctttaaataccatgcattcattgataatttccaaatttatatatctgaccccaaccaattccttgtacttcaaacttatatattcaattgcctatttgatttctcctctagagctctaacagatatctcaaatacagcctatgtaaaacagaatgtttgatctttctcacaaaagctgctcacccgtagtttttttttcccatctcagctaacagtaactccattctttcaattcttcagtctacaaacattgaatcatccttgctgctagtttcttcctcttacactacatgttgagtaggtaatacctgttgtctaccaccagaacagcaatcccaggatattaacccacaacacggtttgcaggtattagggttgccaagaaaaacatgactcacagaggcactggatggaacaacactgtactcacatacagaagagacagaacaacagtatcagtaataagtgtcagtggatcttgtctcacagccatggcagggaatgatctgtatacaccccttttgtgctgcaagtgaaggaccttgttcgctctccaccagggacagaaatagcagtggggtaagccaggcgccatatgacacacacttaagcagaacaaagaagtataaatcaaactcagaagagggaaagaaattcctaaacaaggtaataataagcccagcacagactgtgagggctcctgttcttcatgtaagaaactattccaggcccaaggcatattcttttgcaaccatggaatggtcaacaggttgcacacgattcccttgcccagcaccacacaaccagttttttaggaaatcttactgactccaccttcaaaacatagccagaatcttattatttcttgccacttcactgtaactaccctggtctaaactaacatatctcctacctggtcaccttgcttccagtgggtttctttttcatttagtattaaagcctacattcttacggtgatttaccaggctgtaaactccacatatgactattctctctatcatgcattctgtcccagccacactgccagccttgctcacacttcagagcccttgccctggctgttctctctgcctggaacacttatccaagaaatctacatggcttgttttttaacctctctgaatcccttgctcaagtgttactttcttaatatggcctgccttaaccactcttttaaattggaacctcttcttagctcagcattcctcagcccttttctctgctttgtcaccgttgcacttattgccttcaaagatactatatacattatttatttattatggccattgtctatcatcttccactagaaaataagctatatgagagcaattttttgtccattttattcattgcttaccctagtcttccacatgatagataataaatatgtgttgcctcagggaaagaaatgaaagtttagggaagttaagtgattctagtaaatggcagagctggaatttgagatgtttggcattcagaactactattagaaaacttttaagtaaattttttaacaaacagtgattttaaagtactatcaactagttactgttctgggctgtatattaaggggccaattttgtgatctaggctaatctaagaacctcataaccatattgattttataggaaaatacatgctgagtttgaaagaaaaactagtaaagaacttttagaaaatgatctgttcatcactgtggactacttgtactgaatactaaaggagtaagaaaacatgtagttgataatgattctaaacgcttgaggaaaaaagaacatgaggaatattgggtactgaaaaattttaataaaaatatttatttagagtcaattttttaaatgtaaaattgtagtctgggaatatacctacattaatattttactgacttaatttttccaatgcttgtgggccttcctaaaactaataattcattattataatcaatagcaatttcagttttattaattaaaaatattttgttatgatttttataggctaatgcagcaataaactcttttggtttagttttggatatggctgtgtgtgtgtgtctagtaagatataccattatgcatcctgtaacgacatttcagtcaacaatggactgcatttacaatggtggtcccataagattataatggagctgaaaaactcctatcacccagtgacatcatagcatcataacattatagcgcaacacattactcacctatttgtgttgatgctggtataaaacctactgtgctgccaggtgtataaaggtatatagcatatacaattatgtacagtaaataacacttgataaggatagtaaacaactatattactagtttatgtgtttactatactgtgctttttaattattattttaggatgtatttcttctacttataaaataaccataaaacagcctgaggtaggtcgttcaggaggtatccagaagaaggcttttcttttctttttttttttttttttttgagttggagtctggctctgtcgcccaggctgtagtgcaatgtcgcagtctctgctcactgcaacctccgcctcctgggttcatgcaattttcctgcctcaacctcccaagtagctgggattacagatgtgtaccaccacgcccaactaatttttgtatttgtagtagagacggggtttcaccatgttagtcaggctgatcttgaactcctgacctcaagtgatccatccgccttggcctcccaaaatgctgggattacaggcgtgagccaccgcgcctggcctggttgtttgtttgtttgtttgtttgtttttgaaacagagtcgcactctgtcgcccaggctggagtgcagtggcgcaatctcggctcactgcaaaactccacctcccaggctcaagtgattatcttgcctcagcctcccaccaccacacctggctaatttttgtatttttagtagagatggggtttcaccatgttggccaggctggtctcgaactcctgacctcaaatgatctgcctgccttggcctcccaaagtgctgggattacaggcattagccactgtgcccggccaagaaggcatttttaccactggagataacatctccatgcatatttttgtccctgaagaccttcagtgggacaagatgtgaaggtggaagatggtgatattgatgattccgaccctgtataggcctagcctaatgtgggtgtttgtgtcttcattttaaataaaacagcttaaaaagtaaaaacaaataaatgaaaaaattttaagtagaaaaatgttatagaacaaggatataaagaaagaaaatattaaaatatttctgtatagctgtacaatgtagttttaagcaaagtattattacaaaagttaacaggttttaaaaattaaaaataaagttacagtaagctaagattttgtcattgaagaaaaatattttaaaataaatttattgtagcctaagcgtacagtatttataaaggctgcattagtgtacagtaatgttccagaccttcacattcacccacctctcactcactgactcacccagagcaacttccagtcctgccagctgcattctcagtaagtgccctatacaggtgtgccatttttaatctttcataccacatttttactgtaccgtttctatgtttagacactcaaataattatcatactgttgtataaaactatagcacatacatggtttcttgtagcagcccagtaaagaattgcctactattcagtccataagactaaatagtatatactgtaacatgctgtacaagtttgtagctgagaagcaacgagctataccatatagcctacatgtgtaataagctgtatcacctgagtttatgtaagtactctctatgatgtttgcacaacaacaaaattgcctaatgacatgtttcttagaacgtattcctgtcgttaaggaaggggaatgcctgtgcatatatgtatatatactcacatacacacacgtggttgatcctcattatttacagattctgtatttgcaaattcacctacttgcttaaatttatttgtaaccacaaaatcaatattctcaatacttttatggttattcactgatatgtgaatatgcagtgtcaaaaaatttgagtcacctgatgcacacatttcaagttcaggtggaacaagttgatgctctgccttcttatttcatctctcatactgtaaacaagtattctcctgctatatacttattgtcatgtgttttgcatttttgtgcttcttgatgatttttctgtttgaaatgttccctaggtgcagtgctgaaatgctgtctagtgtttctagggactcagaggctgtgatgtgccttgcaaaaaaaatacacattacgtaagcttcattgaggcatgaattacagtaatgttggccatgagttcaatattaatgaaacaacaatatatattaaataaggtatctttaaacagaaatacacttaaaacaactttgtgtattgattagttgctgaaaatgttgtgaccaggggttctcaggagcctagccgtctattatcccctaggtgtagtaattcagtgtttgcttattcagtgttggggcacctttatagaacataagtattaagaatgatgacaattgactatatatatttgtacacagtttgcacaatttgtgtactttgtacaattatccccaagaagaatagttgtcatttgttaactacttcactatttgaatcttacattaacctccaatgaagccttgagatgtgtcttcaatatatttatattctggagaaatcacccaaattgaaatcttaacacaaaccattgaatggatgattactagtgagtaattttcaaaatattttaactaattttttaaattgtgtaatatacattcaaatgaataaaaataatgtattatttgaaaaagtaacagaagtaacatccttgaacctacaacttaggaaatattaccaatattttttaataccttccaggtgctcctcttagatctagtctttccctaccagagtaaaacactctagtgaattttgtgattatggttctttctctctctctctctttctttctttctttctgctttctttttttttttttttttttttgacagagttttcactcttgttgcccaggctggagtgcaatggtgtgatcttggctcaccgcaacctctgcctcccgggttcaagcgtttctcctgcctcagcctcccaagtagctgggattacaggcatgtgccaccacacctggctaattttgtatttttagtagagacagggtttctccatgttggtcaggctggtctcaacctcccgacctcaggtgatccgttcgcctcagcttcccaaagtgctgggattacaggcatgagccactgcccagccgacgatggttatttctctacattctttaaagtcatttttctgattggtttatgaatagtcatgaaatgcagattaaaaagaagaattggcattttatagttaggttttatagtcactcacctgaatgtcatgagatccagagaccaaatagtgacagtggctaagtgcctgggctctggagctggactgccagagtttgaattctagctctgctgcattctaactggaacaaattatttaacctaccttgaataaattatttaattttttagtgccttagtctgcctgcctgcctgcctgccttccttccttccttcttttcctttccttcttccttttcttttcctttcctttctttctttcttttcttttcctttcttgtctgcctcgcctcgccccgccccgccccgccccgcctcgccttgcctctttcctttcctttctttcctcttgctctgttgcccatgctggagtgcagtggcatgatctcagctcaccgtaacctctgcctcctggattcaagcaattctcctgccttagcctcccaagtagctgggattataggcgtgcaccactgtgcccagctaattttgtatttttagtagagacggagttttaccatgttggccatgtttggccaggctggtcttgaactcctgacctcaggtgatccgcctgccttggcctcccaaagtgctgggattactggcgtgagccactgtgcccagccttagcttctttatctataaaattgaggataataagagtacttactcccagaggggtgttacaattattaaataaattaatatatgtaaataaatggaacagtagagtagtagtaactaataaataaatgttagttatttaacaggtagagaaattaatgcaaagaattctttgaaagccacttgtattcttgcgtactatattaagtaatctttctttaaatgtttctgtaatttcttttaaacaactagtatcatgatttttgtcactctgtgacctctttttattcagctaattgtgggactactgaaaattaggctttccttggtatctctttgtgtctcccagcttatgtgagaacagatctcttcttagtttgcaaataaatttattccacatattttttacttggttgttcccctgacatactcatttaagggctactgctgccaaaaatgataatccaaaggctaatttatgtgttttagcctcatgttggtagaagttctttgtaggttatagatgaaacagtttgtctaataaatggcaaattgctattacgtaaatatcaagctcctgtttaagtaaaaaggaggtctgtgttagtgttgtctcttctcagcgttgctattcaatctgtactgaaaaaatcgtgacagttcaatatttacattagaaattggagaaacatgtgtcagagttaaaactgatgaactttgccactgtttatcaatagcaagtaaactggcaaatatgtcagtatgttagcagtaccaagaagctaaatgggaatattttagaagtttgacccattgttgcactctcacatggcagcctctttatcttgttagagaacatcctttgatttcccttttcattctttctgtgagtctgagctttcctttttacctataaatgtgcttatcttatcaaatagtactgcatgttgcccattcctgggacaaaagagaaataccatcctgtatttcttatagcaacccaggtaaggtttgtgtgtgagggagcattttggagaaaagagaattgtaaataaatgggtataatctagttggaaaactaaaaactttctttaataattttaaggtaggtcaagagcagtagtagtcattgtgtatttcaggttaaccaagaaactcctactgccctgtgaaaatttattttcaatgttagcattcctatcaatggataacagttacaaggcaaaaaaaaaaaaaaaaagtcaagtattttccatatttattttattaaggagaacttacattatgtataaatgttagcaccagaaatattaagcctatcaactctctgtgtttcctaagttttatcctgtggtcagcatgataattaatatgttacataatgaaattaaaagtcctcctttctaagcccagaagacagaaaatgaaaaggattaagcctcccttgatcagattgttatttttccttttgaggataggatatcctccatctctattgaaacccaaggcaaatcagaacataggtacccccatctccatggacacaaacacaaatatctaagaagcataattcaacagagagagaatctaagtgatataatgaaggtaataagggtatgggctttatgttggaacagacttgggttcaaatggtgattctaccatttattagctatatgaccttgcccaagttaggtaccttccctaaacctatttgcatctcataggacttgtgagattaaatgagaacatagaaaagaacttagcattccatctggcacataataaatatgtcaagttctttcatgcctttgtacatgcccttttttctgcagcatgcctgaataatttctatagtcttccttcaaaaacaggtggtcaagtttgcagcacttctggtcatgccatcttctatgaaattaagacaacatcaccttgtctgtgatgccttccttgcctttaactctatttcctgtgctatgacctggttatttactctttctctctgagcttccatgtatcttctatatatctctcactgtgcactatttcattgtacatgttgacctcctccacagggctaaatgctggggagcatggactatgtcttttcaactttgtatatgccttactaagcacagtgtttgatatacgataggtgctcagtaaatactcaattgctgagtgaaggtatattactcttgggagcacaggcagaaaagtagtctgtagtccagagcaggaggagggactgggtacaaccaaagatttttttccccaaaactgttattatgaaaattttcaaatatacaaaataattgaaagaattacaaggtaaacatccaaaaacctgccacctagattctagaattagcattttgtgagaatatactatattgccattaattgtaggcatcatgctgtacagtagacctgttagcttattccacctatctaactataattatgtatcctttgaccaacatctcagcactcccttcctcctgaccaccacagcctctggtgaccaccattctactttctaattcaatgaggtcaacttttttttagggtctgcatatgagtaagatcatgtggtatttgtttttctatgcctggcatacttcccttaatgtaatatcttttagtttcatccatgttgttgaaaatgacaggattgtcttttttatggctgagtagtattccattgtatatatatacaccacattttctttatccattgatctgctgttagactcttaggttgattctgtatcttggctattgggaatagtgttataataaacatgggagtgcagctctctctttagtatattgatttaatttcttttgtatatatacccagtagtgggattgttggatcatatggtagttcgaattttaattttttgaggaacattcatactgttttgaatatggttttactaatttacgttcccaccaacaacgtgcaagggtttctttttctccacattcttgccaacagttgttatcttttgtcttttgataatagctattctaacaggagttaggtgatatctcattgtggttttgatttgcatttccaggacaattagtgacacattttttcatattcctgttggccatttgtacgtcttcttttaaggcatgtctattcacatcttttgctcattttaaattgggttgtttgttttcttgctattgatttgagttcctcatataattttcattgttaacccctcatcagatgttttattagttcgttttcacactgctataaagaactgcctgagactgggtaatttataaaggaaagaggtttaattgactcacagttcagcatggtggggaggtgtcaggaaatttacagtcatggtggaaggcaaaggggaagcaaggcaccttcttcacagggcggcaagaaggagaatgaatgcaggaggaactaccaaacacttataaaactatcagttctcatgagaactcactcactatcatgagaaaagcatgggggaaaccgcttccctgattcagttaccttcacctggtctctcccttggcacgtggggattttggggattgcaattcaagatgagattttaggtggggacacagccaaatcatattagatgtatagtttgcaaataatttatcccattttgtaggttgtctcttcactctgttggttgttttctttgctatgcagaagctttttagtttgatgcaatcacatttgtctatttttacttttgttgtctgtgcctttgaagtcatatccaaaaaatcattgcccagaccaatgtccttgagcgttttctctttattttcttctggtagtttcatagtttcaagtcttaacatctttaatccatttagagtttatttttgcaaatggtgagagataagggtctagctttattattctgcatgtggatatgcagtcttctcagaaccatgtattgaagagactgttctttccacattgtatgttcttagtacctttgttgaaaatcagttggctgtaaatgtgtgaatttatttccaggccctctattctgtttcttgggtctagctttctgtttttatgccaatcccatgctgtttgggttactatagctttgtagtgtattttgaagccaagtcatgtgatgcttccagctttgttctttttgctgaagattgttttggctattcaaggtcttttgtggttcaatataaatcttaaagatttatttttctatttttgtaaataatgtcattggtatttttatggggattccattgaatacatgggtcactttggactatatgggcattttaacaatattaattttttcagtccatgaacatgggatatctttccatttatttgtgtcttcaatttatttcatcaatatattacagtttttaatatacagatctttcacttccttggttaaatttattcctaaatgtttttatagctactttattttttattttttatttttaaattttgtgggtacatagtgggtgtatatatttatgggatacatgagatgttttgatgtgggcatgcaatatgaaataatcacatcatggagaatggggtattcatgctcagaagcatttatactttgtgttgtaaacaatccaattacacccttttagttattttaaaatgtacagttaagttattattaactatagtcaccctgttatgctatcaaatagtaggtcttactcattctttcttctttttttccgattaatcatccccaccttttctctgcattctcccaacaactacccttttcagcctctggtaaccatccttctattctgtatgtccatgaattcagttgttttgatttttagatatcacaaataagtgagaaaatgtgatgtttgtctttctgtgcctggcttatttcacttaacataatgatctccagttccatccatgttgttgcaattgataggatattttttaaggctgaatagtactccattgtttatgtgtaccacatattctttttccattcatctgttgatggactctgtgttgcttccaagtcttggctaatatgaacagtgctataacaaacatggtagtgcagatatctcttcaatatactcatttcctttcttttggttatacctagcaatgggattgctggatcatatggtagttccatttttagtgttttgaggagcctccaaacagttctccatagtggttgtactaatttacgttcccaccaacagtgtataaaggtacccttttctccacattcttgccagcatttgttattgcctgtctttcagatataaacctgtagatgttttaaatggaattgttttcatgattcttttttcaaatagttcaccgttagtgcatagaaatgctactaacacacttttataagttgattttgtattctgcaactttactaaattcatttattagttctaagatttttggtacagtctttagggttttccatatataaaatgatgtcaactgcagacagggacaattcggtttcttcctttccaatttggatgccttttatttctttcttttgccaaatttctctggctaagacttccagtactgtgttgaatagaagtgagaatggacatccatatcttgttccagttcagcttttcctcattcagcatgatgttagctatgggtttgtcatatatggccattactgttttgaggtacatttcttttacatctaatttgagagttttaaatcatgaagtgatgtggaattttgtcaaatgattttaatgcatttattgaaatgactttgacttttatcatttcttcttctaatgtgatgtatcacatttattgatttacatatagtgaatcatccttgcatccctgggattaattacttgattgtggttgatgatcttttcgatgtggtgttctatttggcttattagtattttgttgaggatatttgcatgtatgttcatcatagatgttggcctgtagttttctttttttgttgtacctttgtctggttttggtatcagagtaatgctggtctagcagaatgagtttggaagtaattcttcctcttcaattatttggaagagtttgagaagaattggtgttagtgttttaaatatttggtagaattcagctatatttttaaatatttggtagttttttaactatctggctttttgttgataggagactttttattactgattcagtcgtctccttactcatctacatgaagaaatagatgagtaaggagactgaatcagtaatatttcatccttgatcagttgcatatgtacacagatttatccattctaagttatctaattcgttggcatataattgttcataataatttcttatgatcctttaatttctgtagtatcagttgtaatgtctccttttttatctctgattttgagtcttctctcactttttcttagtctaggtgtttattttatgttttcaaatgaacaactcatttcattgattttttttttcctttctttttttttttttttttgatatggagtctccctttgtcacccaggctggagtgcagtggctcaatctctgctcactgcaacctctgcctcccgggttcaagcgattctcctgcctcagcctcctgagtagctgggattacaggtttttgtttgttttgttttgtttttactttccattccatttatttttggtctgatctttattttctttcttctgctaattttgggctgagtttgtctttgtttttctaattctttgagatccaagattaggttttttatttgcaacctgtcttctttgtaggcatttattgctgtaattttccctctcaaactgcttttgctgcatcccataggttttggtatgttgtattttcattttcatttttctcaaaaaaattttaaattttatttataattttttcattgacttattgattgttcaggagcatgctgtttaatttccatgtacatgtgaatttttaaacgttcctcctgttactgatttctagttttatactacggttggagatttacagttttaaggaatcctgcacttagacatctttcatgggaaaggggaagccttgagaatatacttatcattcatgtaacatgctttgtcatgaacaaatctcagagttcctagttcatggaaaaggaacatacaggctactgtattcaggaatattccaaatagggataggattcgaacttttccataatttctttccttttttctttctgtattctctctttatcctacttccaacccctaatacatacacacataagagtgtatgagggttccctttcctccacatccatgagctcacatacacccatagctctagataaaagtacaaattaagcaatcaaatataactatataaattaaataaaattaaataagtaaaaggatactaattgatctttcaagattaggcagaggtctggaaactgatgataatgaagaaaaggtcatttcacattcattagataacgattcccatgatctaatttttctctcatttgaacagagagtgataatatcattagcagaaaaagttaaaggagaacaatggaccataatatgatttttttttagactgagtgattgcctttctatttactaaaagatctgaaagagtttacaaaattaaaacacatgtaaaaatagataaacgcagtgaccaagatgctatcaggtacctgagatgagctattttctacagttgagtaacgaatttgattattaatttctgctaatgaaagcaaaaagaaaatgctaaattacatatttctcttcttaatgcattctttttaaaaaataaggtcacaattttttttatttttcaggcatagaattggaaaaacataaccagagatacatggttatactaggtatgggaatttggagtaatattgtagacagtgacttcattgtgcttttataaaagatgcatatgtggtacctaaatcaaaattcttatatggactggggttctagagttgagcatgctgaagtctgaaaggctgaatatgtaatgtcaaatgctaactcaataaagatagttctgtggaatatggtactttgctacctcattatttagcttcacacagagataatatttaaagaatgtagaagtatttgtcatcaataaatcccatagtatgtcttcctcaaggaaaatgagcaaaggatgacttttactgcatataaattatacctccataaacatgatttgtaataaaataaattgtttttgagtgttcagagtttttttttttcttttttttttctttttttaaaattattattatactttaagttttagggtacatgtgcacaatgtacaggttagttacatatgtatacatgtgccatgctggtgtgctgcacccattaactcgtcatttagcattaggtgtatctcctaatgctatccttcccccctccccccaccccacaacagtccccagagtgtgatgttccccttcctgtgtccatgtgttctcattgttcaattcccatctatgagtggaacatgtggtgtttggttttttgtccttgcgatagtttactgagaatgatgatttccaatttcatccatgtccctacaaagggcatgaactcatcattttttatggctgcatagtattccatggtgtatatgtgccacattttcttaatccagtctatcattattggacatttgggttggttccaagtctttgctattgtgaatagtgccgcaataaacatacgtgtgcacgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctaactttttaatgatcgccattctaactggtttgagatggtatctcattgtggttttgatttgcatttctctgatggccagtgatgatgagcatgttttcatgtgtctgttggctgcataaatgtcttcttttgagaagtgtctgttcatgtccttcacccactttttgatggggttgtttgttttttacttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtctttgcccatgcctatgacctgaatggtaatgcctaggttttcttctagggtttttatggttttaggtctaacatttaagtctttaatccatcttgaattaatttttgtataaggtgtaaggaagggatccagtttcagctttctgcatatggctagccagttttcccagcaccatttattaaatagggaatcctttccccattgcttgtttttctcagatttgtcaaagatcagatagttgtagatatgtggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggtttttaatagctgaaagactgcattgccattacctggttcttagatgtcatggaatctatgtgattcaggccacgtgctgaattataacccaaacatagtggtacttaaaagcccctgtagctctcatgcttctcctaatagaagcttttggctgaaacaagaaacgtttttgaaagaagcatattgtcattatccttttgtgaaattttaatagccagatttgtattcttattcatatgtaacaaaaaccttgctagcacagtggtgataacagaggtacctgcaagtaaaactgagggttttttttttgaagtaaaagaaagaaaaagcagctttgaagcaggtacttacacaaatactaccttgatttaccacatatctgtaatggatggcctgggagtagtgactgcagcctgaaaagtaatttagggcatggggtattaactgatgaccttatccataaaatattttagttatcctgtggaagttctgattttagttgacaaaacagaagcttctatagacctgtatattgttgagactacatatattattctaagaaggcttttgaatagatttgctgagtgtagttgatgaagatggcccttttaaatattagggaattcatactagatttactgtttcagttttttcattacagattttgagaggcttctcctggtagtaaaatgtcagatgaaactgttactgtagaattcactaggttactgattcagtttgtgagtattagaaaatgttcttccatagagattttaaatagtttttgtgacaaagcaaaaacaaagcaaactgaagttttccctggattgaagcagccgatcaaatattttaacgtttggagtttcaacttctaagtgaaaagattcctgattttaaaatataaaaggattatttgagaagcacgtactttgtgtatgaatgaagaaatgtatctattttccaatgaaagtttatattttggtgactgcttctactgaagtgatagcatggtcagtagtattccaacatctttggatactgttagcttcagccatcatatggtttgattaattgaactggtgtaatagattaatagatatggtggtatctatactaatctgattttcttttttatgttacataaaatagaatttttccttccttccttcctctttcctctcataatttgaacagatactggattcaaaaaatttatgatagcttaaaccccagggatatcattttctaaaggagtcatctgtagatggtttatgttaaagttggacaaatggatagaacatcaagattttaatatttgtttccacatttgtcccacttacggcataagtatcagggaagtggccagatggggtggctcatgcgtgtaatccaagcactctggatggctgaggcagaaggaacacttgaattcaggaatttgagaccagtctaggcaacatagtgagaccccatctctaccaaaaaaaaaaaaattatccgtgcatggtggcatgtgcctgtagccccagctatttgggaggctaaggtgggagaatcttttgagcctgggaggtggaggcttcagtgagccgacagagggagacctgtctcaaaacaaacaaacaagaatcagggaagatacatattcatttgcttttagaacttataataaaccattgataacaactcaaggattaattaggcctaacatttgagtgtatgtatagcataacacctctgttacaaattactggaggcatttgtgaattatctagttaatttcatctgaagaaagagacctaaaaaggaagctggggtagacctgcttttgccatgtaccccacttcatttcttatggctaaggttgttccacagtggtcctagtttcgaacctttgccttggtagcataaccccaaatttttctgaggctatagccttggagttggaattgcctagatcttcacagaaactattgtgctgaactctattgggttgacagagagctgggtatataccaccccactcacctatcatatttggggatgatgacagttggcaaggattggcaccattatcagtatctttaaaaggtatcaagaaattactggcaagtttatagctttaaatgcctatattagaaaagaagatagatctaagtttctatcttaacaagctagaaaatgaagagcaaattaaaacctagataaatagatggaaataaataataaagaacagaaataaatgaaatagaaaatgtatttaaaaaagaaaaagataaaaccaaaagccagatctttgaaaagattaataaaattaataaatccttaccaagactaatcaaggaaaagagaaaatataagtttaaacttttatgtatgaaagaggataaatcatatacagatattaaaaagtcaattagggactattatgaacgaatttatgtcagtaaccttaacaatttacatacaaaagagcattttttgaaaaacacaaattatttaaattgaaacaaaaagaaaatgaaaatacggatagctctatttccactaaagaaatttaattcataataaaaacctttccaaggagaatactctaggcccagatggttaaagaagaattaataccagtcttacgcaaaactctttcagaagcagagtgacagagaacactgacacacttgttttataaggccagcataaccctataccaaaatgtgtcaggcattaccaaagaagttacagaccagtattcctcataaaatattctcaaaaaacccccacaaaacaaaacaaaaaaaaaagagtaacaaacttaatacggtaatataaaggataataactcttgacccatatatacaaggttggtccagcatttgaaaatcgatatattttaaccacattaaccgaataaagagaaagtaatatgatcattatgttactggtgggtatttgttcttagagttcccaagatggtggcgggctgcttccaagatggtggcaagcctcttgttctctgacctggggttcttggcctcacggcttccaagaaatggaattttgggccatgtggtgattgttatagctctattcagctccattagaatgaaccccaggcacttagcctgcacaggaacaatggcgagcctctagcccaattgggagcggcagtgggcgccacctcactggatcaggagcacagcagacacctgccctatccggagggatggaagtcagcagtgggtgtgcgacagtggcaaacagcagtggtggatggcaagcgaaagctcagcttgagccctaacaaacacagaccagaagagtgtgcagttgcaagatttaagagagtgaaaacagagctcccatgaagtgggaggggacccaaaggggctttccattgcctgctcaaatgcctgggtttatatcccgatcattgtccctcctcctgttctctcaggcgatagatgattggctatttctttacctcctgtttttgcctaattagcattttagtgagctctctttactacctgattggtcgggtgtgcgggtgtgagctaagctgcaagccccgtgtttaaaggtggatgcagtcaccttcccagctaggcttagggattcttagtcagcctaggaaatccagctagcactgtctctcaattgcaatagacgcatgaaaggcattttataaattcagtacccatagaagataaaacatgctcagcaacgtaagaatagagagaaacttctaaacctaatgaaggatatctatggaaaatctgtagctaacattatacttcatggtgaaagacaatgtttgacttctaagatctggaagaagacaaagatgtccttcctctttgagcacttatattcaccattgtattggaatacagtgtaatatagtactggagtcagtgcagtagggcaagaaaagaaggcatatggccaaaggaagtaaaactaacattcacaaacaacatggttatgcatgtagaaaatcctaagaaataataaatggagagagatatatcaggttcatgactgttagactctatattgtgaagataccattctccaaatttacttatagattcaacacaatcccagtcaaaatcacggtaggcatttctgggaagacagtaaattaattcctaaatttatatggaaatgcaaggaatctagaataaactcttttgcaaaagatctaagttgtagaacatagacttaccaggtttttaaaacttcttatttcaaagtggattacagacctaaatgtaaatgccaaaacaaaaaaacttctaaagaaaacatgggaaaaaatattcatgacacaaaaacagggcatgtacaaacacaaatatgaaccataaaagacaaaaactattaaactgaactttttcaaaattgaaacttgctctttgaaaaacagcattaagaaaatgaaaatgcaagccatagactgggaaaacatatttgtaatatgcatgtctgacagtggacttggcaatggtcccattgtttgtgtcccctcaaaattcatatgttgaaatgctaaccaccaaggtgatactattaagagatggagcctttggtaggtgattgcatcatgagggcggagccctcatgaattggattagtgctttaataaaagaggccggaaggatcttgtttgccccttccactatgtgaggagacaatgaaaaggcacaatttctgtgaaccaggaaaccgaccctcatcagactgaattggttggtgccttgatcttggattttgtagcctccaaaactgtgagaactaaacttcttttgtttataagctaattagtctgtggtattctggttatagcatccagaatggactcagacagagttgtatacagagcatatacagaatgaagaactcgtaggaaccaacaataatgagatgaacaactcaattaaacaattgggcaggctgtaatcccagcactttggaaggctgaggtgggcggatcacttgagcctaggagctccagacctgggcaacatggcaaaaccccatccctactaaaaatagaaaaaaacttagctgggtgtggtggggcagcctgtagtcccagctactcaggaggctgaggtgggtcgatcgcttcagcctgggaggcagaggctgtagtgatcatgccaccgcacaccagcctgggtgtcagagccagaccctgcctccaaaaaaaacaaaaaacaaaaatcagcaacacataattgggcaggaacttgaacaatcacaaaagaatatgtatcaattgtctaaaagtacatgaaaacattttctataccattagccaccagggaaatgaaagtcaaaactacaggaattaattaaaaggaaaaagactgacagtatcaagtattgacaaggaagtgaagcaaggggtgctctcatatgttgctgctaggggtgtaataattgtataaccactttgggaaacaatttggcaatttcttataaagataaacttacatttaacatttgaagtttgaacctccattcctaggtatttattcaaggaaaatgaaaatctgtatccacaaacgctgtgtatatatttacagctctattcatactagctgaaagctggaaacagaggaatgaataaacagatcatggtatattcatacagtatatattcatgctactcagcaatgaaaaggaatgaactaccgatgcacacaacaacatgaaagaatctcaggaacgttatgctgagtaaaagaagctagacacaaaagactacgtattatatgagtacattattgtatgattccatctatatgaaatttttttaaatgaaaaactaatatattgtgataaaattcagatctgtggttgcctggagtggaggtgtttgaccaaagagaggcatgggggaacattctggagtgatggaaatatttataatggcagggctacataaatgccccagctcaaggaactgtacaattaaaatgtatgcctttcactgagtataaaccatacatcaataaagtttatgtttttgagtaaaagggagttccagactctgtgctctgacaactttggcacatggggaatactacacttactctccataggttaagccttcctagttatctttgataagccttgtcctagacagagacaatttttatactgacaaaatcaaaatacattctattaaattaaatggaaatctcctcactaaaatgaagtacaacacatagatggaatacatgggatgagatacatatcctggatttcagtagtattctttgagagtcttttaaaaatatatttggcaggccgggcatggtggattatgtctgtaatcctagcactttgggaggctgaggtgagaggaacacctgaggtcagcagttcaagaccagcctggccaacatggtgaaaccctgtctctactaaaactatgaaaattagctgggtgtggtggtgggcccttgtaattgcagctactcagggggctgaggcaggaaaatagcttgaacctgggaggtggaggttgcagtgagctgagatcgtgccattgcactccagcctgggagacaaagcaaaactctctctctctctctctctctctctatacatacatatatatatatacacacacacacacacacacacatacatcacaacaactaaatttttaaaaaaattctaattcagggttcagtgactggaccatgaagcctatttttgtactgccccaatgtaagaatggttttacattttaaaaagttgtttaaaaaaaaaaaaaaagtcctgtcccttaagaaaaaacaagcaaccagtactataagtgttcctcaaagtctacaatatttactatccaaacttttacagaaaaagctttctaactcctattctttaccctttgatctgcacactctacctactgtaactgattcagcctcaaaaactaacatgttgtctttttgtttgcattagagaatcctagatgtttgaagtactaattagtatacactaagcctatggccttatttcctttgctctgaaaactaagagggaatgttaagttgaatgatatgatagctactttccaaggaatgctgtatttcttacgaattggcctctttggctgtactccagatggcctggttagaatgacgttaaagctgtggaatagccaaagcacttgaaatatcagttatgtatgtagcatgaggctgtcagccattttgcaaaaagcatgggacaatgctaaatatttctggtttgccccagtggtatagattggagaaccatttttactcttcagccttcatggaaaatggcagggtagtttaaaaggtctttgagaagttttggaggttctaaaggggttttttttttttttttttttggcatggggttgtcagaatagcggatttgcacttctgtctcagcaatatcaagatttcccccttttagtgcatttgaacccacacttcaaccttagaatcttcttactctctcccaccctttgcctctgcctcctgtggcctcatacagctgatctcaaaccataatagatcttttaatattaacttaggtcctctgagcatctctttatttcaaaattttaaagatgaacctgggataaagggacatagagctgctttaggaaatacacagcctctttggggatctcactgtgctagtggtatacagattcaagttgaaagaccagtggaattgtggttgacagcccagggacaggaacaagcaggagcctggtatgagctaacatttaagttaaaatctgtgactatttacgatatttctttcttttcatcttttctctaggcctactctgtgtatgatgaagacattgggtactgtcaagggcagtcttttcttgctgctgtattactgctgcatgtaagtaatggtccgtgtgataaatagcacagtgctgccaagtttattttactttctactggctttgttcttccttcttatttcccatttatctgatggagattacatatggcatatcttttttaaaatgtacgttaggtgataaagtaagagatatgatgtcaaaaatacgacagtttctcaatggaattagttttgttggctagaaaaggataaattgcttatttggagttatttttaactagaatcctctggaattaaagaagtcggtataactgcccaaatatcaggacctggaccattaagacccactatactgtgacaaggaagtcctttatcatttctgtgatgtatttttatatatcctctttcctgtcagttaccttcatttgacagatcatttattgagcatcaattttcaggtactgggctaggaagtggggttataaagatgaatcatttataatttgtgttctcaaagacttcatagtccaggatggggcacagataatgtaggcatgaacttataatttttgttctcttttatgtgtctttatttttctgatgacaaaaataatacatactcattaaataacttacagtatgctaagtgaaagtgatacacaggttaagagaatagagaggagaattacccaaccaagctctgccagaactttcagaaaagactttctggaggaggtggcagctttgtcaagacagaaatgagattggagaaggtgagaggggaaagggagggggtaaagaattattgacaaaagtcacaatatgagaaaatgtatggaagtatgatagggcacagcatacaaagggaacaatatgaaatcacagtttactatagcaattgtacacggggagtggtatgacgtaaaaatggtaagatgggaaattgtgaagactttgtaatgtgtcaaaaatgcaggctttattctagagctaatgaggaaccattgatcactttggagcaagggaataatacagtcatatgatcattttagataaatcttttcatacctgtgtaaagggcagaattaaaggaaacagacagcagcagagagaccaggtagaaaacatcaatatggccaggcacagtggctcacacctgtaatcccaacactttgggaggttgaggcaggaggatcacttgagcccaggaatttgaaaccagcctaggcaatataatgagacaccatcactaccacacacacaaaaggtatctgggtgtgttggtgagcacctgtagtggtggtgagctacctgggaggctgaagtgggaggaccacttgagcctgggaggtcaaggctgcagtaagccttgattgcaccactgcagtccagcttgggcaatagaaggagaccctgtctcaaaaaaataataataataaaaaggaaaagaaaatgtcagtttaaatgagagatgttgagaacccagagaaaagcagaattaagaaacattcagggagcaaaattgttaggttttgtggatggattggcaaaggagcagtcaaaggtgacatatctagtttcctggctttggagactggatgaatgttgtattttgagttcagatagcaaatatatctatggagattgaatgaaggaaaaagtttaggagttgatgatgatgagttctttctttctctctttctttctttagagacagagtctcactctgtcgcccaggctggaatgcagtggcacaatctcggctcactgcaagctccgcctcccctgttcactccattctcctgcctcagccttcccagtagctgggactacaggctcctgccaccatgcccggctaactttttgtatattttagtagagatggggtttcaccatgttagccaggatggtcttgatcttctgacctcgtgatccacctgcctcagcctcccaaagtgctgggattacaggcgtgagccaccgcgccggcctttatttatttatttatttatttatttatttagatgaagtctacctctgtctttcaggctggagtgcagtggcatgatctcagctctctgcaacctccacctcctgggttcaagtgattctcctgcctcagcctcccaagtagctgagattacaggcatgcgccaccacaccgggctaatttttgtattttagtagatggggtttcaccatgttagccaggctggtctcaaactcctgacctcaagtgtgccgtctgccttggcctcctaaagtgctgggattgtaggcaggagccgctgtgcccgtctgatgataagttttgtttctaattatttgagttcaggatattcttgggacatctaggtggagatatatgttcagcagccagttgcatactggagattaatgctggaggagaaatgaaagctgaagtcatgagagtacatcagatcatctagaagaatgaatagagtaagaagattaaatcccaggaacagcaaacatttgaagggctgatgcggaagtaaaatccttaaagaagttcggattctcagtagggaggaagcaatgaatagtgtcaaatgtaacgagaggccaaacaagtttaaaaggacagcattgtttttttgaggtttagcattctggaagtgaagagcaattatagtagattcatggtcctaattctgaaaacctgattttaattataatagttctattatgattttcactttgtttcactttgaggttgatggtttttttccctctgttacattattatctgtttatgacagtttctgtcttcttgttatccttctttctttgatttctctacatctcacctttttgggacttcctgtgatgaccagttactttatagtcacaaattctcaggggcccttgttccccttctaaacccactagaatctagaatagtcaggtcccttccctaagaggctggagaccatacccagtgacatggatgttttcttcaaggctcagagccatctttcttctaaaggaagcctttataattacttggatgagaagctgaagttcaagacatgggtggtgaagctttggtttgaacaaagcaatctttttttttttttttttttttttttttgagatggagtctcgctcagttgccaggctggagtgcagtggtgcaatctcagctcaatgaaacctccgcctcctgggttcaagcgattctcctgccccagcctccagagtagtgggactacaggcacacgtatcaccatgcccagctaattttagtttttttttcagtagagacagagtttcaccatgttagccaggctggtcttgatctcctgacctggtgatcctcccaccttagcctcccaaagtgctgggattacaggcgtgagccaccacgcctggccacaaagtgatctttgaacataccgtagtttagcattttttacctgtagccctgtttaacatattataatatatttattaatgttcagtgagaagaatatctctctgagaaatctgttttggatttgacagaagtttgggtcaattataagttcataattatttggaaacaccctccccaccccgtccgcaaagagagaaagagagagattcaaataacgagagctcaaatacccagaattttttttctacattaggtactctactattataagggccacgtagtgagtcagcctttgtgaactccaacaagatagcttccagtgtatgttacaagagagacagaaattcagtctagtctctcacactttctacattaatagaattattcagtgttgtcatggcttttataaaaataacttgaaatatagaaatccttttagaatccttaaggaacaatgaactgatattcagcattctgttaatgaaaaacatattctaatttttaattggcagtatgtttgataattctgttaattagcatattccattaactgaccaacccatccattcaaccaatttgaataacagaagttaactgtaatttattttttactatatttttgtctccctggtttaaacaaatagaagaatacggactggtttaaacaattcatcaaacacactatctcaggttccagggagatacattattagggtcttactgactaatttgttatcagttacataagctattgcttctttttgctgccagacatctttggaagctccatattaatcactgtgagagcctgcttccttttgggttctgtcctttcctcacccatagtcatttatatttcacattcattgcctgagaagaaagtaagaccaaaaatgaaagtatgttcaaaaacagttttgaatttttaggattttttcgtgtctaagtagtctaaataaataattagcctctccttgtacttggaaatttctagatgctttgacaatagctttgtaacatgtagtagtttagacaatggaagaattaaatgtttatcacagtagactcttacatccatttatgaaattacaagaaatttgtcatttacagttggagaatgttatagtacagattgcctgcaaccattataatgttcaactgcctttgtaatgaaatatacaataataatttctaatttcataatcatgatattagtctttatctcttagtcttaataaattatgacctgattatatttcacttactctaaaaattatataaaatattttagataatttgtaacccaataatttttctacaatatttattgttacaagttttaaattttttaattgaacatgtacctttttagacattcagaagtttatgttcatttttaaggttaaattactgtatgtatactaatattggcatttatagaagctttccaactgcaagaaggattatgtttgaataatctagcatgtttaaaactattgaatttttttaaaaaaactatgactaggtacaattcctttcgaaaccaatttggctttgtctgataaagatatgcacacccagaagttttgctcctagacgtaccttagtcaaatttacgcacttgtacatcaaaatacatgtattacttttgtcctaattaatagtgtttataacagtcaaaacactgaagcaactcaaatgtccactactaaaatgtccaatattagaattgtaattagacagtaagatggctaaattatgatattcttagagtatgaatgccatacagcaatggaaatgaatgtttcacactacattgattcatataaatgaatcatataaacataagatttagtttaaaaaaagcaaagtacaacattacatttggtatgattccattctgcataaagttcaataacaagcaaaactaaattctatttttaggatgctagatagatggaaaaaactataaagaacaccaatgaagtggtaactgttaaagttacgaaagtgatttctctagggagaaactgggaatcatgactgaaaagagacagggattttcagggctatcgacagtattctctttcttaacctagatagtggttacatgcatcctttgtaagtttttttagtttataatcaagtattaattaaagtgtacatttaacttttatacatttttctgtttgttgtatttcagagtaaaataaaattaaaaattataaattttaaaatatttctcaccaaaaagacaggtttgggataagatttaaccaatggaagtaaataagaagcagaactacctattacagattccagagtccaaggtgacaagataaaggcttcattttgaagtctctatcgtatatatatatatttataacatatatatatgttaagtatttgtggcattatattattcaagactctttctgctgcatgtgacagaattgactcatataactgggaaatctagggtcagagatgatttttcacatgattggactgcagagttcatattttgtcatcaagaatctgtatctctgcttttcttgaattttattgtcttaattatgttagtagacaaaaaagtggggcaaaatgactgttggctggcctggattcatatgatcaggacaacttcatttaaaagggactattttttgctacctcgtttaaaagggactgtcttttgctatagctcctgcatttatttaaagtgacacacaacaacaccaccaacaactccctctgtttttcttcctgttggactttggcctggttgggtagggcattctaattgtcacagcccaggtctttagtcaagatcagtgaacaccatcagcccctcctaaacaatggaatggtcttcctataggaagaggggttttgatatcagatgatgggacagtaggatgctaaacaggtacatcacatcatcttgagtgatatacttactacaagatttttagtgtatttaaaaagtaagtcctatacttccaaatcacttttccttctagttcaagagaaagaagcattcattttcctattccaagttaattcttatgaagtgcttttgagccattttccaacatctccctgtgtcctaatacacacaaacattttacctatttaaaaaatatttaactactatcttatgtctctctgcctttttgaagctgaactctttcaaaggatactgaaaagtacaactgtgaatttggattgtggtttaatacctttcaagttatatggctttgggcaagtttcttcaactgagctttagtttcttgttatcatccttctaggcttattatgagtattgagtaccttatgatgagtgtaaagagtcttacatattttgtacctagcacaaaaataatgcagttatgagattaaaaccaggctttacttaatagacctatagttactggcaagtcatttaacttctttgaacttcactagtattatatttataatgtaaaaataatgcctaccttgcaggatttttgtgaatatcaaatggggtcatgaatgaatatgtctaataatggtaactgttgctgttattttttaaattaataattatttgcttttacattaataattatttgcccagccagttttcttttggtccctggtccaactaatttgaatggattacacataggagactaatatatcatacagtgatagaattttatggcttatacattgacattcaatttaaatgtattaagctatttgatttaaagggagaatagacaaatgactagaagttttcattctatttgctttttaatatgtaaacaaaaaatgaagacatgataaataaccttgagtttgaaggttcaccagcattcatctttttttttttttttttttttgagacatggtctcgctctatgacccaggctggagtacagtggcaagatgttggctcactgtagcctcttctcctgggttcaaggaatttttctgcttcagcctgccgagtagctgggattacaggcacatgccaccatgcctggctaatttttgtatttttagtagagatgatgtttcaccatgtgggccagcctggtctcgaactcctgacctcaagtgatcacacacagcctcccaaagtgctgggactgcaggcatgagccaccatgccgggcccattcatttttgttgaagaaaattgggaatatcagtagagtgttcatctccttcatagagaaaggtagatcattccaaaaagatgtgaaacacatcatgtgaagcaggaaatttagttttacactaactatggggattactttaaattatcaaaatgtagttttacttcaaaaaataccttgatgtaaatgatttcaggtgcatcttaaagacttgaaatacttagcactgctttgttttatagtttcttgtggagagaagtagtgagggcttggagattgtctccattcagtgatcatcacaattagtacagatggcagatcattatcaacatttattaccaaacggtgattacatcactcaattctcaattatgcatgtgaggcaggtatttttgttttgtatttcataaagccatggatgatattttgatatcttaaattataatattttaatgtttatcccctcttttccttaatgaaataacactggtgataaagtttctgtacacagcaaaaatggacattcagtcttagagacccaccatattccaacaccttaatattttatttaaagatgtgttgttcaattatgtatttttattgtaactttagaccaattgcataaattggataaattggattatcttattctatgaagcattaatcattgtaataagttaaatagtcattttagtgctttttttttaagtaggtaggtaccaccgtactacctcgtggaggaattgcacgtactaaggtgaagtttgacagtacaacctagcattgcatctcacatcttggttgattttctttatgccgattgagggataagctgaatagtcaacacaaaatatagataatataaaagctttttatatttagcatttggaatagaattacaggaaatcaagtgctaatatagttgcatttggctgccccttgcttctagccttcacaccaatactttccttctacatttttgttggcagttaccaacagattgccctacttgtgtggtatgacttcattaaaaaggcagatatatgcagaattttgctagtttatcttaaagaaatatttaacacttgatatttattgaaggttctatgccaagagttgtggagcggggggtacaacattaaagtggtggttagaagtgcacaaataactgtaatggtatacaacaaagagttttgggattcagagaaagcaggggtctcctcacgttaaagagaaataacaaagtgccacttatgatcagttttaaaagatcagtaatattttaaaggcagagctgtgctatagagtatatcccaacccagttattccctctgagcttgtatacaaaaccatgtggagaaccttgaaactgcagtttgtctgagtcataaaaagcatggggaggaggagggggacattcttcctagtgatacacaagaaatgctgtcacttatatgaaaagcagcatatttttgctgcttcatgttatcaacttaaattccagcaaatcattttaacagaaagatcttagagtaaaaattttacctatgcatctgtttattcttttgagtatccttgtataaagcactttggtaattgtcaatgtataagacagagtctctgtctttaaggaaggaaagataagagaaatttacatttagtgattgccaacaatatgtatatgttgtctcttaaatatatttcacttaatacttgtagcatccctatgacataggtattattatttctaattttttagaagtaaaaaaaatcttaggcattaaaagaggttgcctgctcaaaatcacccagcgagtaattaaaaccttacctgaaattacatctattggtataattccaaaatcatgtatttctcctgcagcgccttttgtatattcatgatctgtttctgggcaaagttttgagaggaatgattgaatataggttcttgtagattatacctttatacaaaagaaaagtgatagattcttagtaaaccaaaatatagttgtccctcagtattgggaactaatgaggaattggtagcagctgcgtgaccttactaaaaataaaaatcagatccgctgctgtaaactcttcactgatttcccactgcacttagaatacattcctaactctttatcatggtcatatcagtgctgtgctacagccaggtcataccagcttttgacggccaattgttaaattttcaggaattctgtgaaccagttgttaagcacagccattgttacaaattaaatgataaaaacttacagttaaataactcatgttaaaaacaaaagtaataagtactcaaaattcatcactttctggttatgttaccactttttactgttgtctgtgctcttgaactatttacattgttttatctgtatgataaaaatggtatatgatggtatgctgcagctctactgttatgcatcacttttctttttttttgcaaatgatattttattttatgcaatttgtttatttactcattcattcaattgcttatttaatcattccttaaaatatataagctgagagctgactatatggatggcaccaggcaaatacaatagatacagtagtgaaaaaaataaacatggtgtcttttgttatggagtccaaagctcagtggagcagtgagtgatactaatcaaacaactgcacaaatgcatctataagtaaattattttaaaagtacagttaaaggaaacaagtaggtgctattaagtacatgatataatatcagggttcaagaaaattttcagagcaaatggcaaatgagatacatatattcagtctgcccttcatgtctgcaggttcaaccaatcgtggatgaaaaatatttggaaacattaataacagtgtaacaagtaaaaatataaataaaaatacattgtaatgacgatttacatagcatttacattgtattaagtattataaagagatgatttaaagtagattactaaaatcatctacttcagtaatgttatatgcaaatataacatatatggttacctgcaaatactgtactatgccattttttttctttttttattttttatttattattattatactttaagttttagggtacatgtgcacaatgtgcaggttagttacatatgtatacatgtgccatgctggtgcgctgcacccactaactcgtcatctagcattaggtatatctcccaatgctaaccctcccccctccccccaacccacaacagtccccagagtgtgatgttccccttcctgtgtccatgtgttctcattgttcagttcccacctatgagggagaatatgcggtgtttggttttttgttcttgcgatagtttactgagaatgatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaataatgccgcaataaacatacgtgtgtatgtgtctttatagcagcatgatttatagtcctttgggtatataccgagtaatgggatggctgggtcaaatggtatttctagttctagatccctgaggaatcgccacactgacttccacaatggttgaactagtttacagtcccaccgacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatatccttcacccactttttgatggggttgtttgttttttcttgtaaatttgtttgagttcattgtagattctggatattagccctttgtcagatgagtaggttgcgaaaattttctcccattttgtaggtttatgcatcacttttcaactccagtccatttattttctaatattctactctgatctcttcccctacctcctctttacgctcaataattcatggatttgcccttttgaggctattttctagatcttgcaggcatgcctaatgtctttttattctttttgttgttgttgtttctcctctgactatgtattttcatatagcctgtcttcaagctcactgattcttctgcttgatcatctactgttgagagactgatacatttttaagtttgtcagttgaattttttagcttcagaatttctgcttaattattttttattatttcagtctttttgttaactttatctgataggattctgaattttttctctgtattgtcttgaagtcattgagcttcctcaaagtagctattctgaattctcttaaatgtcacatatctctcactccaggattggtccctggtaccttgtttagttcatttgatgaggtcatgttttcctgggtattcttgatgcttgtggatgtttattgatatctgggcattgaaaagttaagtatttattccagtcttcatagtctgaacttatttttacccgtccttcttgagaaggctttccaaagggaattaagtgttgtgatctaagtctttagtcactgaagccatatctgctttaggggatgccccaagccaaataatgctgcaatttttgcagactcgcagagatatagccttggtgggcttgggtaagatctgagagaattcctaaaatctctttttctcttctctcactttcccctgaataaatagtgtttttttctcctcatgctgggcttcctggagttgaggagcagggtgacacaagcactagccaccacagctgggactggctactatggctgcaactgcacttggtcacacctgaagccagcatggtacctgacgactactgcctggctgctgctggtgtttattcaaggccccagggtctttccattcagggtagcaggtttccttctggcccaggatggatctagaaatgcttttcaggagctagggtctggactcaggggattcaggactctgcttcatgttactgtggctgagccggtactcaagttgcaggacaaagtcctctttactgtttcctctcttttccacaagcagaaaaggagtatctcccaagctgccctgcctggagttggggaaggggtgtaagtatagccactcttacttttttgttgttgtttctatttgatcccttggctaccccagctggtgtttcactggattgtatgtaccccaagtccactggcttcaagcccagcacagcaccaggacttgccggaagattgtaatactcgtggcctagactgcttttcaaatttgttcaggacaccagggcactttagtctaccagggggcttcccttctgtctggggccagtctgaatccttccttgttgtgtgcctgctaaattctgccctgtgttgtgttctgctgtgacagggcagcactgagtaccagtgcaaagtcccacaatccctgctctctccctttcccaagtgcatggattctttctctacacagtgctggggggataggataggtgtggtgtagacgatgtaagactgttttttctatcctcttccatgccttcttccttgatatcatgttaaaaccaggtactgtgattgctcacctgattttttgtttttatgaaggtgtttcttgcgtggatagttgttcaatttggtgttcttgagggaggatgattgctgaaggatgattgctatttggccatctagctctgcctcctccaaaattgtctctgatgtttacctttacttccaacacccaacattccctagtctaggacttctgcatccttatgaaactcaagtagagttgcctgtttactcttcccctagggaggcactatacctttatctctgtatccctaaagcctagaacagggcctgcacctcatctgttcagtgactatatgtatgaatgccaaaaggcacataaaccttttatttgccctaatgattttaccacattcaaagaaataaaaacatattccctttataagacatcagatggtaagacatttacttagaaagagagagacttaagtgaattagtatctctaggactggctacagttcagttatcttttttttttctctctctcttttgagatagaatctcaaaactccaggctggagtgcagtggtgcgatctcagctcactgcaacctccacctcccaggtcaagcagttctcctgcctcagcttccccagtatctaggattacatgtacacaccaacatgcccagctattttgtatttttagtagagacggggtttcgtcatgttggccaggctagtctcgaactcctgacctcaggtaatccacccaccttggcatcccaaagtgctgggattacaggcgtgagccaccgcgcccggcctggctacagttatcttacatgcagctattttgtatagccatttgagtagagatctgagaggaagatgaagaggcttacaccttggtaagagaagtattcttggccatatatgttcaagttagtgtcacttgaggctttgatgacaaaggagtaaagaatacagtgtaattgtatcctaaataaccaaacggaagctgaaaaatagttgctaacttgaatagctgaggtcagtggccagaaattttgaaaaggtctcaaacaactcatagataaaaagaaaataagcaaatatttaaagaatcaaaatgaaaacactataatgtatttatttaacttcaggagatgttatttaacaaatttgggtattttgtggtttataattagaaaatagaagtggctgatttgtatgaaatcttgtacaactgcatttctaagtggataaatggaactctacttgattcacttgctgaagtatgaagttagtctaacaaatgtatgaaataccataatcaaccaaatgtaaattttcaaggaagtaatatttaaagtagatgtttgtataatagttacatcctaggacattgaataagtacaactttttctgtatgcttggtgtaatttctagaatattagatatgtccctttccatattctttcacctgttgataccactgtttagaggtttgttcctttgacttcagactttattccctgttcagataaaaatacctctgagaaagctagtatgttagagtttactggccatttccctgaaaactgtattttacagaaagtagcaacatcaagaaaacgcagggaggatagtctcacgctatttaccaaaatttaaaatgcatttattttttcacccagcattcccccttttgggaatgtgctctaccccaccccatttttgcatatgtacaaaatgatacatatgcaaggtttattgaagctttatatgattaaaaaattaggaacatctcaagtatcaataggaaacttgttaaatgagctatagtacttttatataatggaatactatgtaattgcttttaaaaaaataaagagacaactctttatatactgagatagaaagatttccaacatatattgttaaggaaaaaaatcaagatgtataacaatgtatatagaatattatcttttatgtgggatgggacaaaataaaattaaaaatgtaattattttatttgcatagataatcagtggcagaatacaggagaaattatttagagtagatatgaggctatgcaaaagaggttggggggtgtaggtaccggggattagtttatatataatgatagggaggagcgagacttttacctttagatctttttacattgtttttattttattttattttattttttttttagacggggtctcgctctgtcacccatgctgtaatgcagtgacgtgattttgctcactgcaacctccacctcccaggctcaagcgatccttccacctcatcctcccaagtagctggactacacactcatgttgccacactcggctaatttttttattctttgtagagacagggttttgccatgttggtcaggctggtctcgaactcctgggcttaagtgatctggctgccttggcctcccaaagtgtgctttggttttttaatcatgagtgtattgcctgtttttaaaggtagcctaatgaatgaatgacaacatgattaaaattaacaaaagaagataattcatctcaagtaaggaggtcatgtcactctgccaaagactggctctgaaggacttcatttgctccaggccttcagctacttatgcagaggactaataacatgaaggaacttttttgacattctggcaaaatgccacttatttatattgtatatgtatatatttttctgtagatgccagaggaacaagcattctgtgttttggtgaaaatcatgtacgactatggtttgagagacctctacagaaacaacttcgaagatcttcattgcaaattctaccagttggagagactaatgcaggtaaataaaaattaggaacttttatcactcagggatttgttgagtcatagaaaaagcctaatagagttggtaagcaataatgaattatagaagtttaatggaatattatagaaaatgtacatggatttagtttcagaccaatatctacattggtctatcataatatgtttatttagccattttactattttaaaaatatctcacattttaaatgttcaagttaaatatactttgaagtgagaatctaatgagtttaatcattaagagattgccaagtattgtttgtagaggaatggagatatttacagagtaaaaattgaaatacctaagagctttctgcatactaattagcaccacttccttatttgagtccacgtagaacacttggaaaagccagaaagatattcataagagaataaaacatactaaaatactgtagggatacatttaaaaatttttaaatataattcctaatctcaatgttgttgttgtgctttacaatgcgtatttataaatgtgtgtgagaaacatgcatccttttatatataccaaatattacacagtaaaaaagattgtgaccacaggcaaagtgattgaccagagctgacaaaaggaatttttaactagctttggagttctacctgaagttgataatcttaaatttataatgggtttttgtggcatgtttatgtgactttgtttaaaaggggttttgggaatccaagagaaatgtgaaggagatacatggatggattgattccatattggggaagggtaaaatggttgaggaaggaggttcgtggaatgtgagagcagaagatgctagtaggagctcattgatatgaactgccaggggatccgtaggtgtctaaagagggaagtgaagccagtaggagactgagagattagaagaacagggcagtagaggatgaatttgcagtgaggttaaaggaacaatttattgggagaagggaatgtaggagggtagaagactttaaaattgaaaagaaataaaaggaggcagggatgtaaaacgagccataagtacaatgacaaatgggcattaaggaggaaaaagactatgtagaagaatctggtaaatatggatattaacagcaataagctcctttttaacgatttaattctaccaagtaaatatttgggattactcgctttttgccttttatttaccaaaaaattcatatattttcaaaggtcagtattcctaagggctttgagaatcaagtaaatatacctaataaataacagatgtgtggtactatgaagaacctcaaccacatttttctgttagcagttttttttcagttaactgaatgagcatttggacgttccatttgaagtacctaatgggcacatttggctatttttcaaagagagcatgtagttcaagaaatggcttattttgttttttattcttctttttgtggtctatttaggaaaacaaaatgaaggtggcctttgtctttcagttatggtaatagctatgctaatactttgtaccttgctgttcatgcttttgaaaaccatttgcttgtttaaattgggagaaaaaaataaagttaccataaaggcatttttagaagatatccaattttatatattatacctttgcataatttctttgctttgccatttttaatatgctgaagacagatttctaaatagtttgtcgtggcttagaattttctaagtgttcaaaaaatatactgaaacatcatagaccccagattagatgatttccaaagagaagatacatttcttttctagctagttaagaattgaaccctgggctgggtacagtggctcacacctgtaatcccagcactttgggaggccaagtcgggcagatcacttgaggtcaggagttcgagaccagccaggctaatatggtgaaacactgtctctagtaaaaaatacaaaaaataatcgggcctggtggagggtgcctataatctcagctacttggaaggctgaggcaggaaaatggcttgaacctgggaggcggaggttgcagtgagccaggatcatgccactgtactccagcctggatgacagagcaagactcttatctcaaaaaaaaaaaaaaaaaatttaaccctgaatggggatgctatgacttgaccctggagtcaagatactcattacactacagatgctctggtagaatgagaattttgcaagaatcaagaacagtcaagtgagcaagagatggtctttcttagttgtttataataagtctgtttttattttcctcaattatctgtcatatccctaattctcatctgctgtcatcacttctgtgcagttatacaagacaaccaatactagaatagagttacagcgatcatagaaagctgtttgtaagttgcagttgtggcaggaacttcattgttctgctgcaagcttctcattgctcctaaattttccactttgacttttaggaacagctaccggacctgcatagccatttttctgatctgaacctggaagctcatatgtatgcatcccagtggtttctcactctttttactgccaagttcccactctgcatggtgttccacatcattgacttactgctttgtgaggtagagtgactcccatctttcactaagccaaaatagaaagtagtttctactaaaaatggttacagttttcttccttttgtttttgcctgtgacattaagccataaatactcactgaccaaaaagctgtatttgaattttcagtaaaaactattttaattgtaattttattatttctgaggaatgaaaatgttaaggcatatataattcctacaaagtaaaatgggtgattaaatttgcataattaaattcataataagcctatatctgtataataatgttttaccagtataaaatgcctttaaggttaaataaatgaatttagaattgggtgttttttaatattaatgcagttatactgcaagagtgaatataaatgagatttttataataactaatttctcagttcatcagatatctttctgtttatcatgtttgggactgctgcgaaatgatgagacaaatgataaactaaagctattatgtcatataattatatttttatatagtagaatatttcaaaaattagtttgtaaaatttcttaggtgtttatatttgtgtattttattgtttttagttccttagatggctatatttatttactcttttaaagaaataaacagtattatgcatatatatggcttatattggtcatcaaaatgtttgactatcttagcagtaatagggaatttgctagataagaagtgtatattttcaatggcagtataaatgtatataaaatatagctatcttaaaaagcaggactaatcaaaagtataagcttatctatgtgattataagcttaatatataatctagacagttttgtattactatgcttcttaaggtaaacatcctttaaaaaaaattttttttgtataaatttaaggggtacaagtgatgttttgctacgtggatatattgtgtagtggttaagtctgggcttttagtgtaaccatcacttgaataatgcacattgtacctgttgaataatttcttatcccctacccccctctcactgtcccatgtgagtctccaatgtctattattacaaattctgtgtccatgtatacacattatttggcagtatttgactttctgagttgttttacttaacataatggcctccagttccatccatgttgctgctaatgacatgattttactcttttttttggctgaataatgctacattgtatgtacataccacattttctttatccagtcatccactgatggacacttaacgctgattttgcatctttgctattataaatagtgctgcgataagcatataagtgcacgaatctttttttatacactgatttcttttcctttggataggtacccaatagtgggattgctggattgaatggtagttctatttttaattctttgagaaatttccatactgttttccatagaggttatactaatttacattctcaccagcagtgtggactcttttctctacatcctcactaacatctgttattttttgactttttaataatagccattctgactgtcataagataatatcatgttatgattttaatttgcatttctttgataattagtaatgttgaacattttttcatatgctcattggccatttgtatatcttcttttgaaaaatgtctgtttatgtcctttgcccgctttttaatggggctagttggtttttctgttgtcattgagttgtttaaagatttctctttcttttcgtttccttttctattctcttttctttctctttttgagatgtagtctcactctgtcacctaggctggagtgcagtggcatgatctcagctcactgcaacctccacctgccgggttcaagcaattctcctgcctcggcctcccaggtagctggaactacagacacacaacaccatgcccagctaattttttgtatttttagtagagatggggtttcaccatgctggccaggctggtctcaaactcggtctcccaaagtgctgggattagaggcatgagccactgcttccagccagattcctctttcttaaaaggaaagtctaatgattttaatcacactaggaattagaagtttaaatgtaaaaataagatttaaaagatgcaatgtgtaaactatataaagcataaaaatgttatttctcagcctactaaaacagtaacaattatatatgcaggcaaggctggtcttttgctcttcagtggctttagttagtacttgcctaatacctgaaggtcacagggcatttgtaagcatgtaagagttttaatcatttgtactgtactttgataaagaagggttcagtgacttgccaggcttgcagaataggtttccaaatcctgaatataacagctagagaatctgatttataatatgttaattctccgacttgttttacttacaaattagtttgtaaaatgcctttctaaatgtatcttaaaggaagaattcagaattaggagctaaaactttattcaaagtcaccatgttgtaatcacaatattcacaaagcatatgtggttatttgtaccaaaaactctacctgattatccaaattggtgtagtgaacagttccaactccgctattttatagggcaatactctttgaaagtataaaccaaattcacatcttcaagttctagaatattaaaataagtgaatgctaaaagttttgataaatattcatagacttttatatactgagctgagtttagtatttcatggtatttcataaaaataggaaagtgggggtatgacattttaacagtttttgagttatatatagtatgagcttgcaaatatttgttattgcttcacaatttttgcagaaagagattaatttcatactagattggttctatagtgttcattgtagaaaagggaataaaattaatgtgcttaatcataaccaactaaatgtgatttctcaatcacttttcctagagtggtatctctgcccttcagttcactgggatggtgactttctaaagtgtctgcccgaatgttggcacccgtggcatcggaacattgtccatgggttttctggaacctagattcaaattttatcttgaagatacatgaatttctaatgtcagttaagaaaactagcaacatttgtgctacagaaaagataaataaatttattagccttcccgtcacttgtcaactgtgacttacaatcagtgtttgaaaggtcataatgttcattaatattaataagaacatcatagatattacctttcctccccttaaacctgtactctatagctgtttaaggaagttggaaaacttttcaaaacatagattgtaatcatagcatcatgatgttcggggaagtaaatggtaacatcctttaccattaaaattgcttttcagaataatctattggaaacaatattgtagtgtgcctcaggatatttattctttccactaactcatctttgtcaagaattattttacaaaggaaatttttgaataaacttttacttcctgcatgtctgtgttttctttttgcccctttccttcttgtagttaataaaatatttatatcaaaagctattatttcatatgtgatgacatattctaagaattggtaaacacagtcttaaatagattatccataggtatttgtttttgtcatattctctgtttttaagaaaacaatttaaattttgaggttacgactcaatgtttacttaaaaatggaaggataggaagctctcaggtagaaaagtattgacttttcaaagttttacattctgatttttaacatgtgcaacatgtttactcaaagatcccattgcaaagtgaaaaagaaagacactgagtttgaaactttatgcttagaagacgtatcatgacatgctttcctaagctatattattttaaagatttcttcattcattctgaggttaagccaataaagttaatttagcagaaaagagaagaattttatagaccttgacaatgcagcctgactgaacaactgctaattattaatagttttatttaaagtatttgcttaaatctgaatatatgataacatgggttagttaattccagaatgatggatagcaatgggatttgaaactggagtttaaaaatacattttcttatgttaagatgagtgaaaatctgttttgattgtcttttagtcagtaactgaaatgaaaatcatttttaaaaaaacaaacctatatcttattatctgcctttatctgtttagcaagtctaaatgtattaacatttatagtgtaaatattatgctattaacctatcgataataaaacattgcagtctttaaaataactttttattgaagtataataacagataaaagaaaatttgcaaatattaatgtagaacttaatgatttttcaaaaaatggacataacgaagtaaccagcacccagatttaaaaaagaacaaaaaggaacattatctgcatttcagaaaccctcttccccttcactgcccttttccagtaactacactctgaaaagtaatcactttcctgacttttaatgccatagtttagctttgcttgttttggaactttatgtatgtggaatcatacaatacgaactcttttctgtctaactttttttagtcatcattatgtttgtgagattcatccgtatcattgcatttaggcatagtttagttttccattctcccattctattgttgacggttatttgagttgtttctagtttccagaaggccattatgaatagtgctccgtgtgaatcttttgaactttcttgaacttgtcttttagttaacgtacctatgcacttctgtgagtacacatcaaggagtagaattgttgtgttaggatgcacatacattcagctttaatggatactgccaaacagccttccaaggtagcatgagcattaactttgagttgtttttattcaataaagatctttcttgtgatcaagggcaaggttttgttctgttttgttttgttttgttttgttttgttttgtttttaggtcgcagataatgggtcagataagagtccatgaatacgcaacaaaatgaaactcatttggtgattggaatgattgacctgatctctgaagttgcatacaggcagattgaaagctaagaactggacctaaaagcagagtccctttagtgcttttatgagagaagttactatgatggggaaaatccagcaaagtattttcagtcttacaaagagcaatgtagagacggtatgacatttgagttaggatattggactttttagtcaacctttcctagacagccttgttcaagttacttgacctatgtaaatctcattttctttgtttgtgtaatgagactaacaatacctgtctctcaggtttagtgtaagaattagatgagattatgatatcaagtacttaagtactctgcctactatacagtattcaattaataataacattgccctgcagtctgctccatccatctgtatagcccatttagttgcttcttaatttcttcaattatctaggtttctaatcaccttcccctccatcacccagtggttgagatgcttctttggtaaaagcaaaattttaagtgagtgaccttaatggaagcttaattctatttcctttttcagtagtgattcaaatactgctctaaaagtgttttttgcttctcctccacattctttcagaagacataaggaaaatactggtatttcttttagtcttcacagaataactgacagccggtgtttgaagttgactcttcccagatagttcaatttttagagtaccaaatatgttcagctttatatagtaacttggtattttcatgaaatttaaggaaatcgttgacccttcaaattagaatgtatcttctgcttctcttctcttctcaggatgttgaaaaaatgacagtactacattatttgattaaatatcaccaggtataattctctcaaagcagttttcagaagttgttatctgaagagtagattcattatttattacacaatattctccctccttatccccattctcccccacaaaaaactcatcagaatgagcttaatacaagcaagattaagactctgacataggggagctggcaagatggccaaataggaagagctctggtctgcagctcccaatgagaccaatgcagagggtgggtgatttctgcattttcaactgaggtacccggttcatctcactgggactggttagacagtgggtgcagcccatgaaggattaacagaagcagggtggggcatcacctcacctgggaagcacaaggggtcaaggaactccctcccctagctgagggaagctgtaaagtactctgccatgagggacagtgctatccagcccagatactacacttttcccatggtcttcgcaacctacagaccaggagattccctcgggtgcctgcaccaccagggccctgagtttcaagcataaaactgggcagtcgtttgggcagacaccaagctagctgcaggagtttttgtttgtttgttttgttttgttttgttttgtttttaccccagtggtgcctggaatgccagtgagacagaactgttcactcccctggaaagggggctgaagccagggagttgagtggtctgtctcagcagaacctacccccatggcatccaacaagctaagattcactggcttgaaattctcactgccagcacagcattctgaagtcaagctgggatgcttgagcttggtgtggggagaggtgctgccattactgaggcttgagtacgcagttttcccctcacagtgtaaacaaagcctccaggaaattcgaactagttgtggaacccaccgcagtgcagcaaagctgctgtagccatagcacctctctagattcatgctctctgggcagggcatctctgaaagaaaggcagcagccccagtcagaggcttatagataaaactcccatctccctgggacagagcacctgggggaaggggtggctgtgggcgcagcttcagcagacttaaacattccagcctgccagctctgaagagaacagtggatctcccagtacagtgctcgagctctgctaagggacagacagcctcctcaagtggatccctgatacctatgccacctgactgggagacacctctgaagaggggttgacagataactcatacagaagagctctggctggcatctggcaggtgcccctctctgatgaagcttccagaggaaggaacagacagcgatctttgctgttttgaagcctctgctggtgatatacccaggcaaacaggttctgcagtggacctccagcaaactccagcagacctgcaaaaagggccctgactattagaaggaaaactagcaaacagaaagcaatagtatcaacatcaacaaaaaggacacccatgcaaaaatcccatctgaaggtcaccaacatcaaagaccaaagatagataaatccatgaagatgaggaaaagccagcgcaaaaaggctgaaaattccaaaaaccagaatgcctcttctccaaaggatcacagctccttgccagcaagagaatagaactggatggagaatgagtttgtcgaattgacataagtaggcttcagaagattggtaataacaaactcctctgagctaaagacacagtgcaagggagccaaaaaccttgataaaaggttacagaaactgctaactagaataactagtttagagaagaacataaatgacctgatggagctgaaaaacacagcacgagaacttcgtgaagcatacacaagtatcaatagccaaattgatcaagtggaagaaaggatatcagcgattgaagatcaacttaatgaaataaaacaggaagacaagattagagaacaaagaatgaaaaggaagaaacaaagcctccaagaaatatgggactgggaaaagaccaaacctacgtttgactggtgtacctgaaagtgatggggagaatggaaccaagttggaaaacacacttcaggatattatccaggagaacttctccaacctagcaagacaggccaatattcaaattcaggaaatacagagaacaccacagagatactattcctttgtggaaccccacaaagaacaaccacaagacagataatcatcagattcaccaatgttgaaatgaaggaaaaaatgttaagggaagccagagagaaaggtcgggttactcacaaagggaagcccatcagactaacagtggatctctctgcagaaaccctgcaagctagaagagagtgggggccaatttttaacattcttaaagaaaataattttcaaccagaatttcatatccagccaaactaagcttcataagtgaaggagaaataaaatcctttacagacaagcaaatgctgagggattttgtcaccaccaggcctgccttacaagagctcttgaaggaagcactaaatatggaaagaccagtaccagccactgcaaaaacaaaacaaattgtaaagaccatcaacactatgaagatactgcatcaactaatggacaaaataaccagctagcatcatatgacagtatcaaattcacacataacaaaattaaccttaaatgtaaataggctaaataccccaattaaaagacagactggcaaattggataaagagtcaagacccattggtgtgctgtggagcagggggcggtgctcatcggggaggctcaggctgcgcaggagcccacggtggcggggaggctcaggcatggcgggctgcaggtcccaagccctgccccacagggaggcagctaaagcccggcgagaagtcgagcacagcagctgctggcccaaacacagcttagcagtgctaagcccctcactgtctggggccggcagggccagctggccgctgtgagtgcggggcctgccgagcccacgcccacccggaactcacgctggcccgcaagtgccatgtacagccccggttcccacctgcgcctctccctccacacctccctgcaagctgagggagccagctccagccttggccagcccaggaaggggctcccacagtgcagcggtgggctgaagggctcctcaagtgccgccaaagtgggagcccaggcagaggaggcactgagagtgagtgagggctgccggcacgctgtcacctctcagagggagaggcgtgggtgggaaccgaggctgcgcacagtgcttgcgggccagaacgagttccaggtgggcgcgggcttggcggaccccgcactcggagcggctggcctgcgctgctggccctgggcagtgaggtgcttcgcacccgggccagcagctgtggagggtgcaccagtcccccagcactgctggcccacccgcaccacgctcgaattctcgccaggccttagctgcctccccatagggcagggttcgggacctgcagcctgccgtgcccgagtgccccctggcactcctgccctccacgggctcccgcacgcccgagcctccctgactggcactgccccctactccgggggcctggtcacaccaaccgcccaagggctgaggagtgtgggcacatggcatgggactggtgggtacctccacccatggccctggcacaggatccactaggcgaagccagctgagcttctgagtcgggtgggaacttggagaacttttatgtttagctagaggattgtaaatgcaccagtcagcactgtgtctagctcaaggtttgtaaacacaccaatcagtgctctgtgtctagataatctagtggggacttggagaacttttgtgtctagctaaaggattgtatatgcaccagtcagcactttgtgtctagctcaaggtttgtaaacacgccagtcagcaccctgtcaaaacggaccaatcggctctctgtaaaatggaccaatcagctgtctgtaaaacggaccaatcagctctctgtaaaacagaccaatcagcaggatgtgggtggggccagataagagaataaaagcaggctgcccgagcagtcaccttccggactgtggaagctttgttcttttgctctttgcagtaaattttgttgctgctcagtctttgggtccgcactgcctttatgagctgtaagactcactgcgaaggtctgcagcttcactcctgaagctagtgagaccacgaacccactgggagggacgaacaactccagacgcgccacctttaagaactgtaacactcaccgcgaaggtctgcagcttcacttctgaagccagcgagaccacgaacccaccataaggaagaaactccagacacatctgaacatctgaaggagcaaactgtggacacaccatctttaagaactgtaacactcactgtgagagtctgcggcttcattcttgaagtcagcgagaccaagaacccaccaattccggacacagtggttttcccctgcagtcaggctgcccagcagtagctactttctctaagaagttttccctgatcacccgttcttaaatggatatatccttttcctttctctcttagcaccccgtggttggtgtttatttattgacttacttacttactcctccaacctccccagccaaactttgcgtcattccatcagtcagtggcctgctggtgtctgccagtgcttgctggtgtgctcttctgctggtgtgtgttcctcccaacgtccagccgcttgtgtctgtgcccccagggtcttggggattttatagacacaagatgggggcatggcggaccagggtggtcttgggaaatgcaatatttggggacgaaaacagaaatgcctctcctgatttaggtccaatggcacaggcccagaggtggagccctcaccaggagccccacccttctgctcccagcacttccttgcccccatactatatcattaagacatacattgaagtgctatgtatctcacttctagaagtaaaacaatgtcaatgagattagaagctttatatatacctcttcctgactacatcttctttggtcttcctcaggagaaccattatgaagaatttagtgttaatcattcccatgcatgtctgttttttttactacatatgtatgtatctctggacaatttataattgagaatatttgaaaaatattattgcagtctgatatggttttgatatttgtcccttccagatctcatgttgaagtgtaatctccattgctggaggtgaggccttgtgggaggtattggatgatgggggcagatctttcatgaatggtttagcaccatccccttggcaatgagtgagttcttattctgagttcatgggagatatggttgtttagaagactgtggcacctttccctcaaaccctgctctcgtttactctctcactgtatgatgtgctggctcgcccttgtccttccactgtgatagtaagcttcctgaggccctcaccagcagcagatgctggcactatgctttgtgtacagcctgaagaactgtaagccaaaataaaacctcttttgtttataaattacccagcttcaggtgttcctttatagcaaagcatgaaccagactaacacacactcactagtttatcaagtctacctccaaaataggtcttgaacctttattctttctccaagtcagcattatctcctattcagtaacttcctatctgttcttcccacttgtcttcctgtcatttttttcccattattctccatagcatccagagaggattttgtaaaacacataaccgattacactcctctactgaaaacccttctgtggtttcccactaaataaaactcacattgtttcatttggcctgcagttattcccttccttcctccccagtggtatccaaaggtcagcctttttcctgctctttgtagtggaacactggtcttcttttagtttctggaacattgaaaacatttgtatattttttaggacagcagggatgttaatttaaaaaaaaaaagaaaaacattttttcctctttgtgcttggaatgaactactcactctaccttgctagctacttcctctaagaaattttccctgatcacccattcttaaatggatacatccttttcctttctctcttagcaccctgtggttggtgttttatttattgacttactttgtattgcttttaaaatgcctatttcccccaccagattataaatttctgaaaggaagagctatgtcttttttgtgtgcagctgaatacctagtatctaactttacatatggtagacatactcaaagtatctgttgaaggaaaataggaatgaagaagtaacggacataattatttttatcatcttcatttaaattctacaggctgaaaaataactttgctcttgagttttaagaggaaaaaataagttgttttagtttagatattttaagaaacagaaacctagacatagtagctccagtacagtgggggtttattgtaaagatagaggaaatccaggagaagttgagcaagtagacttcaggaaggacaggcaccaaagttaacctagacactcgtctgtattattctctatcaatctctatgaatcagattttctcccctctttcctgacctacctctttgtagctttgttttttttacagggcctaaaagatctctaagtatttctagtgtgtgtgtaatttaagactaaaattcttaatgttgactgcattgaaagtagacatttgataaatgtaatattaagtaaaattctgatgcatctcaagacaagctatatattagcttggcataggaatttaattagagtggagcatagcatagttttaatatagggcgtaatctttaaaattataatttggtcctcagggttgaagtggtagctggatccaaatcattttcatagtatacatttgcaggtgaggttataagtaaaagcagtgtgcaattttgacccatataaataattttaatgattattggcaaaagtatatgaaatatttgaatgcttcccattgtctagaaactgtattgggaaagcatcttctaagtaataagtgttgaaagacctccattgtaattattagtaacaacattctttcaatttataaattatctatattgtacaaaagagaaggaactcatgcagtatcagtggaagtggattaaaaatgagacctttcattgaagagtagttatttccctttaccaccttgtttcataaatatccaattttagctgataaactttcagacttactgtttaagtctcaaatatttgaggacagaatactggcaggctttactggagagtatttctgggccacacactgtactaaaagatttacataccttgtcacactattcttaccttctccaaacagactgcagcccttcacacccctcatacagttgcccaatttagaaataggtttttcaacttttttcaattcacatgggcagacgctgtgattatccttgtccttcatgtcccttagtaaataacagatggtctttgtctcttttaagaaatcctcattacctactctcattttaagacagaaatagtaatcaattcccaatatcattttgggtctttcagtccaagacttgactctgttgatctcatatcccaggtcctcctatggtctggcaagacttctccatgttaaattccttcacctgatgctcctggtattcttttccagctgcacttttcaggcacagttttccattggtatccacagggtttaaagttcccctcatcccccacagataccaaaatctgaggatgctcaagttccctgtataaaatggcataatatttgcatataacctaacacatccttccatatgctttacatcatctctagataacttataatacataatacattgtaaatggtatgtgaatagttgttatttgtttttaagtttacgttatttttattgttattatttttattttaaagatttttccatctgcagttttccatctgttgtttgaatccacatatgcagaatccaccgatagggagggcaactgaacttaattatctgcatccattgtttggcatttagtagtagtagtatttttagagacagggtcttgttgtgttgccgagagtagagtgcagtggctattcacagacattatcatcatagtggcgcactacagccttgaaatcctgggctcaggtgagcctcctacctcagtctcccaagtagctgggactgcaggtatgcgccactgtacccagctgtttggcatttttaaccaaagagtagtttaacctttttcttatttatccagggcttcttaaccatatctaaacatacaatatttagctaccagtactagaactgttgtttgcatttgttaaaaaagaggcataataggaccttctggtctcctactttttgggttgtctcaccgggactttcagaggctcttattttttatttttttctttcgatacctttggtatgaaagctgttattttttagaagtccacttgacattttgcttcttgtcctcatcctagtagtatagcccattttgctcttcttaggaatatgccagaaaatttttcataattgaataaaacaatttcctgctggtcctctggctcattgacctattggatttcagcttggaccacatcatgtctggtaattatttcttaaggcacttaaagcacctggtagtttgtttacttacttacttcgtgtagttgttctcctaacatcccaatgaagtaggtacaccctactttgtagactctaaagattcttggttatgctcattggcaggcaagaatccattttatccataagaatccttaatacagagaagaattagtgcattcttagtgtttatcatctctgttaccttgcaaatatacataaaagatccctcgttaatattaacatatgaattttaggccaggtgcagtggctcaggcctgtaattccagcattttgggaggctgaggtgggatgatcatttgaaatcaggaggctgagaccagcctgatcaacgtggcgagaccctgtgtctatcaaaagttaaaaaatttaggtaggcatgctgggcacaactgtactcccagttactcaggaggctgaggcagaggatcgcttgagcccaggagtttgaggctacagtgagctatgatagcgccactgtactccagcctgggcaacagaacgagattcctgtctcaaaaacaaacaaatgtatgactgtaaaagaatgaaagataaatatccaatagtactgattaaacctctcgtttaagtgcccttttttgttcccgttaaatagaatcaaagcacattttatctaataatgtataagctttcagcctgaaaaacagcttaaaataagtgactaaggttgaagctaatatgagtcaaccttaaaacatgcaaaatttttacaaaaaacaggtcacctttagatgccaggtattactttgcctattcaccaatctagatgtattatctaattcttgtcttagaccttacatttttttccaaaatcagtatagttgctttctgtttgtctggtggtgaaccgcatgataactttacaagtactgctggttctatgagagtctttttcttactatcagaagagcatggtaacagtccaatactaaaagaaaaaggaagtacgttagttgattataccagtgaatcttgaagaacatatcaagtaattcttttctccaaacttcaaactgttatagttcacacggaactaatcttgggtagggaggcagatggggtgggcttcctctgtctgctgcttcctgtcccagttgctcctcaacagtaacacctgagtcttcttagccacctttctcagtacctcaggaaacctctgtgaagctttctttctccttacttattcctccagactctgttgtcttcttctttcattcttctgttgtcttcttattttattcttttgccctgtggtcttccttccttttaggtttttggtttgagttttggttattcaatctcacctaatttcacctgggaaaatttttgagatccaatcaggttgaagaagaaagggaaagaaaaccacttagcactagtccctcaggatctaccgtatataagccaaacagacattctcctctgccagaatgctcatctgttggcataactttgttcctaagaatctctacctcacttctctgcttagagttgtattataaaagacccccttctattatcctgggtcaataagtgcacaagctcaaaaggaaaagaagggatgtgctgtgccccaagaaaggatgatagaggaagaaaaatcctgtcctggctcgtctgatgtctcagttggatattacccaattcttaatgtttaataagcccatttatttttgaggcccttggcatcatttgtcatcgtgtactattttaatggcaataaaacgttcctccagctgtatcaggctgagtgtaaggatggtggagacccaaagcagtttacatgaaaccctccatgggaaggagaggagagaaattcaggatgaaactacagccacagccagaatggtggactgaagtaccagtgttccctcagatgggggaactcctttatagtgtggtaggttttcttttcttttcctttttttttttttttttttgagacagagtttcgctcttgttgcccaggctggagtgcaatggtgccatctcggctcaccacaacctctgcttcccagcttcaagctattctccttcctcagcctcccgagtagctgggattacaggcatgtgctactatgcctggatatttctgtatttttagtagagatggggtttctccatgttggtcaggctggtctcaaacttctaacctcaggttatcctcccgcctcagcttcccaaagtgctgggattacaggcgtgagccaccgcacccggcctatagtatggtaggttttctgaggccttctttataccagtattaaaaatgaatttttaaaattgtgccagaattaagattttttatctatttttctccaagaattattagccactttaaaagatatctttaataattaaagataaaattggattttatttgaaaagtactgataaacctgaattacatgttacgtaatatattaactgtcttcctatcttcaaccttcaaatctataatagactcgatatcaaatagtactttgaacccagtagagtttcacaacctttcaagtgtagaaccaatcagtcaacaagcatctattaaatctctctaagttcaagaaaagatcctttaatttaatctagcatttggataaaacccttgaaaaaattggttgttggttacactttttctacttttccttaatggggctacttaaagatttatttaggtcagatatggccaactcaaatgcacaaaaatgagtgaaatgtgctaggtataagacaagatggagtattgaggactgggatgaactgcagagtacatattcacgtaaaggaactcaaattcaatttttataaaaagctgaggccaaatagagtgtatcatcagtccaaattcagccaaaggctgcagtttgtgacctctgatttagatagcaagatgaaatattatttggttgggatttttggaggtggtaggagtgactccaaatcataataaattaatatatatgtactttagaagcccatattgcaagacttgtatttatgatggctataatatatattgataaaagagtaagtataattatgcctagaagcataagacagtatttctcaaagtgtagttcatagcaactttcactagaataatttgggaggggtgggagagggactatttcaaaacttactacaaagctatagtaatcaaaactgcatggtaatggcataggtgtaaatctatagattaacagaatggaaatacactcacgtatttgtgggcatttgattttcaacaaggatgccaagacaatttagtaaggaatgaatggccttttcaacaaatgttgctgaggtaactggagatagctagctagctagatgtagatagatagatagatagatagatagatagatagatagatagacagacagatagttggtttttttttttttgagacagggtctggctctgttgcccaggctggagtgcagtggcacgatctcagctcactgcaacctctgcctacctctgcctccagagctcaagcactcctcccacctcagcttcctgagtggctgggactacaggtgcatgccactatgggcctggctaattttttaattttttgtagagacagggttttgccatgttgcccaggctggtctcaaactcctgagctcaagtaatccgcccacctcagcctcccagagtactaggattacaggcttgagccaccggtcccggctggtaactggatattgacttataaaagaatgaagttgcacccctacttcacacccctctctccatataaaagaatgaagttgtacccctacctctatggcaaatccatagagatagaaagtagattagtttcctagagttgaagagaggagggattgacgagtgagtgcttacaggaaaaagttttcttttggagatgatgcaatgttcaggaattaggtagtgatgatggttgtacagccttgcaaatatactaaaaaccaactgaactgtacatttttgaagaacaaattttatggtgtttgaattacatctcaatgtaacaaaataacttgaagcaggagagattgctcattaaagataaaaattctagaggtcatcttagactcaagcttctttgagaatatggctctagaaatctacaagtttaacaaatatactcaggtttatttcctaatgactaggaaatactgatttaacagttgtgtatacttgtacattgaaatgtgtttaggctaaaggacatgtgctttttgatcattttaatcatcagcagcaaagagttatgtggtattactttctgtcccatatgagagttatcagatgataaaggtgtgatgctttctctggaggaacaagaagacggccatacatagaagcatgaaatggtgtactttttcatttctttgaatttgttactttggcaaattctgggaagaaagataataattcaacgtaatgaattcagagaagcacaaaacttaagggaaatatccagcaatatttctgtggttgctttgtttttagtgtttattttggggatgaaaaccttggtgtgttgatttttctcaaggctttcttggtcatgtgttactgtgggcctttcaacaaagccaagttgacagagaacagatgcatattttaataactaaacttcctcagcaatagtatctggatcagattggtttcacagcagtgttgcagcaggataaattataattaaaaataggcaggtattttatttcatgaagatttaggggaagaacaagatggaactttttagagttagcagttaccaaataggggaatgaaggtagatctgcaatttcccagtacaaagtatttgggggcttattcagagttttacttgcactgagttgataaatggtatatgatcatcagtagtatcctataaatattaaactgtaagtctcttttgaaaatctaaaattactcctttttctaaattatcaaaggttttaaaacatcaaattcacaaataccttttttatttaaagagaaagtaggatttgatactcaatttttttgttgttgttgagacggagtcttgctctgtgtccaggctggagtgcaatggcgccatctcagcccactgcaccctctgaatccctggttcaagcgattcttctgccacagcctccctagtagttgggattacaggcatgcgccaccatgcccagctaatttttgtatttttagtagagatggggtttcaccatgttggccaggatggtccccatctcctgaccttatgatccacccgccccacccacaaagtgctgtgattataggtgtgagccaccgcgcctggccgatactcaatttttttatggttgatgccagtcacacttactttggctaatcctgtttctttaacgataaaaatagatgatgaagcttaaaagattctacacttacacgaatggtatattatattgttttgttatatgtaagatgtacgaaaagtactttgtttaattagggtctcggaacatgaatatgactagcttttcccatttttccttttttatcgcaagcttctttttttttttgagacggagtttcactcttgttgcccaggctggagtgcagtggtgcaatctcggctcactgcaacctctgtctcctgggttcaagcgattcccctgcctcagcctcccaagtggctgggattacaggcgcccaccaccacgtctggctaattttttatatttttagtagagatggggtttcatcatgttgtccaggctggtcgtgagctcctgacctcaggtgatctacctgcctcagcctcccaaagtactgggattacaggtgtgagccactgcacctggcctttatctcaagcttctaccagtagtgataaatggctagcaagaatcttctatgccttagcctgaaggagatgggttccattaccaatcttctttcttccaaaatatagaacttcaggtatttgcccgaggctgcaccctcagccaatattttggctctattttggcctcagccaatatgttgtgctctatattaggcaagtcacagtacatgatggagacacagaactgatgaacattttcaaaaggaggcatgctggagtgattcaatacaaataagatagacagactcttgcattatgttgacccataggaatttgctgggtttttttgtttgtttttgagaaggagttttcgctcttgttgcccaggctggagtgcaatggtgcaatctcagcccactgcaatctccacctcctgggttccagtgattctcctgcctcagcctcccaagtagctgggattacaggtgtccaccaccacgcctggctcatttttgtatttttagtagaaacagggtttcaccatgttggccaggctggtctcgaactcctgacttcaggtgatccacccacctcagcctcccaaagtgctgggattacaggcatgagccactgtgcccgtccaaaatttttgtaagtcaaaattttttgaatattggcagtttcctgtggtgcatcctaatattatactgagagtagtgatatgttggagataaggtcgtaagaacaggtaatacctaatctaaactgggagaataactactgttcaatcccactattgggccatagtagtcactgtttatataataaatgagtgaagtcttctgtgatgtcttttcgacacatgtattcagtgtgtattatgtatctagtagtctcccaatctcaaagcttctttgaagttgcatatcatatatttaaaatacatgtaaaatttgcagtttgctgcacaatagagccatagttgtcttagtacaaatatttttttcacatgtttaagtaaaacttgtccaaagagatatagcatatttgccttgtttttcccttttcttacacacagctctttgtacctcaggggtttgtcataccataatttgggatgcattgttatataaataggaggccactgaaagtttaaatcaaggtaatgccatggtgaaattgatgtttgagaaaagtaattctgagagagtcaaaatagttgtgttgtgatagcaactggcatatgtgcattaaaaattgaacattaagaataaatgctgacattgtggattatttgttgctttcataagtttgtcctctagcacttgtgctttttatcttttgtattaagtatgcattttaagagtaaatggtataccaccaaattgtctaacagtgctacatttttgtggaatcttgggggagggatcatatatagttaaaattttatattagattttcttttatagccatttacatgatgtggctttttatatttggaggacaaaagaattcatagaatacattaatgtgttacatgatgtcagcagataactagatttctaaaggttaagttattaaaggcttatatggaaatctaaaaagactcatgagtaattacttttaaaggcattgaaaggagtgaaaaagtgggtgactatctaattccagacatgaatatgagacagactagtacttatagcagtttggaggatgccagagaagccaaaaagggagcagcatatgcttccaaattgttttgaagtgaggctttgtcttttctctagaaaaatagataatatctcatcaacttaacatctagaggaccagagatattcactgaaaggaatgctttttattcattcaattattcattcatttattaaatattgaacactttaatgtgctgacactgaaatagtcctaacataacatatggttaatagaacagacgttgtctttgcatctatagtgctaatacactaatgggcagataataaatacaaaaaatatatatgactatatattataataaatgttatgaagggaaactacaagttacttcaagatttggtaacaaggaaatctattttagattagggtttcaagaatggtctctctgagtaagtgacatttaaagctgagatctaagagacgagtaggagaaatcacggtgatgagtaggggaagtgcatgcttgaggctcttgggtggcaggttctaaaagaaagccagactttctagaacacaagagcagttggccaagaggtaggtaggacccaaattataccagagcttggtggccatattgaggaggacatgggatttcattctaactgcaggaaaaagccattgaagatctttaagcatggaattggatggagtgacttaagtgtttcagagatgactatggctgttgtgaatgcattgaaggggataaggagaccagggaaaccagttaggagctactgctcgggtaagagttgatggtggttagttgaatgtatcagcaatgaacttgcaattgaaggtcaaagctaactttaaattaaactcttaagaatattattggtggtgtgtctcccaagaaaaatacctgtctaagaaaataggaaacatcatccccaaaagactaaatacgtagtgtgaaggttgagaaagaggaatatattgcagggaaacttttggtgaggtttatttgttgttgttgtttacttccaaaatatggtttccatttttctcccccataagttttctatttgggaaaagagatttagtggaattataaactgaaagaattcatgtataacttttgcctcactttactttttattttcatttttaatctttcatttttttccttctataactttcttgtctttgaaaaaaagagtgcaggtgccttatgtgtccaagaatgaaatagcctctgaagtactatctgtttgcttgctagcttgctggcttgctgggtcaaagaaaaggaagggctcgtttatactgtaacagtgtttttatttagcatgcctctgaggtttttattgtgttctgggacagtgtttatgacattggaagttaaagaaaagaattgcaatgagttggggggatgggggagggatagcactgggagatatacctaatgctaaatgacgagttaatgggtgcaacacaccaacatggcacatgtatacatatgtaacaaacctgcacattgtgcgcatgtaccctgaaacttaaagtataataataataaaattaaaaataaatatatttaaaacaaacaaacaaaagaattgcagtgagtttgagtgacacaaaaataaaattcccatgataattcaataccatgaattatctttattgagtgaaataaattctgagggtatagtaattattttatggtccttttgtattagatttgtgtttgcttaataatttagcactttgaattttctctttgaatttttattcttccagaaatctttgcggggttggagttttcatattgtgacttttgggctaacatctctctagctcttcttattagttaattttcagcagattttttttttctatattgcccagtccagtctcaaagtcctgggtttatgcaatcctctctccacagcctcccaagtgactcactgggattacaggtgtatgccaccatgcccagccttggaagactttttataaattagggtacatcttttttttttatttttcacataattttgtttttgttatcagcaaggttgaatcaaaagtaacttcctttcctggtggtctaattgctaggataaagagagggaaaaaaataacttcatcattactgaattatcaaaatgaggtcttttaatttatctattactattataaggctagttagaaaatttaagtcattttctaagagatagaaattttgttagcttgatttttctgactttttgtcattccttctcttatgtatggtgccatctgctgtttgtgggaagtattttatattttgaagcactacacataatagaaatacagtgtctaaaagaaaaatgtcaaaatacatgaaatgaaaaaagcagtagtgtggcccgtttgaaactttgtggcctgtggcttgtttctttttatgtaaaaattatttttatatctgattatttttagtacttacatgaatcacaagattttggtactcatcgtgttctgtcttaattttgtttttgctcagaatagaagtaatcggtaaacatttgttagttgactcatttggtttgttttttgtgactcctcaggcacctttcttgtaagcttctgcttacagtctatgcaaccttaggcaaataatttcagcccttagcacctctgtttccttctccataagaagaagataataatatcaatttcttaaggtttttctgaggattaaatgagataacacttgtcatatgcatagcacaatcctttcctttcgctaaaatgttgtttccaggttcagtgagtttcccttttaccttatttcaaagacacctttgttaagaatcagatttcattgctataggatcataaactctttgagccagaaggaacttcagtaagtgggcctcaaaatgttagcatgcatttgaatcatatggtgatcctatttaaatgctgattcggattttattggtggttataggatatggaacctcatagtctgcacatctaacttttacttaagcattgctgatactgcccccacagaatgccttttctgtagcaaagctttggaaaacaacaaacagaaaaacaactagtaaagatggagatggatgggaagaggatgactgaaaggtataaaattacaattagaaagaaagaacaagttctggtattctattgcatggtagggtgactatagtcaacaataagttattgtatatcttaaaatgacaagaataaaaggttctgtgtcttcacaccacaaaaaaatgacaaatgtttcaggtgatggatatgctgattagcctgattttaacattacacaatgtatatgttttgaaacatcacattgtaagcaataatatgcacaattattatgtgttacttaaaataaatttttttaaaaaacaaaagaaaaataatccaccaaaatctgattttcttttttgggtaatctcatgtgccagtcatcagaactgtatttctttgtagaagaggaaaggaatccagagtctgtctccagaagacattccagactaatttcttattctttactctcagcactaaattttattagtcagcagttacattttgtcatttctaccaatgttatacagcagtaacattgctgagagaaattattaaagagaattatattcaaaacccagttatttattgtccaagcattatgacctacaaatatttaattggtatccatttaaaattcaactacaacttttatttctatttgtaacttgttgccttgttctttactctttaaattgctttaaatttttacagcattaaaaaatgaaaagctaaacaaattagcaacttcagtaacgtttcaggttacaaaatcaatgtacaataatcagtaacatttgtatacaccagtaatgttcaagctcggagccaaataaagaatgcagtcccctttacaatagccacacacacaaaatgcctaggaatacatctaaccaaggaagtgaaagatctctacaaggagaaccacaaaatgctgctaaaagaaatcacagatgacacaaacaaatgaaaaaacatttcttgttcatggattggaagaatcggtatcattaatatggccatactgtgcaaagtaacctacagatacaatgctattcctatcaaactaccagtgtctttttttttttttttttttttgagatggagtctcactgtgttgcccaggctggagtgcggtggtgtgatctcagcttactgcaccctcccaggctggagtgcagtggtacgatctcggctcactgcaacctctgcctcccaggttcaagagattctcctgactcagcttcctgagtagctgggactacaggcgcaagccaccatgcccagttgattttttatttttagtagagacagggtttcaccacattggccaggttggtctcgagctcctgacctcaggtgatccaccctcctcagcctcccaaaatactgggattacaggagtgagccaccgtgcctggccaccagtgtcatttttgacagaactaaataaaactattcaaaaaattcgtatggacccaaaagagcccaaatagccaaagcaatccaaagcaaaaagaacaaagctggaggcgtcacattacctgtcttcaaatatactgtaaggctatatagtaatcaaaacaacgtggtactggtacaaaaatagacacatagaccaaaggaacagaatagagaacccagaaataaagatgcacacttacaactatctgatctttgacaaagtcgacaaaattcagcaatggagaaaggactccctattcaataaatgatgctgggatagttggcgagccatatgcaaaagaatgaaactggacccctacctgtcaccatatacaaaaattaactcaagaaggattaaagatttaaatgtgacatcacaaactataagaatcctagaagaaaatctaggaaacaccattctggacatcagccttgggaaagaatttatgactaagtcctcaaaagcaattgcaacaaaaacaaaaaattgacaagtggaacctaattaaagagcctctgcacagcaaaagaaattatcaacagagcagacaacctacagaatgggagatgatatttgcaaagcatgcatctgacaaaagtctaatacatagaatctataaggaacttaaacagttgaacaagcaaaaaacaaataaccccatttaaaaaatggacaaaggacacgaacagacacttctcaaaagaagacatacaagcagccaaaagacatgaaaaaatgctccatatcactaatcatcagagaaattcaaatcaaaaccacaatgagaccatctcacacccatcaacatggctattattaaaaagtaaaaataaataacagatgctggtgatgctgtggagaaaaggaaacacttatacactgttggtgggaatgtaaattcagttcagccactatggaaagagcttggcgatttctcaaagaacttaaaacagaactaccatttgacccagcaatcccattactggatgtatatttaaaagaaaacaaataaaaagacatacacttacatgttaattgcagcactatttgcaaaaacatggaatcaatccaggtgcctatcagtggtgaattggataaagaaaatatggtacacatataccacaggatactttgcagccacaaaaaagaacaaaatcatgtcgcttaaagcaacatggatgcagctggaggccattatcctaagtgaattaatacgagaacagaaagcccaatgcctcatatttgcacttgtaagtgggtgctaaacattgactactcagggacataaagatagcaacaatagacactggaacaactctagactaatagaggaggggaggaaaagggtgggaacaagggttgacaagctaactgttggatactatgctcagtacctgggtgatgggatcattcataccccaaacttcagcattatgcaatatagccatgtaaccgacctgcatatgtatcccctgaatctaaaataaaagtcggaaaaaaccccaaacaaattagccccaataactctctgtaaattctagagtaattacttgactccaataagacctttttttggtgagttggatatacaatgctattctcttgatgtttggattttccccgaaactggttaattatgtttaaaactgaatacccttaagtccagtgccccagtgtgggttcaacaggataaagtgtctatccacagtattctctgagaaggaatcctttagttttagccagagagtcatagagttgttcacacctgaggaatcatccagcttagttacacaagttcaaggtcctaaaggaaattaaaagaggcataaaatgacttctcagaaatgtatagattgactaaaaagtaaaaattgtggcctagaaaaaaaacttaatgagtagaaagttttttccaaatgaaatcttatgtataaggacaatactaccctttcttcctacctcccctgaagtgatggtaaggagtatcttgctattttatttttattttttgaaagagcatctcgctctgttgcccaggctggagtacagtggtgtgatctctgctcactgcaacctctgcctcctgggttcaagctattctcctgcctcagcttccccagtagctggtattacaggtacacaccagcatgcccacctgttttgtatttttattagagaaggggtttcaccatgttggccaggctggtctcgaactctgacctcaagagatctacccgcctcggcctcccaaagtgctgggaatacaagcgtgagccaccgcacccagccagtatcttgattttatctggtgtagcccagtgcattcacaagcattgctgtaagactacacaaatgtcatgaaagctactaggatttgtatggacaggttgcactatcatcctgtctggatacttgtcatgtttaagatttctagaaaaggaacttacccagtgtactttgataactttttcttgatttttaattcttttgcttttacatctgtgaaaaatagatcattataatacttttgaggtattttttttctagtggataatctgaatgcaaaatcaaccaacaaaagaaacaaacaaaaaaaccctgttataccctggaactccaacttgagaattttcttttccttgccattcctggcttccatcttcacagtcattcgtagactcaccctctctttaactttgcaagatctctggcaattattccagtcctaaaaggctagattctataggcatattctgtaaatgcttcttggttttcagactgtgtcatggtaatgctgttgccttccttgctacatcttctgagaactagaacttaaggacttccatgtctctgtacacttattcaatctgttcttattttaaaatcagaaaaaacaagggactatgtttctactatattcaaatcataaagaattatgggctgggcgtggtggttcacacctgtaatcccagcactttgggaggccaaggcagatggatcacaaggtcaagagattgagaccatcctggccaacatggtgaaaccctgtgtctattaaaagtacaaaaaattagctgggtgttgtggcgcgtgcctgtagtcccagcttgggaggctgaggcaggagaatcacttggacctggaaggtggaggttgcagtgagccgagattgcgccactgcattccagcctggcgacagagtgagaccccatcccccccaaaaaaaaaaaacatggattgttagacttgaaagtaactctacaggtagtttaagccaataccccttatttaaaagaagagaacttaagtatgacagtaaaagttgtaagaaccatgactgatctcaagcttaaagccggagcagatagtttagcttagcattagggcttaaagttaatactctaagtagattaggtaattctttaatagtagactgtggtatttggacctatgctacagaattctgtctagttttattttttagatgatttataagagtcttgaagatagtttataggtgaacaaacgaatttaaaattagtacgcatgagaacacatcaaaggaattaagaatatttccttaaaaaggataccttcaaaggcatcttcagtaacatgaaaaattcaaccaagtgttctctactctatttttttttaggatagtacaaaggaagtaaaggcataatatagtaaaaagaacagcagcagttaggtgtgaggcaaatccacacaatgaagctggtgaacactagaacaggagggatatttgccttcctggttattttcctcaaattctctgcttattatcaatatctgtttactgtggttgggatttagcatccaaaggcacgaatggatgcacttcccaagactctgtcctgtttagtgatatttcatggtctatttaataaactgtttgggggactttaacatgataattgtcagggcatatagtgcttaactgtgtgtcagacacttttctaagtgtttttttatatagtaactcatttaattctgaaaaaaaaaccctctgaggtatctataaggaaatcgaggtagagagagttaaaataactctaagtcatatagttaggaggagatgcaaagttgattcagacctaggaaggctggctccgagtctgtctcataaccaccatgctttattgcctctccaaaaaagaataaaaggaggaagcggtcagacttcaagggaaataaaatttcttttattttacctagatatctctagatccgataacagctgggaccaagatatggcaggctgcaggggtcaaggagagccagcaagcagtgaaacatctgcctccctctccagcttcatccctcacatgcactttcgtggtcccatccctcccagatcacaggcagttctgcctgcttcgtttctctctgcctttacagatgctatgcttttggtttgcactgctttcctcccaatactttaacttgaccaatttgtatttatttctctacctctttcaggcaaaactgctttgtaagcatctactgcattgtgaaacatttccaagtttacccaagaagtactgatctttctacctttgggctccccctgtcccctaaatatccctcctttttttgtactttcatcactcatttgacaactatttatttagcattactatgtgccaagcactattctggacactgaggaaatcagtcagtccaaatttctgacctaataaaacataatatctaagtggggaagaaaagcaagatttggaagagaaatgataggatttgatgtctcccttaaagggatcactccggctactgtcactctagagaaaaggagtcactctggagaataggctgtggggggtcaagagcaggagtgaggagaccaggaaactgttgtgttaatccagatcaggaggtgatgatggcttaggtaagggtgggagcagtgggaatggtaggaagtagttgaatttgggatatgtttaccaagtagatccaaaaagatttgctgatggtttaactgttcgttgtgagagaaagaaaggataattctatgattttttgcttatgcaactagaggaatgcacttaccattgaagaagagattggaggaagaacaggtttatggggaaaataaggaattcagatttttacatgtttttgattcctattaggacatccaagtagagatcttaagatagttgaatatatgattctggagttcagaggagatagtgaggctaaaacgttgatttgggagttattagtgtatgctatgtatttaaagccacaagacttgatggggtcacctagaaagctagctgacgaccaggtatgaccatagggaactcgggagatggtagtattcagagcaaaaggtagttcagtaaagctttcaaagccccagccaaagggatagaatttagagtcaggacctcattaaaaaaataaaaataaaaaggaactgaaaagagtgaaatgagatgcctgttctaaacaggcctggagatttgagcaagttctcaggacagcaactagaagaaggtaagaatccagaaccagaactcaattaggagacagaaacttggtcttaggagaaagtcagatgccatttattataaatgaggcacaagatcagagataggatctaatcaaacatatattgatgttcagcaccttgaatgttggattgtagaactctttacttttccactgggaccatgtgccagatcattctttatgccatgagtcaaccagagctggaggcatatcatgggttgaccttcgttcatcatgtccaatagaaatagaattatttaaaatacaaataatttttgcttatttatatgcctaaaattcttgcacctttcctactaattcttcagattgcattgagtcacacttatgcttatttagtcttttttttaagtgggaagtatgctcatttaatttgggaaattaggatctctctcttttttttttttttttttttttttaagatatggggtctcactttgttgcccaggctggagtacagtggcacaatcatagcttactgccgcctcaaattcctgggctccagcaatcctcctgcctcagcctctcaagtagctaggactataggcatgcaccaccacaccaaactaattttaaaaacatgtttgtttgttttttggtagagacagggtcttgccatcttgcccagactggtctcgaaatctgagttcaatcagtccttctgcctcagcctcccaaagtgctgggattacaggcgtgagccaccatgcccagccatcttatttttttataatccttctcattccttaagaaactgaaaggctggaagcttctcccttgaatagaaagcttcccagtttccagtcacctagataatagggtcaactcaattaaattaattcttaaagatgtataaacaggaaatcgtggtctttgcattgctgtaaagaaatacctgagaccggggctgggcgtggtggctcacacctgtaatcccagcacttttggagcccaaggcaggagaatcacttgaacctgggaggcagaggttgcagtgagctgagatcacgccattgcactccggcctgggcaacaagagcaaaactccatctcaaaaaaaaaaaaaaaaaaaaaaaaaaaaagaaatacctgagactggataatttataaagaaaagagttttgattggcttgtgattctacaggctgtacaagcatgactccagcatctgcttctggtgagggccacaggaaagtttcaatcatagtggaaggtgaagaggagcagcatattatatggcaagggaatggggagataccacactcttttaagcaacaagatctcatgtgaaccaccagagccagaattcactcatcaccaaggggatggagctaagcccattcatgagggatacacctccatgatccaaacaccttccaccaggcttcacctccaacattggggattacacttcaacatgagatttggcgaggatgaatatccagcccatgtcattctacccctggcctctcaaaccctcaaatctcatgtccttctcacactgtaaaatccaaccggcccttctcaatagttgcctcaagtcttattccaacattaactcaaaagtcccaagtccaaagcctcatctggagatgagatccttctacctgtaagtctatgaggttaaatacaagttaaccattcccagttacaatggtggtacaggcactgggtaaacattcccattccaaaaggaagaaattggccaaaagaaaagggtaacaggccccatgcagttctgaaacccagcagggcagacattaaaccttaaagctcctaaataatccttgtttccatgtcccacaccctgggcacactggtgcaagtggtaggctcccaaggccttgggcagctctgcccctgtggctttgcagggtacagcccacatgactgctctcactagatggaatgcctgtggcttttccaggctgaggattcaagctgcccatggcgctaccatactgtggtctgaagggaaacagcctctttcctgcagcttcactaggcagtgccctggtggaggactctgtgtgggggctccagccccacatttttcctccacactgccctagtagaggttctctgtgcaggcgctgcccctgtggcagtcttctgcctgggcactgaggctttttcatacatgtcctgaaatctaggggaaatctgccaagcatccttcatgcttgcattctgtgtacctgcagacttaacatgacatggaagctgccaaggcttatggcttgcaccctctggagcagcagcctgaactgtacctgggcactttgagccatgactggagccagaacagctgggatgtgggaagcaatgttctgagactgaccaggacaatggggccccgggcctggcccctgaagccattctttcttcctaggcctctcttcctatgatgggaggggctgtctccaagatctctgaaataccttcaaggccttttgcccattgtcgtggatattagcacttggctcccttttagttatgctactctctttagcaagtagttgctccatagcctgcttgaattcctctcctgtaaatgctttttcatgctctgccacatgattagactgcaaactttccaaacttctttgttctgcttcccttttaaatataggttccagttttaagtcatttccttactcccatatttgattgtaggttgttagaagcagccatactacctctagaacactttgctgcttagaaaatttttccaccagataccctgttatcattaagttcaaacttccacaaatccctaggactcagacacgatgcagccaagttatttggtagggaataacaagggtgacctttgctccagttcctaataaattcctcattttcatctgagacatcctcagcctggccttcactgtccatatttctatcagcattgtggccacaatcacctaacaagtctctaagaagttccaaactttcccacatcttcctttctttctctgagccctccaaactcttccaacctctacctgttacccaattccaaagctgcttcccacatcttcaggtattaatagcaacccctcactccttggtaccaatttttatgttacaccatttttgcacatctgtaaagaaacacctgagactttgtgtaattttcaaagaaaggggtttaatttggcccatgtttctgcaagctgtacaggcatggcaccaacatctgttcaactcctggtgagaacctcaggaagcttacaatcatggcagaaggtgaaggagaaccagcatatcacatggaaagagcgggaccaagagagagatgggggatgtgccacacacttttaaacaaccagatcttgtgtgaactaccagagccagaattcactcatcaccaaggggaaggtgctaaggcattcatgagggaaccacctccatgatccagacacctcccaccaggtccccccttcaatgttggggataacattttgacataagatttggaagggacagaaatccccaccatgtttggtggcatcatgggctgacattaatacatctctttaatgggattggaagttaggagatgtttcaaggaggagattaccttgaactgagctgtcctggtcagttggccatctgagagaaagaaatggggtccctgccacaaggcgcctgggaaattaaatcccagttagagaaataggaagacactcaggaagtaatcagaaagacacttcactggttatttccccccagcagttttgctgcgatgaatttcaggggtagaagcaggaatggtggaataaggaattggaattcaggcctacttgtataaggccctcctcagttgacctataccagtatttctacatttttcttatttgacttctcttaccttgtaaaatatatagaaatcagtggtttctagggtctgcagagtggggtgggtggcactaaaatacagtagatgttaatacccgtcttagacttaatgaatcagaattatccagggtgggatccaggaatctgaacttttaacaaatctcttttgttattcttaactggtactcctcaatttactgtttaggaatcttacacatgggggaggttgagacacttaactaagctagttggtggcagaaatgaaactgtgatatggatcttctaactcctgctctaaagcttttgatttatagtatagtattaatgaacttctattgtgaacttgcagaccgtttaatattaggttcaatatactatgtttaaatgggaatgaatttcacagggcttatagagcctttccccataattgtaaaatttttgcagcaaccgctatattactgttgctacaattttctttgctaattaggtctctttgccttgtagctctcacttttaaattgtttttgttttgtcatttagtagatctcagagcaattaactaaactaattcttccatctttttttaaatggagacatctcctcctcactatggcaggaagatctgtgatttctagtataactgcttgatgtgaggacagggttacttgggaaagaactttcagcatgagtgatttaattatctgcctccattagataggtacctttctcttgcttggctcctaataaaggaacaagcactctcatccattttacggtttaaataaattttacagttaaatatgactagatatacttttagtacccaaagttgtggatattttgttccataaaagctaattactaatagaaaatggtttgctagataaattacttaactgaaaatatactagaagcttatttgtgctttctaaaaaagttgataattatgattcactggttagaagttgtagattttacatatccctgatgtatagatggataagtgcaaataggaaaactatgctcttaaattatcatgattgcttgaaaacttggtaatgctcagttctcagtctggtttcatactagaaactcctggaagttcttaaaaatacaagtgaccacattctactcctgagaaatttctatttatttgacctaagatggatctcctgcctctgtgtgttatgaaagctccccaggtgattttaataagcagccatggttgagagccaatggtctaatggaaagagaactgaattataatcaggaaacttgtcattccagtcttaattctgtgaactcaggtaaatcatctaacatatttaagcttgcattgtaaaatggaggtaattaataatggcctatatgccggattaatatttttacagttgaatgaaactatatactcaaaagtgctttgcagtaaagtgttatacagatggtggcatagcaattaagatttactacgcaatatactactgtgaagtggtatgtttagtcttttgtacttcttggcagaaagatgctagatcccctgtggcagaaagaaacttaggctccttagcgatcctcagggtatattattatgattcttaaagttcactctgtatttttatgtgtaccaggctgctagtgtctctaggtgatagggggaaaaggtagaggaaagggtggagttgctcctgctggtgattttttaaaattgtgagttcctataattagtaacatccttcttacatcttcatagagacatggttggtagcagtggagtcgtttatataactttacaaaccctctcttgtgtactctttttcaatgttattctcttaaatcacttctgtctctgctttccctagtgtttaagcttcactaacatttacctatatataaatggatgaggacagaagagaaagggtccccaaagatgaatacactcattactggtttcccaacatgatataaacctaggacttcaccccttggagggatgaaagtttactatgcatagcatttcctggtgtgtcagtctcggtacagcctcttgctcaattcatcagctgtttccaggcaaaattacataccacttcttgagtgttttaaagcctcctaactgtatatatgtgagttctttgatatattgacttctttttctttgagtcgattcccagtagtggcattgctggatcaaatggtaattatatttttatttttttgagaaatctccatactgttttccatagtggctgtactagtttacattcccaccaacagtgtatatgagttcccttttctccactttcttgtcaacatctgtcttttttaataatagggattctggctgaggtatgctatctcattgtggttttgatttgcatttctctgatgattcatgaggttgaacattttttcatatacctgttggctgtttgtatttatttttttgagaaatggctattcatatactttgcccaagtatgaatgggattatttgtttttttcctgttgagttgagttccttatctgttctatatattagttcctgttggataaataatttgcaaatattttatcccattctgcaggttgtctcttcactctgttgatttttttgttttgtttttttttttttgtgtgtgggagctttttagtttaattaattcccaatcacttatttttggttttgttgcctgatcttttgaggcctttgtaacaaattctttgcctaaaccaacaaccaggagagggttccctagattttttcttctaatatttctatagtatcaggttttacttttaagtctttaatctactttgagttcatttttgtatatggtgagataatggtccagttacattcttctgcatggctatacaattttcccagcaccgtttattgaagagattgtcctttccccagtgtaagtttttgttgtttgtttttgtgtttttttgagacagagtcttgccttgtcacccaggctggagtgcagtggcatgatcactgctcactgtggcctcaacctcatgggcccagatgatccccctgcctcaccctcccaagtagctcagactacaggcatttgctgccacacctgactggtgttttattttttgtagagatggggtctcactctgttgcctaggctggttttgaactcctgggttcaagcaatcctcctgcctcagccttccaaagtgttgggattacaggtgtgagccactgtacccggcccccagtataaattcttgttggctttgttgaagatcagttggctgtaactatgtgtctttatttctgagttctctgttttgttctactggtctatgtggctacttttataccatgttgtggcatttttaaggattttttttttaagtggggagtttgagaccagcctgggcaacatggcaaaagcctatttctacaaaaaaaaaaaaaaaaaaaaaaaaagtagaaaaattagccaggcatggtggcatgcgcctatagacccagctacttgggaggctgaggtgggaggattgcttgagcctggaaggttgaggctgtggtgagccatgatagcactactatgctccagcctgggtgacagagcaagaccctgtctcaaaaaaaaaagaagaagaagaagaggaagaggagggggaggggggaggaggaggaaagaagaagaagaggaggagggggagggggaggaggaagaaagaagaagaggaagaggagagggagggggaggaggaggaaagaagaagaagaggaggagggggagggggaggaggaggaaagaagaagaagaaagaaaagggggccagatgcggtggctcagcttgtaatcccagcactttaggaggccaaggcaggtggatcacttgaggtcaggagttcgagaccagcctaactaatgtggtgaaacccatctctactaaaaatacaaaaattagttgagtgtagtggcgcacacctgtaatcccagctactcgggaggctgaggcaggagatttgcttaagcccaggaggcggaggttgcagtgagctgagatcgcgccactgcactccagcctaagcgacagagcaagacttcatttcaaagaaaaaggaagaaagaaaagtggtatgagcacaagaactctaacaaaagatttctggatggattgggttaatggaaaactggcagaagcctggaggaaggagaaggtcaagatcagctaatagtagctgataagaagtcctgtatcattatgaagagtatcaaaagcacccctgcagcctgggatggttgactgataactataactgtaaaacaatataatccgatgtgtatcatgacttaagagaatttgagaagaacagaaaggtgaatgccagtattcaatggccaatggaacatgtgtttagggactttatagcaatacttcagtgctctaatgttcaggtcatacctccctatcattccctaggtggtgtgttatctgtttatatttttatctgctatcctaatctgggagtcctctgagtgtagggatgacttatccatctttgtaaatgtcctcaaaatgcttgacatatgatgaatatgttaccacaacaccaggggttcagtctaggtcctgctgctcacagcacagaaagccaatgactaagatgatgattattgccaaggaagaaggctttaattgggggctgcagcagacgagatgagatgggagctcagtctcaaatccatctccctgacaaactgaaactagggacttatatagcagggaagagatatagcaatatgtaagaaacaggaactagagaggggtaaggaagcaattatggtgaatgaggggccctcatctcattatctggatatggtgatctggtgagttccagttcttccatacttttttttgagagacctgaaggtcctttgttgagtaaggaatccgataaaacaaatgttaaggttcaagcttcaagaccaaaaacgtcaatttctatgtttatccaaaaaactatctattgaactattgggtcagtttgaaacacatgttaaaacctctaatttgatttccttatctcattttgcctgccttgtttctgaaagttttatctaattcagatgtcacaaacctctaaaaatttctttccttgttcaacaaaccccctatgtcacaagtttacctgcataacaaacctgaacatatacctttgaacctaaaataaaagtttaaaataaatgaataaataaataaataatagcaaaactatgtttttttaaaaaaaattcttctcagagtcacctatgataaagacttctagattttgtagatattttactacttaatctgtacaaacaagtgtaaaccaagaaaatattttaaaattactcatgactaaacagatgcattcatgttaaacttatctctcatccctacccattcttgaactctttctcattcactagtcatttatgaaaaaactgtataacaaataactataataaaatggaaaatatataattaagctagaggaaaggaagggtgggagtcatcctttttttttggtatatgttagtaaattaatagtaaaaataagggaggacttagccataagggttttaaaacagcatgtctcaatttgtatacaaggctactatgttggtctgtgaaatacgtaaaaaaaaaaaaaaaaaaaaaaaaaaagcgattgattttcagtgctgcaatcctgacctctagtggacattcagaacaaaacccaaacatcacattcttttatttagttactccatcaagcaccattagccaacctaaaatattaaactttcaaagagattaaaacatgagaagcagaataaagtaaaagaatttttggctaatattctaaatattcttgctgtagaacctgtatttaagagcagctagtattaacttatttctttttgcgtgttaattatctgtcactttcactactttctttgaaacaatgcattgctttatagatcatagcagcaagaaatttatcagagaagccaaatggattttcttttgattacctgtaatatataacaagctatacgaaaactgagtggctttaaaaggacaatgatttttatagtgagacatatagtgatgttatgtaacctcctgatagaatgcactgagaagggcacagcatcacttctgtggtatttgtgcccaaaatacatattctgaatttaatcataaggaaccagtagacatatcgagttgagggacattttataaaataactggccaatactcttccaaagcatcaaggtcatgaaaaataaacactgaaaacggtcccatatgaaaggagactaaggagacatgacaaccaaattcaatatataatccagaattgcatcctggaccagaaaaagggcattagtggagcatttgataaaaataatagtttcttggttttgatcattatactatggttatgtaagatgttaatgtttgggtaaaactgagtgaaggatatgtaggacttcttggtactgtttttgcaaagtttttctaaatccgaaattatttccaagtgaaaaaaagtaattaaaaccaatcatttattttcttacaatctcatgagtcagaaattttggaattcaactgtgtggttcatctctgatccacttggcatcagctggaccacctgattcacttccagatgacttctttactcacatatctaccactttggtgattcttggtctttcttctttactgatgaaatctggttctccaggccttcttttgattgcttggttccttagagagcatgggagtataagtataattgcacttcttatatggtagctggcttcgaaaagtgagtgctccaagggactgaacatgaaagctgtcaatatctgaaggcctgggcacataaactagcatggcatcacttccaccatattctactggtaaaagcagtaccatagtctgcccaggttgaaatgagagaacagagaccttaactctcaatggagaagcatcaaataattgtgactctttaatccatcacagatatctaacaaaagtctcactgagttggcactcaagatggaattagtggaaaaaagcctggatttgctttagtctgatagacctgagttatagcctggctttaccatttactaacagtgttctgtctctgagcttcagtttagccatctctaaaatggtggcaataatacatatgccatagagctgttgagaggattaagtgaaaaatataaaatactggatataatgggcaataaatacatgaacctaataataataattgctagtgtttatcgaatatttaccaaatactcagttcacttgatgtatgctatctcatttagtcattatctcttcctagggtggtatgttttcttttgtatgggtcagaaaggacagaaccccatttcctctagctttgtctgtgaacctgctccatttactttggccatttttggtttgataatttggtaatttggtttattgacttgttgttaggatttccattatttcccttttattttgattcctaagaacccaggtgctgatgcacacttggtactttttgacactaccttttcagcatttgttctcagtgctgtcagcttaagtttttgacagcttctcacacaatctgtcagctctctctgaacccacgattgcctgcttatcagagccagaatgttcagtgtctttgtttcagtgagtgctctactgtcagctgttattttatgcaagattgtgggtgcttaatccttggcctacccaagaacatcatgatctgcactttggagcaattattcaatttggggcaattacttgtaggtgttctttaaagcaaagatgatgccagaatgtaattgaattttgaaatagcagtatccaaatcagttaaaaagctacttcgtcatgcatgcaaggctgatctcaatctgttgtcattagaggaaggtggtgaccctttcttcccacagcaagttgggtttttgttgcctcatatactgcaagcagtcagctactttttttgagtgttttcaatatggaaacaaataatagaatttagttctggtagaagtcacttatttgttatctttttactctctgctctcaaaatttacttgcctttaaatggaaagaatcactttaatcctttaggaagtagaggacacattaaataatatccaaataagagatttattcattcattcacatattcattgaatcatcttctctaacttaattgtttagagtatcacttttggaattaggttaaaatcctagatctgcacttattagctattggacttaggaaagttactttgatttctctaaatcttgatttccttgtgtataaaatggaattttaggtggttgtgggatgaaatagggacatgcctttaatgtaattaattcatatcttggcacatacaaaatactcagtagatgttggttattattttgcatttggagttagaccttgtactataaatgataagtggccataatatgtttacttattttttactcttaataattctccaaacctttgactcctactacgtacatgttttccccttaagaacaaacaaattgctggggattacatattcctaaaaatgggaggcatcttgaaaatgtatgagatattttgcttttaaaaatacatttcaaggctgagtgtattgtctcatgcctgtaatcccagcatgttgtgaggccaaggcagaaggatcacttgagcccaggaattggagaccagcttgggcaacatagggatacctcatctctacgaaaaaattaaaaattagccagatatggtggcacacacatgtagtcccagctacttggaagctgagttgagaggattgcttgagcctgggaggttgaggctgcagtgagtggtgatcacaccactgcactccagcttgtgtgacagagtgaaattctatctctaaaaaaaaaaaaaaaaaaaaaaaacctgatagaataacaagttcttttctgaattccatcaactcaaatgtcttaaagtgtatttgtttgcatcgtctagccactctgttctactttagttcaaggcttatgaagtctttatttttatgggtaatgtctagagcttcatataagcagatatagtaataccttatttttctgaacttgtttaaagaatttacatacataaatttttctggtaactgaaagtttcctctttagcttcccaaacttcaaaacatcattatctactttttatttaaaacacacactcacctcccttcttaagcacagtattataacatgatataagcattcatcaatcctgctggattatcattattaataatgacaattaacagtagttaataattaactattgaagattattggctcccccaagtggacccagagagctatgcattttatctttttttttttttaatatatgtcttcatttctgtgagatctaatattttaattctgacaactgtctctataagctatctatccctgaccccatctggcacatactttatcttgtagtttgctacttgtaatatctataagcttcaaaatcatatcaccaaactaactggaagtatgtatagaataaaaagtttagcaaagtttcctcttggtgtttgtgagagctattttggctatttagagatctttatttacttaatttttacttgtaagttctttgtgtcttggacagcttggttgtctaattgtttgattttgagataattgaagaaaggggttcttactgtaatttgatgataattctgtaaattggtctagttgggtccacagggaaataatcaacccccgaaaatttgggaaagctagtgtagtttaatcattcagtcttcaaataagcatttactatgcacattataccagcactgtgtgagaatatctcacacaggaggcttgagggggtgattctagcctgttactaaacacatatgtaaaccaaaaacatctgagatgggtttcaatcaatttagaggtttattttgccaagttacagaccatgatccatgacacagcctcaggaggtcctgagaacatgtgcccaaggtgattgggtttcagattggttttatatgttttagggaaacataagacattaatccatggccgagcacagtggctcatgcccttaatcttagcactttgggaggctgaggcaggagggttgcttgaggccaggagttcaagaatagcttgggcaatatagtgaaaccctctctaccaaaaaaaaagaaaaaaaaattatctgggcgtggtggcatatgcctgtagttccagctacttgggaggctgatgtggaaagattgcttgagttcaaaaggtcaaggctgcagtgagctctgatggtgccactgcactccagtctgggtgacagaacgagactctgttcttaaaaaaaaaaaagacatcagtccgggtgcgctggctcacacatgtaatcccggcactttgggaggccaagacgggcagatcacttgaggtcaaaagtttgagactagcctggccaaaatggtgaaaccccgcctctactaaaaatacaaaagttagccaggtgtggtggcagagcctgtagccccagctacatgggaggctgaggcacaagaatcgcctgaacccaggaagtggaggttgcagtgagccaagattgcaccactgcactctagcctgggcgacagagcaagactctgtctcaaaaaaaaaaaaaagaaaaaagaaaagacatcagtcaatacatgtgatgtgaagcatacattcattcagtgcagcaataattcagagatggggcttccaggtcataggtggattcaaaaatgttatctttttttttttctgttcttttctttctttctttttgtttgttttttgagacagggtctcgctgtgtcatctaggctggagtgcaatggtgtgatcttggcttactgcagctcaacctcctcagttcaagcactcctcctgcctcagcctcccatgaagctgggaccacaggtgtgtaccaccacacctggctaattttttttttactttcttgtagagatggggtctcactttgttgcccaggttggcaaagatttcctgattggcaattggttgaaagagttgttattatctaaaaacctggaatcaacagaaaggagtgtctgggttaagataagggcttgtaaagactagagttcttattatgtatatgaagtcttatgggtaaccactcccagaggcaataaatggcaaatgtttcctttagacatcctaaaaaggttctagactctcagccaatctcttcaggatcagaaagtgacctggaaagagaagggaatcctctatagaaagtaaattttccccacaagagacaactttgtaggaccatttcaaaatatgttcaaggaatctttattttattttattttttttgagatggagtctcgctctgtcacccaggctggagtgcgatctcggctcattgcaagctccgcctcctgggttcacaccattctcctgcttcggcctcccaagtagctgggactacaggcgcctgccaccacgcccggctaattttttgtatttttagtagagactgggtttcaccatgttagccaggatggtctcgatctcctgacctcgtgatccgcctgcctcggtctcccaaagtgcttttgggataaaatagtttggtttctttcagggccctgctatctgctatgtgatgctatacttagaatcacgttggaatttggtatcttattgctacagggtgtttgctgtctgtcttaggatctctcttttaatgttaatgctggtcagttgtgtgcctgaactccaaagggaggagagtataatgaggcatgcctgattgccccttcctgtcgtgatctgaactatttttttcaggtttagctgggtccctttggtcccagcttagtcagttggagggcttagaattgtctttttggttttcacaggtataatattgggctagtcacattcatactctaagaaatgagaatcattgtataggttgttataacaatcaatgaaatttcacaattcctgtgaatgtaaggaatttggggggaatgtttgacagggaggttaagaatacagccaaggtagctgaacatggagtggagtttccaaaggctaccatgaaaggatttggaaaggaaaggaggagtagcaaactagcttaggataaaggaccagagcattatgaagatgagaaaactagacatgagagggatttgcattttgagcagtgactggaaaaacaagaaccagagaaatagtggatcaggttctgatggcaagctgataaacactcaggttgtgagaattcactgttgcctagtggttgtgatgtggtggtggacagagttggagaacagggcagtaggtcttttttatattggcctttaagttttggcaggtgggcagcagctagtgggtgagaagtcaaattttgattcagaaagcaaattttgcttaattgtaacccacattttaaaatctgtaatagtcttttttttctaattggtaaattgtggtcaaaaccagtccaggataattgcttagtatggtaatgaactgtgttcatttgtttttatctcctggcctgattatacttatttcctattgcttttggtttcttaaataatcagctgagtaaaccccaaaccaaaaatatttggtttatattttaaccaactgaatatttgtgtttatcattcattccttccatcattatgttatatttctggtacctgaatgtgaaagtttatgttagcaaatcataacaggaatacactctaaatatctgggcctaatccttgcttctggagttatttcagagacagaagaagcatggtttattataagttttttggatagcacatttggtatagctccatatccaaaagccagccagaatgtatcagtgaccaagatgaagagggcacatcaaatagaccctggacttatgggacttatgccaactcatacttgaaatatcttttttcttatgtatgatgacttgcatggcaaggaaacagcacattttgtagcaaacatttctgattgttacctttatcatataagattctctatcttttgaatttaataactcaatgtctcttcagagcaattgggcagaacccagagttcaaaattcagttctagaatagcttcttaaggaacaatttaatttgtttatttctaaagaaatattgctatggttttcagaaaaggaaaggaagtctggcagatagcccctaatgaccacctctagttatacaaataatacttgaaagcaattgctaaaacaaataagaaaacaataagaactgtagtggaaatgcagtgtgatacttaaagcctccagtacacaatctgtcccacttatcagcaacactgccttgtttttttttattttattctgtctgccacttgcagtttaactgtaacaccgagatgtccagattagggttaggaatttcaattaataattttagacttctgcatcattatgccagcttgagcaaggaacttgactttcacaagacttaggcacatgcaaataatccagaaattgactgaagggaaataacttattgtaaaaacaattttatgtgaacattgattaaatagcacctaaaatttataacaagccactcagggaaagaaaatacctttaaaaaaaaactcatggtttaattattgtttgtgaagatgaaagcaattaggaattttattaaatatatgtggaagtcttggggaaataataaaatagtgatacatgtggcagtactaatcttcactttctttttctatttcagggtttgaacataatctttcatgtagctttggctctcctaaaggtaagtcttttttttaatcttaagttaccacattctcttacctctttgcccttggaactggaataattcaatttacagtctttgactcatttcagtttctcagacacacaaaaatagatgacttctctgagaaactctgatcctcttccctcctctcatctttttctgttgttgtttatttggagtcttttttttcttataatccatttatttaatggtactatcatagagctctttccagtaacataaaatatctttttatcatatgaattggatgatataagagaaaaggttaaaaattgttttctgtcaaaatgatgcctgcttttttcttaaaacactttttactataacatctctggaggtacctaaacatataattgaattattaaaaagtttttataatatactgactaaaaaagaaactgctacatttcaatttgcagttctttccatgatagttagaaatttataaaacactttagaattctattgtaattaccttgttggattttatgtcaacatatcatacagctttaataatgtggtaactgcaaggcatttgctgcagagttgatgaagataacccagctggtttttgtccttcagtcagagaagacattctgatattaaaggcaataattgcctcaaaggcacaggcttaccctttcctcagtataacatggtggttaaaatggcagacctggactcagacagatttgcttctaatttcagccctaccatatgaccttaggcaaatttttctaagtgctcaaagtctgggttttgagataataataggaattaatttatgggattgttaaaagaattgagatgatcaaagaagtccttagtatagtatctagaacattttactgcctagtaaagttagctgtcattattattgttctttacaaggtgactcagaatgtgttcttagatcccttatcattcttctgaatctctcaaaagataatgatgtggtatcataggaggacctcttgatacgttaggagagccttaaccatacctaaccattaacataaccttgattctaaacaaaggcatgaaatagtacaggccctctgcaactcagtaagtggatttctattcctcatctcttattcctttacacatttgctctttgtgaagttcataagatacactttttaaaattaaatcgattgtgtttatatattttttatgccaaagctatttagaaaatagaaaaatattttaaataaaataacacaaacatatttgctgtgtcccttaatgaagtcatgggttttgacctctaatttttttctttcattaaaacaaatccaagctgaaactttccaacatgtcctctcaacagggctggaataagacttttagaatgcctaagcattgaaagtatatgtaatacagactaaaaaaatattaaaacataaagtaagtataaggaggtccaagaaagttctgatttctcatattatatctaatgttttaaactctcagatattatgtctttcctaaaatgcctttcctcatttttttggtgacttatctttactagtgctttcactgaatgcttaatctgtcttttgagtaacccaggactacctctctggatatcagacctataccctgtgtcaacttaatactatatacattagtaaattatcttcttgattgacatgttgacttgttcatattattttcatttattttgtccatgttaacacagacaaggcctctacagaggacatactctggccactgggcaggaaggctttgtctgtcttctttagcaatacatgggcactcttgtagcatcatcttagagaattttactagttagagaagataaaaagagccttctcaccactagtgccctatatttatgtaacttccttatatgaatcctgaagctgacccccccaatagacagagtatatatgggactaaactgaagtgtactttaatgatctattgccaccacttggaaaaaaagaatacgcaaacatatatgacagtcactgactttcagcttctagtgtagtataccagataaaataatatgtatttgtttatatcaaaattaaaaactttggagaagttcaaattgctgggtttttttttcttttgttttgttttgttttttgctttttgagacagggtcttattctgctcactctgttgcctaggctggagtatagtggcgtggtgatagcttactgcagcctcaaattcctgggctcaagtgatcctccctcctcagcctcttgaggagctagaattacaggtagatgccaccatgcccagctaattttaaaaatattgtagagacaggggtctcactatgttgctcaggctggtctcaaactcctggactcaagcagtcctcctgccttggcctcccaaagcactgggattataggtgtgagccaatgagcctggccttcaaagtgcttatgaattgagcctaaggaattttcagtatagctacagagagacttcagatttctctgtattataagcatttcttgtgatgaggggacagaactaacatttcttgaacatttatactctgtgttaagtactaacagattatctcattaacatacattaaatgtctaggatttatttgtagaatagtaatggtattagccagagaaaacatctaattcttcccccagcccctagttgataattgagagatcaaagctcaagatcaccttaagacttttgtctcagtagtgggaaagttggatttataatttttttgaatgggatagatataggatgaattctgtgttgctcagttaggttttaaagacacctactttctgaacgggaccaacttctttttggttagtaatagcctatcaggtagctaaaaagctatggacctaaaagaatgattcacaatactaggcagcatcatgaaatcattttgtgtccagtaggtaggtcagatatattcctccaaatgtaatttatttacttatatgaaacattaggtagtcatagaatacattcaatagatttaatagactggagatgatcagtcagaattgttcttagcacttcatgttgggcacagaaatttttcagtcagaataggttttttgtttgctgtccgtggttaaaagcaaatgacagagtgtttttctctggccttcccaaagtattatatgcttatttcgtgtcctacatgtgtatgcagacactacagagataaagaaagcccaatcataatcctgttcccagggatgaccataataaaaacttggtataaaacctttatcccatgctttggcctatggttatataagtatgcattacctacctatacacatatgtatatatgtatgtatgtatatttttaatctgagtttgagataagatgggaaagtgggaggaaatccagaagaacagtgtgaaaggatgcacataaatttattttctttcaaaaaatgctgttgaacaatactctttttcattcagtatatcgtgaatatctttccatgtcactaaacacatgtaagggttaaaagcatgtggacattggagtcagactacttaaattcagattcattcaaaacaatttatccaatggtcttaggtaaattacaatttctccattttttaaatgggggaatattagtaataccagtctcataagattgttgtcagagtttaatgagttaatatatgattgatgcctagaactcagtactacagtgtactgaggtgctattgttagagacagaatttctcttttgactggtttttatcctactgtatgtgccataatttattttgaggcagagtctggttctgttgcccaggctgcagagcggtggcacaatcttggctcactgcaacctccgcctcctggggtgcaagtgattctcctgcctcagcctcctgagtggctgggattacaagtgcaagccaccaagccctgctaaattttgtatttttagtagagacggggtttcaccatgttggccaggctggtctcgaactcctaacctcaggtgatccacctgcctcagcctcccaaagtgttgggattacaggcatgagccaccgcaccctgccctgtaccatatatatatatatttttttttgaaagccactgactttattgatctaaaaaactttacaaggacagtgacttttctgccaaaaaaggagccaaatggtatcaaacggactgaaattgagggtgggggtgagggatggggccaggaatccattcaggaaagctggtgactgtccccagggaagtagcaggggaaaaaggaaggcggaggcatgcaagagtgagaatccaaaaaagttaaaatgattaggagagaaaactcccaaaagaccctggagtacattggaggtgagtaggacaatagcagtcttttcctttgttgaggacaggggaggagtccctactcggttgcaaactccggatgagggctggggattgagggcttcccagaaagcatcacaagaaggtgtcacaccactctcgaaggcatctgaagcagtcctgggactgcttggcattggcaccaccagtgtccctcagccattctcagaagaggtcttcatctttctttagcaccagaaactggccaaggacaacataggccttgtcaaagcacccttcctccagcttcttgtccataacttcaccaatcccggccaggctccctactggcttttcccccacggactctgccacaaagtctcggtgcttttgggaggttgtaatcttgttcaggtttaattgtcagcttcagttcccataatggttcctcctgccacctggctgctcctgcctatacctcaagccactagaactttcccctgtaccacaatttatttaaccaattttatatttagtttttatggacatttgtttccagaatttcctgttaaataaaaccgtaacaaatatccttaaacttgcatctttgcatacttatctgatatctctggggtaaatttctagagatggaattgctaggtcaaactgtaaccaaattttaattttggatacatattacaaaattcttctctgctagcaatgtgagagtacattttcccatactcttcaaaaatttctaaacattaagcacctttatggaaatcaaaagcaagttataaatataaatataatatataaatatataaatttatttatacataaatataataaatataaatgtaaaacaaagcaatttaaaagtaatgatttagtaattttttattactaaatcatataaataaagctcttcagccagctttgaagactccagtattttcttttttggggagaatatccagtttctttagggaagcagtggatcatggctaaattctagaagactggaccttctcttagtttggaggggcttatataaaagttctgacactttagggggccaaggtgggtgaattaggtcaagggttcgagaccagcctggccaacatgacgaaaccccgtctctactaaaaatacaaaaaacgccaggcgtggtggtgggcacctgtaatcccagctacttgggaggctgaggcacaagaatcgcttgaacccgggaggcagagtttgcagtgagccaagattgcaccattgcactccagcctgagtgacagagcgagactccatctcaaaaaaaaaaaaaaaagagttctgaagtgtatctttgatgtttttggcttttcagccctttccagtatggtttttccttaccattccattgaagcttttttagtatcttacttgatccttcaacagttgtcaaaacagcataatgacatacacaacgcttccttttttttccccttctttttttatgttttggaaacatcttcccttggtttctgtcctttcttttatctccccctctgctacttctgtctttttttttcctcactcctttttccccctagccattagcttggagttctacagatctccagcctctaggaatttgcttattgcttctcccttgttgatcttattcattcccctggtttcatctataaatgtttactctcatttatttttattttttttaatccctcaccgccctcccaccctttccccttctgagtctccaatgtccattttctactttgtatgcttttgcatacccatagcttagctctcacttagtgagaacatttggtatttggttttccattcctgagttacttcacttaggataatggcctcctctttcaagtttctacaaaagacattatttcattcttttttatggctgagtagtattccatggtgtatatattaatatatcacattttctcatctactcctcaggtgatgggcacttaggttgatgtttactctcatttatatttaatccaaacccacatatttggctgtggactgaacatgtcggcttggatgtttcacaggcacatcaaaagtcaaaactgaaataatgtgccctcccaaatgtacttttcatctagtaacctccacttcagtaaggactctacccagctgctcaaaccagaaacctagaagttatccttaactctcttctcaatatcccatatcagttcagtcaccaagtcctgtggattctacttcttgaaaatttttagaatcttcccacttttctcctattcttacttaggtagcttttaggccaccaaattttccaggaagatgatgccctcctggattattgcaggacctcctgtaataataaatattggatacctatgaagtgccaggtactgttctagacattggagataaagtagtaaccaggaaagaccctgctttcatggaacttgcattccaatgagagaaagatagtaattaaacaaataaatgaatatatatgttagttcattcttgcattgctataaagaaacattcgaggctgggtaatttatttaaaaaaaaaaaaaaaaaaaaagaagtttcagccaggtacattggctcatgcctgtaatcccagcactttgggaggccaaggtgggcggatcactggaggtcaggagttagagaccagcctggccaacatagtgaaaccctgtctctactaaaaatataaaaattagccaggcatggtggcgtgtgcctgtagtcccagctacttgggaggctgaggcaggagaatctcttgaacctgggaggcagaggttgcagtgagccaaaattgcaccactgcactccagcctgggcaacagagtgagactctgtctccaaaaaaaaaaaaagaaaaaaaatggttttattttggcttacagttcaacaggttatatacgaaacatagtactgatatctgcttctggtgagggcctcaggaagcttacaatcatggcagaaagcaaggggagctgtatatcacatgacaagaggagaagcaagatacagaagggggaggtcccagactcttttacaacagccagatctcacgtgaactcactgagtgagaactagctcattagcaaggggatggcaataagccattcatgagggatctacactcccatgacccaaacacctcccactcggccctaccttcaacattggggattacacttcaacatgagatttggaggggactacacttcaacatgagatttggaggggacaaacatccaaaccatatcaatatgattagtttagatcatgctgaggtttatgaaagaggtaggtttgagaagatggtggcttggatttgagtgttagcagtggaactgacagaagtgggtgactgcactttccccatatactcttgaccattgttgagtccgttgccacactgccagtagtctttttaaagcagatttttttttttttactttgaatttcaggggtacttgtgtaggtctgttatatagataaattgtgtgtcatgggggtttggtatacagattatttcttcacccaggtgataagcatagtacccaataggtggtttttggatcctcaccctcctccaccctcaagtaggccccatgtctattgttcccttctttgtgtccacgtgtactcaatgtttagctcccacttacaagtgagagcacgtggtatttggttttctgttctgtgttagtttgcttcggatgatggcctccagctgcatccatgctgctgcaaaggacatgatctcattctccttatggatgcatagtattctatagtgtttaccacattttatttaaccagggtactgttgatgggcatctaggttgattccatgtctttgctattgtgaatagtgctgcgatgaacatgcatgtgcatgtgtctttatggtagaacagtttatattcctttgggcatatacaaagtaatgggatggctggatcaaatggtaattctgttgtaagttctttgagaaattgccaaactgctttccatggtggctgaactaatttgtattcccaccaacagtgtataagcattctctttactcttcaccctcacccagcatctgttgttttttggctttttaatactattaaagcagattttagtcattattcaacaatatttagtaaacacctatttagagacagatactgttctatgtgcttgaatagaaatgagtgaactaaagtaacaaagctacttgcctctgtggaaattattttctagcaagagacagttgataattgtattagttcattttcacactgctgataaagacatacacaagactgggcaatttataaaagaaagaggtttaatggacttacagttccacgtggctgggccaggcctcacaatcatgaaggacggcaaggaggagcaagtcacatccaacatggatggcagcagacaaagagagagggcttgtgtagggaaactcttgtttttatttatttatttattttttaatttaaaagtaaactttaatgtcaaaaatgcaaacttgaggaggccagaaagatcacacacaagactgccacttcacacttggatggttgcacagcagtccggcagaggcgctcctcacttgccagacagtgcgggggccagggagaggcactcctcacttcccagagggtggcacggccaggcagaggcgctcctcagttttcagacggtgcagccgccaggcagaggtgctcctcacttcccagacaatgcaggggccggggagaggcgctgctcacttcccagcagaggctctcctcacttcccagatggtggggccgcctagcagaggcgctcctcatttttcagacggtgcggccgccaggcagaggcactcctcacttcccagacggagacagtgtgggggccggacaagggccgaacagaggcattcctcacttcccagacggtggaaactcccgtttttaaaacatcagatctcatgagactattcactaccaggagaacagcatgggaaagacccaccaccatgattcaattacattccaccaagttcctcccacaacacatgggaattgtgggagttagaattcaagatgaggtttgggtggggacacagccaaaccatatcaacaataaacataataaatatataaatatagtatattagaagttatagtattatggggaaaaggaaaagtaccgcagggtgatgggagttatgggtaggttgcaatgttaaatagggtagtcaggataggccccaactagagggtgagatttggacaaagactgcaggtagtgaggggatgctctgtgctgggagtgtgactgagtgttgagggacagatggaagccagcgagactgcaacaagagagtgagggaagggcggtaggagatgaggtcagagaagtaaattttttcttgcttaaagtcctttaaaggcctccattgctcttaggataaagttcacaattttgacacagtccacatagtttttatgatctggcacaacttacctctccatcctcaactgccccttccctccctctcatttgcactgtctcaatcaagccataatgaacttctttcaggttttcccaatagaccaatctgtctttcacttaagagtcatcacatatactggtttcctctgccaggaatgctctgtctccctctcttcaataagctaatttccatttagctttactacgttaggaactttctgtgccttctgcaaacttaggttagacagtgaaaacacaggttccctttgtcttctaggacatctatttgacagtcctttgcatacttgggactgatacctgattaaatggttggttggttgttgtcttcctcattgtagttaatctctatgtggggtctgcccactagtttgcctttgtattggagttgctggcacatagtaggcacttaaatatttattgactactgacttagagtcaaattgagaaagcataggttttcttttccctcacttcctcctatgtgtatatgaataagaattctgccaggatagcagctttttcaacccaggtctcctttgctttttttttttttttttttttttttaagatagattctagctctgttgctcaggctggagtgcagtggctctatctcagctcactggaacctccacctcccaggtttaagaggttctcgtgcctcagcctctggaatagctgggactacaggcatgcgccgccacacctggctaatttttgtatttttggtagaggcaggctttcaccatgtgggccaggctggtctcaaactcctggcctaaagtgatccacccgccttggcctcccaaagcgctaggattacaggcatgagccaccgtgcctggcctcctttgcttttaaaaaccttgaaattaattgctcttgtccccagtatttagcttctctcattttcattattgagatataatttatgtgtcataaaattccctttaaaaatgtacaattagtggctgggtgtggtggctcatgcctgtaatcccagcactttgggaggctgaggtgggtggatcagaggtcaggagatcgagaccatcctggctaacacggtgaaaccccgtctctactaaaaaacaaaaaattggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtagcgggcgcctgtagtcccagctactcgggaggctgaggcaggagaatggcgtgaacctgggaggcggagcttgcagtgagccaagatcgcgccactgcactccagcctgggcgacagagcgagactccgtctcaaaaaaaaaaaaaaaaaaaaaaaaaaaaaaaaaaaaaattagccaggcgtggtggcaggtgcctgtagtcccagctatgcaggaggctgaggcaagagaatggcgtgaacccgggaggcggagcttgcagtgagccgagatcgtgccactgcactccagcctgggcaacagagcaagactccgtctcaaaaaaaaaaaaaaaaaaaaaaagtacaattagtggtttgtagggttgtcacaaacttgtgcacccatcacctttatctaattctagaacattcttatcaccccataagcatagtagccacttcccatttccccatcctatcaccacctgacaacttctaatctgttttctatctctgtagatttacctattctgaacatttcatataaatgggatcatatgataagtggtcttttgtgactggctttttttccttagcataatgttttcaacgtttatccatgtcgtagcatatatcagttcttaattcctttttattgctagataatattccattgttcaaatgtaccacattttatttatccattaatcagttaataaacatttcagttgtttccattttgattgttatgaataatactactgtgaacatttgtgtacaaggttttgtgaacatatgctttcagttctcttggttatatgcctaggaacagaattcttggatcatatggtaattatgtgtttaactttttaaggagctgccaaacagttttccaaagcagctgcaccattacatcccccgtggcaacgtataagtatgttgtaaggcctaaaattaaagcccaatatgatgtgctgcctcaacatctggcagaaatcaggaaggcctccagtcacctaagtgcaaggtctcctccttattttgctcctgtggataaggtttcctagccaaacaaccctccttagccaaagggtgaggcgctgttcttttctttgattttgtttttttagggctggggtctcactctgttgcccaggttggagtgcagtggcacaatcatagctcattgcaacctccaattcctagactcaatccttctgcctcagcctccaaagtagctgagactgtaggcgtgagccactatacccagtggcattgttctttcttagagtagcaaacttcagttccttgccagcctgtgtcattattcagacaagccaatcacatcatcccaggggagctagggggcaccccactctcttgataccataaagctgcctcccacagcccctgattgttcactgtgttttaatccagcccttccatgatgttttcctcccttggggatgtgaatacctgttactaataaactactgtcaatctcatctgtccgtgtcaggtaaactactgtcaatctcatctgtccgtgtcaatctcatctgtccgtgtttgaccatggctgcaaccgtagggcaggaattcctcccgtattagcagggtgaataggagacaatcgaaacaatgagggtttgattcttctacatccttgctaacacttgttattgtctactttattttttattatagccaccttagtggacatgaagtgacatcttgttatgttttgatttgcattctcctgatgtgggacatcttttctagtctacagccataccaccctgaatgcgcccgatctcatctgaacatattttcatgtgcttattggccgtttgtatatcttttttggagaaatggctgttcagatcctttgcccactttctaattgggtttcctgcacttttattgttgagttgtaacagatatatattttttgagtcagggtctcattctgttgcccaggctggaatgcagtggcataatcatggctcactgcagtttcagactcctgggctcaaaggatcctcctacatcagactcccaagtagctgtgactacgtgtgtgccaccatgtccagcaaatttttttttttttttagagacagggtcttactatgttgcccaggctgagctataacagttctttatatgtgctgggtattgcctcccattctgtggactgtcttttcattttctagataatgtcctttgaaacacaaacatttttaattttaaggaagtccaatttattttttctttagttgtttgtgcatttggtgtcatatctaaggtcacgaaaatttcttcttctaagggttttataattgtagcttttacatttaggactttgatgcattttgagttaatttttgtatatgatgtaaggcagggcattatggctgaatcgtgtttcccccctacccccaaaattcatatgttgaagtcgtaacccctagttactcagactgtgacagtatttggaaatagaatctttaaagaggtaattaagttaaaatgagctcattagggtgggccctagtccaatataactagtatccttaagaggacattgggacacagacatgtatggagagaagatcatgcaaagtcacagggagaagacagccatctacaagccaaagtgtgagaagaaacaaaccctgctgacaccttgatcttagacttctagcctccagaactgtgagaaaataaatcactgttgttaagccacccagtctgattcctttttatgacagccctagcataccatacactaggggtacaccttcatcctttagcacatggctatctacttgtccccataccatttgttgaaaagactcttctttctcctttggatggtcttggcatccttgtcaaaaatcagttgaccatggacagttttatttctggagtctctattcccttatctgtgtgtctgttcttacaccagtaccacagtcttgattactctagctttgtaataagttttgagataaggaagtgtgcattctccagttttgttcttctctttcaagattgttttggctattccaggtcccttgcattttcatatgaattttaggatcagtttgtcagtttctgccaaaaaggcaataggattttaatagggattgctttgaatctctgtatccattgaggagtaatgccatctgaatgtaaaccaaaaatgaaatcctaagccccctgaccattcttttacctcagtcccttgacaagggcatctcagaggtaacctgaaaaaacaaattcagcccatgatgggggaaggtgggagtctgacatgcctcattatgccatcttcccttttggaatcaccaatagaacagacttgttaagtctgttaaacatttacaatctattctctccaagcctgctatctggaggcttcacctgcatgataaaaccatggtatccacaaccccttatcttaacccagacattcctaagtgtttagacaacaacttaactttttcaaccaattgccaataagaaaatctttgaatctacctgtgacccggaagctcccacttccccgttgtttcacctttctggaccaaaccaatgtacatcttccatggatttgattgatgtctcatgtcttcctaaaatgtataaaactaagctgttctccgaccaccttgggcacatgttttcatgatctgagggctgtgtcatgggccattggtcatttatatttggctcagcataaacctcttcaaatattttacagagcttgactcttcatcgacattaacaatattgagacttttgatccatgaacatgaggttttttcacatttatttaggtcttatttaattttttttgatgatactttgtggtttttagcatacaaaagtcttaaagcacttgaaaaaatttaattctaacttttattctgcttgatgctattgtgaattgaattgtttgttaatttcattttcactgcgtcctcattactggtatccaaaaatacaactgactttccttttttttttttttgagacggagtctcaccctgtcacccaggctgtagtgcagtggcgcaatctcggctcactgcaagctccgcctcccaggttaaatagaaccaacttatctatattgatcttataacctgcaaccttgttgaactcattttcagctttaatattcatgtatgtgtattgtgtgtttcccaagatttttgaaatacaagatgtcattgtattagtatgttttcatgcagctgataaagacatacccgagactgggcaatttacaaaaaaaaggggtttattggacttacagttccatgtggctggggaggcctcacaatcatgcctgaaggtgaaaggcacatctcacgcggctgtggcaagagagagaatgagagcaaagtgaaacaagtttccccttattaaaacatcagatttcgtgagacttattcactaccacaagaacagtatggaggaaaccacccccatgattcggttatctccacctggtccctcccacaacacatgggaattatgcgagtacaattcaagatgagatttgggtggggacacaaagccaaattgtatcagtcatcttgtagacatatttttacttcttcctttctgatttggatgcattttctttctttttcttgcctaattcctctgactaaaacctccagtactggcagaataggtaactaggcagacatgaacaggacaggagagggccctcctccccaggaatgtcaggtgaccatcaggtaatggtcatgcagttgttaaactatctaacataatggttgtagcttgcgccagggaaaggctgtctcccaatagatagaaaccacctgaagctggtgatcagcagcttcttaataagatctcaggattttgcgagtaggctcaagcatgcccaccaggaggcaaactggtggagtttaacaggtatatgaccctcctctgggaacactagtcaactggtaagggaaaaatacctcaaatgaacatgcacacaacttcagtaaacacactgtacatgcggccccaccccagggctagcaggccactgtgcatgtggacagcccaccccaagggaagaatcaggggagaagaaacacaaaccctggaatcatgccaatgtataaaaccctaagtcaagggtcagacagtatacttgaatctctcaagttgcctgcttggctcacttccaagaatactttacttcctttcattcctgctctaaaagtttttaataaattctcactcctgctcaaaaacttgccttaatctctcactctgccttatgccctcttggacaaattctttttattgaggaggcaagaatctcgagttgctgcagacctgtacagattcactgctaacagtacaatgttgaatggaagtggcaagagtaattatctttgtcttgttcctgatctcttttaccctctatcagaaaagttttttttttccttagaacttcatttctggattactactgtcaccaccattgtcactgtaaccacctgacaggtgcttcctgcccactgcacaaacaaaatcaattcatggagcattgcagtaaagaaagaggttaattgatatgaagacagccacactttgcaggtgatggaattattactcaaatcagtctcattgaaggttagggattttcccaaggtagtttggaagaaggggtggaggtggctagacaatggatacttgctgctgattggttgggggcacaatcataggggtgtggaaaacggtcatcttgtgcgctgagttgcttctgggtggggccacaggagcagttggtgggtccaggtggagccattggtgtcatgcaaaaaacctgaaaagatatcccaaaaggccattcttaggttctataatagtgatgttatctacaggagtaattgggaaagttgcatatcttgtgacctccagaataatggctgacaatcacgtccacaccatagaagaattcaagctcctctatccccctagcctggtggtctctcattagctttacaaggtcggttgagttttggggaaaggctattatcatttaaactataaactaaatgtttcccaaagttagcttggcttaagcccaggaataatgaatggcagcttgaaggctaaagccaggaggggagttggctagatgagatcaagaagttagccgggcatggtggtgggcgcctgtagtcccagcgactccagaggctgagccaggagaatggtgtgaacccaggaggcagagcttgcagtgagccgagatcacgccactgcactccagcctgggcgacagagcaagactccgtctcaaaaaaaaaagaaagaaaagcaaaagaccttgaaactggaaaatggatttcagttctccctagtctttgatgtaccaacttgggttaaaagttcttgtttctgtgtttgaagatagtgacttaaggaagaactgaagttgggaatgtagtttctgtagttaatattcatgttacaaaaatagaagtctaaacacctgaaaaaaagaatgaaacaactcataaactttttttttggatttgcaatgattttgtacattccattagttttgtaactttcatgaaggaatgcctattgtcctgttggtggcagtaaaacaccactcctggatcatttgttacttgaatatttcatttgtttgtttttaactttctctagtgcatcttcagtttgatgataggttagtttcaagatgctatctagtaaatgctaaaacaaaccaacaaacacaaatactgggcttctaattaggatactcaaggaattttaaagttttaaagtttcagaaataatacattttatgaaacagggatctgtatcaggaaaaaatgtatatcatcacagtaccatgcacatattatataataccttaaatttgttgaagcaatttctcattacttatttctcatgaaacaatccaaaatatcaagaagggaagacagttgaataaacacaccatttccaagtagtcagtgattaaattgaacttaatgtaccctaagaaatacaagctcccttgacagagaacaaacagaacaaaaaaatccagtttcctccttgttctatttttgtgagcaaaataagtactcatttaagcttccatcccttttacttaaaaatccctctctgtcttcatcctcttctgctttgctcttgtctttaatgaaggtctgttctgcccccattccaaggctaacttcctcactatgtccttgatcccatctttcctgtctctctttggagaagcctgtgatggttagttagttcacttattcaacagatattcactattgacagtccctgggttagatgtcaggggatacagagatgacattctgtgtcctgaagttgtcacatctaataggggaggcacacagacataagaattcagtgtgtttgatcctggggtttaaaagggatctttgggagcctaaaggcagaatgccaaattcattctgggaaactagtaaacattttccaaaggtggcatctaacctgagaataggacatgagggtgagagtgaacagcatgtagaagaggaatgaggaagaatggctgaggcaagtcctttgccatggcacatttgagggggatgcgcaggatacgattctgaggggctttaattacatttctgccatcaatttattgtggaattttaatcaaatcatctaaccttttaacacttaatttcctaacttataaaataaagagacagggaagcatgctctaaatttatgtcatgccagctgtgtcaatctgtgctataggtgtgtgtatatgtgtgtatgtttgtatgtcttatataaccatttcagtcctttaatgagtagataagaatctttgtataatttgcatgtttgttgtttaagtgcttggctaaatttatctttgcctcttttacaaaaaaaaaagtgtttacagaacaatataataaaattaggagcaaaggaatattttatttgttatacttcaagatgaataccaccaaaatgttttcatttcaacttaaaaatctctttataaccatacttgaatataaacaacccatttgttctacattagtgaaatgttagtgtgtgtattttctagcactcacacctctgcactgtgatcattctatcaggtatttctagatatccaagcaatgtgttggatctatgtaaaaaaaatctgacagctaccatcaataacaatataattgtgtagcatttaaacagtttgtaatgagctctcaaatgcattttttaaatgtttaataaataaaattaatagtaagacacctatcatttattgagcacttaaaatgtatctgatgctgtgctaagcactttaaaactaatcttcacggccgggcacattggcccacgcctataatcccagcactttggaaggccgaggcaggtggatcacgaggtcagaagttcaagaccagcctggccaagatggtgaaaccccatctctactaaaaatacaaaaaattagccgggcctggtggtgggtgcctgtaatcccagctactcgagaggctgaggcaaagaattgcttgaagccgggaggcagaggttgcagtgagctgagatcacgccactgcactacagcctggacgacagagtcagactgtctcaaaaaaaaacaaaaaacaaaacaaaaaaaaataactaatcttcactacctttaattttgtttattgtagtataatatacgtaacataaaatgtacaattttggtcagggcagtggctcaggcctgtaatcccagcactttgggaggccaaggtgggtggatcacctgaggtcaggagttcgagatcaccctggccaacatggagaaaccccatttctactaaaaatacaaaattagcgggtgttgtggcgtgtgcctggctactcaggagactgagatgggagaatcgcttgaacccgggaggcggagcttgtggtgagctgagatcgcaccactgcactccagcctgggcaacagagcaagactccatctcaaaaaaaaaaaaaaaaaaaaaaaaagtacagttttaaccattcctaagtacacagttcagtgacattaggtaaattgacattgttgtgcaactatcaccaccatccatctccagatctttttttcatcttgcaaaactgaaactcttgcacctgttaaatagtaactccccattcctttctccccttagcccctggcagtcaccattctgctttctgtctctatgaatttggctactctaggtacctcatgtaagtggaattatatcgtatttgtcttatctctggcatatttcacttagcatagtgtatgacccttaatttttttactgacattaattaaaagaaatcctaattttaacaataattctattactgttaatattgtattactattttatcagtgattctattactgttaatactgtattgacttgttggtatgaatcaatatgctcattttacagattaggaaactaagacttataaaaagttaaaaaacttggttaaagtcattcagttaggcaaatgacataccacaatcacaactaggcctgtcttactacagaggcagtgttcttaacttctaagctatggggtgtgtgtgtgtgtgtgtgtttattttaaaccttacaattgctctgtgaacaagagattatatcctacttgatactcaaatcccaggcatggcgacatatgcctgtaatcctagctacttggaaggctaaggtggaaagatcacttgagcccatgagtgcaagactaatctgaacaacatagtgagacccgttatctaaaaagtaataaacaaataaataaataaaagccaggtggctctcactaaaaattccatgcctttttacgttatacagcaggagacccttaaattatagtgaaatcagtctccattccacaaatctatgttgacatcatactatgagtgaaaacaggttttttaattcaagttgtttgaattaagcatattctattgtatgttcaaagatagttgtcccaatttaaaaatgtccttggttgaataggatagaagcagagccagagcaaccaagagccattgctatatgaacaaataattgaatttaggctaatgaaaatgaactcactgtcaaaaatcatcatgaaattaaaatattctctgctcttgactggctggaataatatttgattcctgagttctgcctttccacttattctgtcataatctttgagatatatgaagtcatccctgaatactgtttaatgctctggttaaactccatttcactctgaccaatcagagtatgtgagctgatcataaggagctattatcaagagacttgtcagaggattcactgcccaatatgtttttatgaccctttttatctgtaagagttgctggtattgctttttagaatgaaatagactaattttgtccattacagtgttgatagtttgataactcactgtgggaatcaattgatcttatcagaataatataaccagtagaggaaatgtaactgaagcatatacagttttatttaatatattgtttatgcaggttgagaaaaggctgaaatatgctccttttgctagaaatgtaataactaaaacgcccatagccttgatcttttttatcttttattgcttttccttgactaagagaatttggttttggtaaagctaaatgaatttagaataaagtcatttatttgtgtcatacgtaagcttgattaagaaggtttttatggccaagagccatggctcatgcctgtaatcccagcactttgagaagctgaggcaggaggatcacatgagtcttggagttcaaaaccagcctgggcaacatagtgagatcttgtctctacaaaaaataaaaataaaaaaaatagcaaggcatagtggcctggcattgcactccggtgatcacaccattgcactccagccctgggtgacagagtgagatcctgtctcaaaaaaacaaaggaagattttttttttttctatttagaaagagagtgcataaaagagaaaccataggcagggacagtacctcatgcctgtaatctcagcactttggcagggcaaggcaagcggatcgcttgagtctaggagtttgagagaagcctgggcaacatagagagacctcatctctccaaaaaatacaaaaattagccaggcacgatggcacgtgcctgtagtctcagttatttgggaggctgagatgggaggatcacttgggcctgaggggttgaggctgcagtgagccatgattgtgcactgcactccagtatgggcaacagagcaagaccctgtctcagaaaaagaaagaaaccataaaaagtataatggcttgaaaaagatggtgtatttctcccacagatattaatctagagagaaaatgactggccccaaaaggcagatagctcagttacataagatcactcaaggactcaggttctataatgaatttgttcaattatctcttaggatgttgtcctcatgtacatggttaaagtcagacacatctttcaattcggaggaagagggaaatttcaagcaaaagtggagggaaggcaatttccttttaagcaaatagtgaggaagttgcatacatcacttttattcacattccattgacaaaaattttgtccatggccacacttagctgcaagggaactaggaaataattgtctgaaactcagcagccatgtgccgtgttaaaattattatatttatggaaccaggagaaaacttttttttttttttttgagactgagtttcgttcttgttgcccaggctggagtgcaatggtgtgatctcagttcactacaacctccacctcccaggttcaagagattctcctgcctcagcctcccgagtagctgggattacaggcagactccaccacgcctggctaattttgtgtttttagtagagacagggtttcaccatgttggtcaggctggtctcgaactcccgacctcaggagatccgcccaccttggcctcctaaagtgctgggattacagacgtgagccactgtgcctggccgggagaaaactttttaagaaaacaatcagcagtctatatagtctaccctactgacctttcagtgtctgtgattacctatattctcacacatagacactccctctctcccaagggagacattccaaggctcccttggattagttcatctgctcaaagtcaagaatacccggatggtgcacattcctgattttcaggtctgtgatggtccctcacagttcactaatgtgttttctgttcatctcacatccagtatacaaaagtggtaggaaaaatataactgcaataaaagctgtcattcagaagatggaagaatgggaaacatgtcacagtcagtccgtaggaatttccaagattcttgctatttcagtagaggagatttcttggttagcctgtgtagctgtcccctggttctaatttctaagaactacaccattttccattgtcctccatggccatatctaaagttggtgttagaggccaggcgtggtggctcacacctgtaatcccagcactttgggaggccaaggcaggcagataacttgagatcaggagttcaagatcagcctggccaacatggtgaaaccccttctctactaaaagtataaaaaaaaattagctgggtgtggtggcaggtgcctgtaatcccagctactcgggaggctgaggcaggagaattgcttgaaccccggtgggtggaggttgcagtgggctgagattacaccactgcactccagcctggacaaaacaatgagacttcatctcaaaaaataaaaaaaaaataataataaagttggtattagagaatagtacatcctcctagggagctgcacactttcaaaaacttgctacttgtggagatttggaagcccaagagttgtgttagtgatcaaacaaatgactcttttttaggccaattttgatttcttttgggaaataattctctgaatacttttgtcgacttgtggtctttttgcttgcattcagttccttctgagtaaacaggtctaaagatttcttctagacatagttcctaaatcttctcatttatttgtttacctgtttgcatttaatggcccatcctttttccctccattttaatggtggttaccctgaggctagctaaaatcacaaactggagtcagaaggcaataccattaatttgatctttgcctgttagctggctgtatgttttggctgagaagtcttaatgagaggtacttaggaaaaatgtagagccttttaaatccttctgtttggggacaagtagtttgattttctaatcctgtatccttaaattactgtacttaatcagtttagattgtagaccatgttctctgaagtgacaggtattataggcacacagtctgccttccaagttatcaaaggcagtagttttactaaatattgtgacatgacataaaaaggatcattagttttccagactgcaatattggttttttcaccttgatctttactcagccacaaagccaagaaacatatttgacgttttaagtttttattttggcagtaaatcaattctggttacctatcccaaaatataataccttaaataagaattttttttctttttatgtgatggtatgtggagatagcacatggtccagacctttatgcatctcagctccatgagatcattcacagacttgtgttcttttcatcctgttgttctgcagcagtatttctcatgctcagaactattggcattttggggcagttaattctttgttataggtggctgtcatgtgcattacaggatgttcaacagtacccctcatctctacaggatgcccataggacatgctcagttgagacaaacaacatctgcagacattgcccagtgttcccctgggggcaaaatcacccctggttgagcatcattgctttatagttgcctaggatctcatcgtcatctgcatgatcaaagcagattttgatccataatgaagagaaaaatcaatcattcgaaatcactctagattttataattggcagacaaaaacattaatactgtaactttattccatatgttcaaaaaaataagtaaagaaatgcaagatatttaaaaagaaccaaattaaactttaagagataaaaattacaatgtctgatagaactaagaaatacattgaataggatgaagggcagatgggacattgcagaagaaaagattagtgaacttgaaaacatagcaattgaaactattcaaaattcaatacaaagaaaaagcaaatttaaaaaaaggcagaaaggagcatcagtgagctgtgaaatccttcaaaaggcctaatgaatgtgtaattggaggacctgaaggaaaggatgggagtgaatggtgggcaaaaagcacttgaagaaataatggctgatatttttccaaatttgatgaaaatttttccaaatttgatgaaaattatagacccaagaagtttagtgaattccaagcaaaagaaatatgaagaaaactacatcaaggcgtgttatgatgaaattgctcaaaaccagtgataaaggtaaaatcttaaaaagcatccaaaggaaaaaagataatatgtgtaaagaaacaaagaaaagtatatcagcagatttctccttagaaacagtgccagcaataagacagtgggaccacatgttaaaaatactaagcaaaacaaaacaaatgcaaaaatgtctctcaaaaactaagatgaaatgcttttatagacatacaaaagctaaaagaattcatcactaggagatctggattactgaaaatgttaaaggaagtcctaaggaagaagcaaaataatacttcacagaaatatgaatctgctctatgcaaaagaattggggagcgtggcaaatggtacctatgtgggtaaaaatgtaataagagtacaattctgtattcttcaggtcctttctttgcttatcactttggtgggtttctcttcctctgtagctttcaacaataagtccttgaaccttctgcattttttttttaagtcagagtctcacactgtcaccgaggctggagtgtaatggcgtgatctcagctcactgcaatctccacctcctgggttcaagcgattctcctgcctcagcctcccgagtagctggaattacaggtgcctgccaccatgcccggctaattttttgtatttttagtagagatggggtttcactatgttggccaggcttgtctcaaactcctgaccttgtgatccacccaccttagcctcccaaagtgctgggattacaggagtgagccactgcacccggccaccttctgcatttttatattgcattattgcctttggagaagtcgtaaatacacttttcaaaaaaagtaatttctaatttttgtcctaacccaacttccaatttaataactgtagtgattctatataaaatcttcagtgggccaggcaacttgtgtacagcacaacttcagggataccattcccatagactatgattgcacatctgtacatcatgtttctgattataacactgcattcaccttttcactctcccatcaaaagtatttgagttgaacttgagtactgtttcctaaaaacatctttatctcatatatcatctccccttttctttgtataatactgagccttcctagcccttatgttgtggcttaaaccccaccttctttaaaggatgattctaaactctttctgcccaaaatgaacatctactgtgattataccatgtgtcattcattatgacaccaaaatgccatcttgttgttatttagatgttttgtatgtgtatgtcttgtcttgaattcttcaattaaactgtttattttttaaagacagtgtgaggctgtttatcccctaggagagcaagtgaagttctgcatgttcagcaagcatccctaatcccagaattgatgcataaagtagcaaaaggccaaaggattattaaccttatgttttttccagttgttctatttaagcaaactacaccccatctaaaacaaggtttgaagtagtttggacttttccctaaagatttgatttctgcttggttttgaagttttgtattagaaagaaatcatactaacccttacttcatttgattaatatttgttaattgtttatatggtaaatacaggtctcttcacatagattatgtatactgaactcctttcttttgaatacaaaagccccatatttcccaaatttagtttttatttaaacaatcatatcctggatcacctgaggtcaggagtttgagaccagcctgaccaacatggtgaaactccatctctactaaaaatacaaaaattagcttggtgtggtgggaggcacctgtaaaaccagctacttgggaggctgaggcaggagaattgcttgagcccaggagggggagattgcagtgagccgagatagtgccactgcattccagcctgggaaacaagagtgaaactccatcttacaataaataaataaataaataaataaataaataaataaataaataaataaattaaataagccctaattaaaatttccctcagtattaccagtgttgggtatggcctcacattgtttccatcctgcttttcccatatttaataggccctcactgactcctgaatattgaaaattgagttcaaatacatagtttattcctcgaaatcctccctccatactctgctcagatggatgattccaacctcaccatggatctctgctctacctaaactggaagtggactcaagattagccacacataccttacgcttgcctgctttctgtctgggaataggcttcctccagccttcctaaatctcatgtttttcaagtctagctcctatctaacccctgatcatcagttaccttcctctatttttacattatcatcctaaatagagataactcacagggaatactgttgtattatagtttacttgctaaagtacatgcttttgatatatatatatatttttattatactttaagttctagggtacatgtgcacaacgtgcaggtttgttacatatgtatacatgtgccatgttggtgtgctgcacccattaactcgtcatttacattaggtatatctcctaatgctatccctcccccccacccccccaccccacaacagtccccggtgtgtgatgttccccttcttgtgtccaagtgttctcattgttcaattcccacctgtgagtgagaacatgcggtgtttggttttttgttcttgcgacagtttgctgagaatgatggtttccaatttcatccatgtccctacaaaggacatgaactcatcctttttatggctgcatagtattccatggtgtatatgtgccacattttcttaatgcagtctatcattgttggacatttgggttggttccaagtctttgctattgtgagtagtaccgcaataaacatacatgtgcatgtatccttatagcagcatgatttatattcctttgggtatatacccagtaatgggatggctgggtcaaatggtatttctagttctagatccctgaggaatcgccacactgacttccacaatggttgaactagtttacagtcccaccaacactgtaaaaatgttcctatttctccacatcctctccagcacctgttgtttcctgactttttaatgatcgccattctaactggtgtgagatgatatctcattgtggttttgatttgtatttctctgatggccagtgatgatgagcattttttcatgtgtctgttggctacataaatgtcttcttttgagaagtgtctcttcatatccttcacccactttttgatggggctgtttttttcttgtaaatttgtttgagttctttgtagattctggatattagtcctgtgtcagatgagtagattgcaaaaattttctcccattctgtaggttgcctgttcactctgatggtggtttcttttgctgtgcagaagctctttagtttaattagatcccatctgtcaattttggcttttgttgccattgcttttggtgttttagacatgaagtccttgcccatgcttatgtcctgaatggtattggctaggttttcttctatggtttttatggttttaggtctaatatttaagtctttaatccatcttgaattaatttttgtataaggtataaggaagggatccagtttcaggtttctacatatggctagccagttttcccagcaccatttgttaaatgggaatcctttccccatttcttgtttttctcaggtttgtcaaagatcagatggttgtagatgtgtggtcttatttctaagggctctgttctgttccattggtctgtatctctgttttggtaccagtaccatgctgttttggttactgtagccttgtaatataatttgaagtaaggtagcgtgatgcctccagctttgttcttttggcttaggattgacttggcgatgcgggctcttttttggttgcatatgaactttaaagtagttttttccaattctgtgaagaaagtcattggtagcttgatggggatggcactgaatctataaattaccttgggcagtatggccattttcatgatattgattcttcctatccctgagcatggaatgttcctccattcgtttgtgccctcttttatttcattgagcagtggtttgcagttctccttgaagaggtccttcacatcccttgtaagttggattcctaggtattttattctctttgaagcaattgtgaatgggaattcactcatgatttggctctctgtttgtctgttattggtgtataagaatacttgtgatttttgtacattgattttgtatcctgagactttgctgaagttgcttatcagcttaaggagattttgggctgagacgatggggttttctagatatacagtcatgtcatctgcaaacagggacctgctttacttaaatgctgtgtaaagaatttggtggaagctctttgaaatttttcttcatttgttactcttctctggaggagctctgcatttccgcatgggatgtcagtttgcatcacagtagagaatggacattttgtgggtaccgtggattgagctagtggtattgagagacaggactaagctggatttcctaggccgactaagaattcctaaacctagctgtggacggtgaccacacccacctttaaacacggggcttgtaactcagctcacacctgaccaatcaggtagtaaagagggctcactaaaatgcaaattaggctaaaaacaggaggcaaagaagtagtcaaatcatctatcatctgagagcacagggtgagggacaatgattgggatataaaccccaggcattccggagctgggatcgggcaaccccctttgggtcccctcccattgtatgggagctctgttttcactctattaaatcttgcaactgcacactcttttggtccatgtttgttctggctggagctgagcttttgctcaccgttcatcactgctgaatgctaccatcgcagacccaccgttgacttccagccctctggatcctgcagggtgtccgctgcactcctgatctagtgaggcgcccattgcccctcctgatggggctaaaggctcgccattgttcctgcgtggctaaatgcccaggtttgtcctattctagccaaacactagtcgctgggttcaacggttctattccgtgactcacggcttctaatagagctataacaccgcatggcccaaggttccattccttggaatctgtgaggccaagaaccccaggccggagaacaaaaggcttcctaccatgttgggagcagccgtcaccatcttgggagctctaagaacaaagacccaccctgcccccgccgcccgtaacagtatgagggagtaccagataagaaatctaaatacattcctaggtcttcctgagctagttcttttttgtaatgacttcattattcaagttaatgcctaatacctaagagatattcaaatagaattgcgacaacttactcaaatctgtattcatcttcaatttgaaattagtactgccattctctgttgataattgagaggttactgaacatctttgcatctttgatatgttttcttcttcttcttcttttttttttttttttttttgagatggagcctcactctgccgccaggctggagtgcagtggcgtgatcccaggtcactgcaacctccacctcccgagttcaagtgattctcctgcctcagtctccctagtggctgggactacaggcgcatgccaccatgcctagctaattttttttatctttactagagaaggggtttcaccatattggccaggatggtctccatctcatgacctcatgatcctcccgcctcgccctcctagagtgctgagattacaggccgtgagtttttcttcttcttcttctttttttttttttttttttttttttttgagacagagtctggcttgtcacccaggctggagtgcagtggtgcgatctcggctcgctacaagctccgcctcccgggttcaggccattctcccgcctcagcctcccgagtagctgggactacaggcacccgccatcacgcccggccaattttttgtatttttagtagtgacggagtttcaccgtgttagccaggatggtcttgatcttctgacctcgtgatccgcccacctcggctcccgaaagtgctgggattacaggcttgagccaccgcgcctggactcagtttttcttcttttatttggataactatagatttacctacttattctctattcttccttctctttagtgctctgttgtcaatttattatatttatcttatctcagatttcttttctttcttttatatgaccagtgtgcaatccctcctatattgtggtgggaggtgggagaggtttaccccagcaagcgtgggactggtagtggaaacatcttctacccagacatggtaatgttttattttgtaaaggttgagttgagtagatgaactgaaggaggtaattgagacaagtgtgggccatcaagcaagactggcctgaggggcatgtcaggaatcggagttcaaagccaagaatagaccaaactgcaggaaagcaaaagcaaaatcaaaatgagtgtaaaggaaggcagcctagaaatgggggtaagggtagtgtgtggagagcaacgtgggtgtttacctggtactaggcttttacatgttctacaagcccttgcatggttgaggaagctccattttgaagaatcagtattggagcagaagccaccagtcagtttcttcttgattattaaatcataagcaactcctccttaaataaaaagtaatgaaagatggcatattttaaataggacccattgtattctcagtagcatttaaatgaaaaggtatgttttgggggtgagaatatactacagtatttcacaatacaatatttccatatgagtgattttattttatttttttatttttgtttttatttttgagacagagtttcactcttgttgcccaggctggagtacaatggcgcaatctcggctcactgcaacctctgcctgccgggttcaagcaattctcctgcctcagcctcctgagtagctgggattacaggcatgcgccgccaatcacaactaattttgtatttttagtagagacagggtttcactgtgttggccaggctggtctcaaactcctgacctcagatgatccacccatttcagcctcccaaagtgctgggattacaggcgtgagccactgcactcaccctgagtgattttaaaatagagaattgtcttgttctgagattaaggttagcttatcgttcagctactgtttcagtaaaataaataattccagtaaaggaacgataattgtagttatcttggcttggtatattatgctatggttaggcaattttagagtaaagagaagaaatcaaaagctcttgcttagcacacttgctgcttaggcattcttgttggaaaataatgcgttctcatttcagagcaaagacagcaaagctgactctggtatttggagagctaaaggagtgaaacttcttttaagaacgggaccattcgagccctgtaggagcttttgagcatgcgtattcaactgctcactctcatgtctataacccacgctgcttctccaccgttatgtgcagaccataagccctacagtggtgacagctgcttttaggcccctttgccttaaatacagtagaatgcttatatattagacttttagttcttgaattttggctagatatttcaactttcatttaaatgttgtaacatcccatgatcagagcattataacctggagtatcactgataggaaagaaatagtaaaaaaaagtatgtaaatatgtaaatgtaaacataaatggaaatttgaactcagttatttgactaatgtgtgtataccatctggctaactccatttcaaacaccttatgcatttacttgtagtttttatcttctctaaatataataacttgtagaggaggagtgtggaagagtcttccatttaccaaagtgatttctgtgtcattttcttgagtttgatttcagtcttgtgactggtaaattctaagtatctgcccttttgagcaaataaacttgtcaatcagatattttctaaaggggatattttttgttaatattagtttaggttcatgtggacattgtttaaaaagctttgggaactttaatgattggattttataacactttattagttatagccaactatgttactacttccatcaacacccatactctgtttctttgtgaaatgaaaaatattgttttatttgacactctcctccttattatattgtacacagtaaaatccaaacggaagccaataacttctgaactctaattgtgtccatcctgtaaagcatatgggtttgttcactgattcacttccagagaactaggtcatcatcatgagaacccccacattccccaaatcaaatttacatgttcttgaaggaacaccaaatggtaatgagtactttgctaaataacgttgacctttatttattttcttatggattttatgctgctttactatgtgtcagtatccctcccttcttttagaaatccataaacattgcacttgctttcattttgaactttcttcttactaatttagacattaaataaaagagacatatatgcttattatcccctagtttaatatatatattttaaaaagttaagctgatattttaattttatttcttcacgtgagcatcatttattcatttgttcatttactcaatatgtatttaaatgatctctgaccacagtgactaaaaactgttgggtactagaggtgcgaaaatgaatatgttgtgtggttaatctcagagtttcactgggaagtaggggagacagacgtgcctacaaataattgtcgtagaagagttgttattgtagggtcataaatgggacaggatgcaaaggcagaggagggaagtaatgacagggatgacttgaaagagaaagtgaggctggacatagtggctcacacctgtaatcccagcactttgggaggccgaggtgggtggatcacctgaggtcaggagttccagaccagcctggccaacatggtgaaaccctgtctctactaaaaaaacaaaaatgaaccgggcgtggtggtgtgtgcctgtaatcccagctacttgggaggctgaggcaggagaatcgcttgaacctgggaggtggagattgcagtgagctgacattgcaccattgcactctggcctgggtgacagagcaagactctgtgtcaaaaaaaaaaaaaaaaaaataagagaaagtgacatctgactcttgaaagattagcaagacaaaacaaggaatgatgttttaggcaacaagaacaatatatgtagataagaaaagcataatttttaaaaagcatatttgggaaataatgagaagtttcatgaggacattgggcatgaggggtcaaggtgacagatgcaattggaaaggtaggatagatctagcttgtctgaaggatgtcttgtgctttgaacctgtggaccagaggatatggatactttcagacaattgcatgatcaaatgttttgttttaggaagataatttggaggcgaaaagactgaaatgtgaaggtactggtaatacatatggagaatagttaggatactattagaatagtctgggggagaaataatgaaggcttctttaaccaaggctgcaacaataggggtgtagaggggcaaactgagcagcatttcccaggtactgtagggaacttgggtacagttggatatgtgagacaacgaatagtgagtcattactatcctccacttttcttttatcttccttttaaaaacttccctgtcctggtctctctttaattttaaggaaaagagctgctaaaatgtgtgctttatagagaaagaagcttactagaccttacatgttctcacttatggcatttagtgataaccagggtgtccctaagcaattgaatagtgataccagaccagcttctgcatggtacagctttaatgtattattgtttgaacttcattaataattagacttgcgacgaaagtaaccagttcaagtgatcttataatcaactttgtgcctcagcacctggaactttgagagagccactgtgttcatttatcaggaggcattctgcttcctctgtggtgtgccattccctgacttggtaaagaatattgtctctctggcagttttgtattagtgagttatacaaaggaggtcatagcaaaccacctgtactttagaaagttaacacagaaacactgaagaggtatttcttctttgtggtacttcttatattcaagcttggctctatttccgtagcacaccagtccaggctctcattttctcacattcgattgactacaagagctttctgacttgtctaccttcagtctcttcctctcttaagctgtcctgccctctgctattagattaatctttctaaaaggtaatcttcgtagcattcctcacctacttgttgtccagtacccatctttttggaattccattttcatcataatttggcctcagatgtacttactggcctcaaatgtacctattggacacattgggatgaagtcttgttctgttgcccaggctggagtgcaatggcatgatctcggcttactggaacctccatctcccaggttccagtgatcctcgtgcctcagcctcctgtgtagctggaatcacaggcgtgcaccaccacaactggctaatttttttgtatttttagtagagatagggtttcaccatgttgcctaggctgttctcgaactcctgagctcaggccatcctctctcttcagccacccaaagtgctgggggttcaggtgtgagccactgcagtcagcctgttttatgcttttaagtttcttctctttcctgaagtagttgactgttacataacatgtattatccaaagttcacaggatactctaaataccaatattatgatatccttatttttaaatatagaaacctttctcctcttaccaaaaaccacagtgactcagctacttgcatgtctaaaatggtctctgcatttttctgtggctagtctttatgatggttatagatcagtaatagcctttttggaagcataatattatgtattaatcatggcattcttaaggaatcactgcaattaaccaggtagaccaatttagttggaccgtggtctgtttttttagtatgtaaaaacatgggttcaggggattaaaacaactcaacattcatgaagaatatattttcagatgctcttacattccctgatttttcaatactgctacgatttttttttacagagtttctttacttatgaaattgatataaaataactgccttgtcataagaatgtataataactgagaagggcaaagactgtaagctaaatttactcagcatctgctacatgggagtgactcagttcattgctcagcaaacccacaagttactgtgttgtgtctctgtggggtctcctggggagaacagaaacaataaatgttaaatctgtaaatgtgtcaaggggtcactgtggttgactcttggttgctaaaggaaacagaggttctaaggccctgtaaaattataatatttcaaagtgaaaatgaatgaattaatagaagaagctgagacaaggatcttattttgtgtttgttttcctctcaatacccttgccaattaacattttttgaatctcttgctcttctccactgtaagcctgccctgatattttctaattggatacagagataatacataactggccaggtgtggtggctcatgacagtaatcttggcactttgggaggctgaggtgtgcagagcactggaggccaggagttcaagaccagcctggccaacatagtgaaaccccatctctactaaaaatacaaaaaaattagctggctgtggtggctcacacctgtggttccagctgcacaggaggctgagacacgaggataactgaaacctgggaagcagaggttgcagtgagccgagatcatgccactgcattccagtctgggagacagagcaagactttgtctcaaaaaaaaaaaagagaatacgtaacaaagaagtaagaaaacaatttcaagtggtgataaatgtcataaaagaaataatacaaattttttactgcccttcattagataaagatagtaagagagaaggcctctgggccgggcacggtggctaatgcctgtaatcctagcactttgggaggccaaggtgggtagatcacctgaggtcaggagttcgagaccagcctgaccaacatggtgaaaccccgtctctactaaaaatacaaaattagccaggcatgatggctggctatttttgaatgccagtaatcctagctactcagtaggcggagtcaggagaatcgcttgaacccaggaggcagaggttgcagtgagccaagattgcgctattgcactctagcctgggcgacaaaagtgaaaaaaaaaaagaaaagagaaagcctctgtgagcaaaatgacattggaattgaatgatgcagtagagctagccatatgaagattggcggcaaaaacggtgcagaggcccttctgaaattctgctgcatctatttgaagccatgagtgtgtgtgtgtgtgtgtgggcagggggcggggggtatgtgtttatgtatggtgggagagctagagtgggaggaggctgtgcaatctattaccacctttgtttcacaacatggacttgtccatttcaagaaaaaaaaaatgaggctgagcgtggtggcttacacctgtaatcccagcactttgggaggctgaggtgggtggatcacttgaggtcaggagttcgagaccagcctggccaacatggtgaaaccccgtctctactaaaaatacaaaaattagcctggcgtgctggcacgtgcctgtaatctcagctacttgggaggctgagacaggagaattgcttgaacccaggaggcagaggttgcagtgagccaagatcgtgccattgcactccagcctgggtgaagaagagagactccatctcaaaaaaaaaaaaagaaaaaaaaatgaatgtccctatcttgacatattaattttgtagaaataaattcacttgctaatacatgggttggcccatataactcctccattgaaaatattattttttacagtgacagctgttaaacatatacctaacattctatgtaatatgaagatgaagatgttagagattgcaaatttaatagggaattggagatggaccataggaagaaggtagagacaattcacaacttactaggatgagtacaacacctcattattttttaacagcaatgacaatacacacacataaagataaaaaaatgctggtctagcttgagaggatcagggaatagtctagattctatacacgataattttaatctgatcaattcaaaatttaaaaacaggcttctgctaacatatgtttataccttctgcttaagcttgaaaataaatatgagctttatccacactgtccaggaaaggggatgaacgaactgagatagcattccattttcaagcctgtgccactaacatggcttcaagaaagcagctcttacagagacgctgtggctgagctgccaaggatgtagctccttgaactgttcatctggaaaagaaagtgcttatcagttaaaaattgagaaggcagatgtgctttattataacaactgtgtgtttagaagtgacagttctcagggcagacttgtggataccccttctcaactcaacctaagaatcttagattctttcttaccagatggcaggctcaggttcctgaccagttccacgtggaataaagtggtgaagcataatctttctaataagataggttctttatgggatacattacttgaaagaccagattacagtgcaggaaatgctaggttccctgccgtgcatctgtgctctgaatatcttggcttcctgactctgcctctgacaagttttatgatgatgagcagtcacttatctactgcctcagtcttttcaacaggataaacatgttagaccttggtgttttctagggtccaacaaggtttcattactttattattctgttatatctagagtatctgtttcagtttgggcagccctatgagagatactgtccaaagtgtgttcttgaagtagcaagcatgattgtgaatagtctagaatggtccagaaaccacctcataggagacccagtttgcagcagggatgattagcttagagaaaagaaaattaagactgtctttgaatattttaattaacgtcacgtggaaaaaaagaagtagacttagtctgtgttgctgtaaaatatttaattgaggtgactcttataggaagtgctctaaccacaaaaggaaaaacaaaacaaagggaacaggaggaaatttttagagatgatggataagtttacggcactgatagtgataatggtttcacaagtgtatacttatggcaaagtacatcaaattatacatataaaatatctacaactttctgtatgtcagccatactcaataaagcaactaaaactatatataactgagcctagttactagaagtttcagatgtctggcttactatgtacagtatagccctttcctaaatgtccagtaataagataagcagcctattgagctacatgtcaataatgacacagaagtagaaacaggccagtgcggtggctcacgcctataatcctagcactttgggaagccaaggcgggtggatcatctgaggtcaggagttcgagaccagcctgaccaacatggtgaaaccccgtctctactgaaaatacaaaattagcagggtgtggtggcgagcacctgtaatcccggctacttgggaggctgaggcaggagaatcacttgaactcaggaggcagaggttgcagtgagccaagattatgccactgcactccagcctggttaacaagagcgaaactccatctccaaaaaaaaagaaaaaaagaaaaagataaagaaaaaccaagtagaaacaaaatgactctctacagaccataagacattcttacattaataaaggcattacagtagaatctgatcacaaggattggcaataggtattagtgatgctaccaagactattcagaatgttattaaattgcttttggtaggggaaagttctcctttctatttaaaaacaaaaaaccttctttaacagttatgccttaaattttacaaggttagagcattcctaaaaagctaggtaagtctacaatattttacagagatgctataaacatgtgacctcaaccacctaccaaaatgtcaggtaactgcacagtatcttctatattgtactctaattcttcgatgtttgagttccaactataaaataatgagactcatttccctgtgatacaacttgtaagctcagtctcattacatttcattttagcttttaagtagcttgaataatccttaaagttagaaagcagcatctgatctgtctttctatatccagaagcatatagtacagtgttgagcaaaatcaagacttttttttttttgagatggattttcactgtgtcacccaggctggagtgcagtgtcatgatcttggctcactgcaacctctgcctcccaggttcaagtgattctcctgcttcagcctctccagtagctgggattacaggtatgcaaccaccacacccagctaatttttgtatttttagtagagacaggtttatgatatgttggccaggttggtctcaaactcctgacctcaagcgatccgcccacctcggcctcccaaagtgctgcgattacaggtgtgagccaccatgcccggcccagaatcaagacttgaatgaaagaaagagtgtgatttgtgcaggattttacactaccacgatggcaccactactcactgtgtcatctgtattttgacctgtttgctggatcttaggaacttgcaaaatcattgaaggttcatctttttaaaaattgtcaatcaggcaaagaatagctagagaattaggttttgctctcctagtcaagaagggcatggatcctttgctacttattgatgtgtctgtgtcttagtgaaccgaagaggcaggtgatctgacaggaatgtcttttcagtgtttgactaactctctttctattgtgaatatatccaaagttctttttgtctttctaaaccctaacccagataaacgcaatgtatttttacacattttcttttcttctatgtgatttcctggaaagaatgaaaaaaactactagttgttgagcacctaccatgtgctaggctctacgagaggttcctttatatgcattaatttattaaattttcagagcagctttgccagctaggtgatgttgccatacagaagctcagagggctaagtaacttattcatgtcatacagctagtaaatgtgactaaaagatgatgtaataagcaatgccctgttttggtcttagagatatatttaattatcattactcttggatttttgtctaggcccatcccagtagtataaacccacttttgtctgcatctactgtggacaacaaagacatacctacctcatagcacacagtgtgtcaccccttttatagtgtccatcacaccctactttatctttgtatttggatacctccctgattttaagctcctgcaggtcagaaggtgtttcctttttcatttttgtaactactgaaataactacctagcatgttttgttacattcagttttcttaattataggtccatgaattaagtcaaatgtgcttttcattttacaatggaaatctatatgtgtcctgaatatgtctgataaccatgacacagtggagtggttcaggaagagcattctcaagtgcaaggctctaactgggattgcagcactgaccacctgcttccagtactccagagaatgacacttctagtcattagaccatggctttgggaccattgcctggttttttctcttactctctcttattgggtatgaaaggattcagaatatgtcacccctcccccccagtatatcactgtggcataaggattattttgaggtaaaggcgattaaggaaaagcagacataggacaagctctctgccatcccccgtatgcctgaaagtcaagcataaattcctcttgtgaaggtgcctcgccactcactttccataccagcaaagggatagcaaccttataaatggagaggagatggcaccaagaaagagtctatacaaacaaaccttattaactagtctttatctgtcataagtttccccatatatttgccttcctacaatttgtcaccctaggagctcaaagtccttttcctttgttttatcacttctctacagaagtattgttccttattaacatgctaataaaccccaagtcccaagtttttgtttttctgagacagggtctcactttctcaccaaggctggagtgtagtggcacaatagtggctcattgcagccttggctttccaggctcaagtgatcctcccacttcagcctcctggttagctcagactacaggtgtgtgccaccatgattaattattgttgttattattataattatttatagagacaaggtttttgccatgttgctcaggctggtcttgaactcctgggctcaagccatctgcctgccttggcgtcccaaagtcctgggattataggtgtgagctactgtgcctggcctcagccccaagtactaaccactcctttgagttagtcattactgagtttctcccatgtgtgtgcatactacatgtgttaataaagttctgtttatgtttatcttgctaacctgtattgtctcagacttatttgcagggccccaggcagagaacctaggaggatagagggaataagtttttcttctctatgggtgattcatccaaaagaaatgtgagaaatcatgcattattaactagttaaatcggaagagtttcttttctcttattccattttatggactactttataactcagaaatgttttctgtgaagtgttctgttgggtacatgcttataatcccagctactcagtaggctgaggtaggagatcccttgagcccaggagttcaagatcagcctgggtaacacagcaagacgccatttcaaaagaagaatgttctgtgattgttctgtgatttattactgaatcgcaacaacaataaaaaaagtatttgggatttggggaggaagaggaggaaaagctcactgaaatgagtgatgcttttagggcttcaaaaatccctagaatctcttttttcatttcaccaagtagtgttctagaagaatcattttacctgatattgatgaacattctattctgaaagaatatcctgaaaaaaggaccagggcagaaatgatggaaattttgaatgcaaggatttttgaggggaagcatgaaggaaacatgagggatttttgatggggaaactgaagtacatgaccacttgttgtagtgccttgtacacagcattttgttaaacatacctaactgttttaagtgaaacttggtttgctcattaagataacatattttgctgggcacggtggctcacacctgtaatcccagcactttgggaggccgagacgggtagatcatgaggtcaggagttgaagaccagcctggccaacatggtgaaaccccatctctactcaaaatacaaaagttagccgggcatggtggcacatgcttgtaattccagctactcgtggggctgaggcagcagaatggcttgaacctgggaggcggaggttgcaatgagctgagatcacgccactgcattccagcctgggcaacagagcgagactctgtctcaaaaaaaaaaaatcatattttaattattacatttaatacatagtatatatgattttaacttctttttgtgagcatcagagccaaaccatacagttccaaaatcattttgattaatttttacttatttttactggaatctttttgggcaagtcctgtttctggtttatgtaagaaaaaatgcttcagctagtacttttcaagaccaagttagttgagtggaaacatcttccctaccctttaaaaagtcaactagaaaaaaatcctataacctaagaagtcactgaattcttcattcacatttaagagcaattcaggatgttcccttgttcttaaatgtgaaatgtctatggcagtgctgtacatagcagtagcacagtcctatcaaacaaaatttaatgcagaacaccagtatatatacaaggtaaaaatggagctgaggggagtgtgtgtgtgtctaaatgtgcgtggtgttgggggggtgtgtgtgtgtggtgtgtgggatgtgtgtgtagggggtgtgtgtgtggtgtgtctgtgggtgtgtgcaggagggtgtggggggtgtgatgtgtgggggtgtatgtggtggtgtgtgggcgtgtagtgtggagtgggagtgtgggtgtgtgggggggtgtgtggggagtgtgtgtgtggtgtggggtatggggaggtgtggggggatgtgtgtgtgtgtgtggggtgtggtgtgtggtgtgtgggtgtgggtgtgtgtgtgtgtttagggatacagtatgaaaggcccagaaccttttccttcttatggcctccctcttccagctgaacctatcctcatcctaggcagtacatcaaacatttactccagaactttaggacctgaaatttatttgtatatacgtaatattctatgcttatgatcattttacattaagatctttactttgcatagttttttgtttttgtttttagagatggggttccactatgttgcccaggttagagtgtagtggctgttcacaggcaggaacgtagcacattagagcctggaactcctgagctcaaaggatcctcccacctcagcctctggagtagctgggaatacaggcacacactactgttcctagctctactttatttagtttgttaagaaatcattttagcactttgggaggccgaggcaggcggatcacaaggtcaggagatcgagaccatcctggctaacacggtgaaaccccatctctactaaaaatacaaaaaaaaaaaaaaaaaatagctgggtgtggtggcgggcgcttgtagtcccagctactcgggaggctgagacaggagaatgatgtgaacccgggaggcagagcttgcagctgagatgctgccactgcactccagcctgggtgacagagcgacaatccgtttcaaacaaaaaaaaaaagaaatcatttttggaagagataaaaggcttgacagcaatatataaatatttcatttaaaataacttgttaaataatacttaaatgttaaatttcttaaaattcttgtttttctgagattttggaaaaacaaaaccaaataatatattgttaagggaggcagaatctcccttcctatttctttaagctcattttcataattaatctatttatttaggcctacagacatacatcaataaatatgtttctatttggttatttgtagatatgtaactcttatttgtcagagtagaaaactaagactcacaaaatacatgctctggctctcttagccttgtttctctttgtaccatgctataatttgtatggagaaaccagcctggtacttaagagagcaactacagaaccacagaatcaagatgctgaatatggattagttaattgttaggataaagttaagagactgtccctatggtgatttggtcattttgccttcatttggctacaactgattatttattcacaacaagtaaactaatataacacattagcactaagattgtaaaattttgaactatggataatttttatattactggggaaggattaatttgaccagagatttatcagaacaatgttttcaactattagctgagtgtttatcaaggtctgtggcatacaaaagttatttttgctttgagaatttcaattctaatagttctttaaatgtatactcttaatacgtgttaggtttttattatttatcatattgcttgtttacaaaaatcttccttttaatcatggccagccttcccagaatcctgaaatgcttcttgtatttgcattgcaaagagtcattattattgcataaacacttcaacttgagggtgtgtcatttcttggttgcttggtctttggctcttctgtccatactctatcattttaccctaatacctctcttctgtagcggtttcagtcatctaataaggattggaacatcccactttaaatccaagtataagatctattctcgttgttagaaagcaagagtgaataaaggtcagctgttcagatgactggctgtctgatttttttctgtgagcgtcacatgttaggaaaagctagttcatctctctgtggcttaggattcaacagcataagctgtcagactaacactgattgaaggtagactgggagggggaagcgcatctgtccaatggctcgccattggcttcttattacagcattctcccctgagacacactctgcatgctcattcacctacctcctcctcttccctccccttccttccctaccccttcattactgattcacagcgagaggcagcagcagcagcagtagcagcagcagcagcaacaacagcgctgcttgtcacgaatcgaggattgcaatgagctcatcgttttctccttgcagcttcacaactgccctggcttcctggctactgctgctgctgtcttctcacacatagacacgcacacacaccctttctcgcacacacacacacacacacacacacacacacacacacacacacacacactctcacacattctcacatgctagacccttctaagcagcttgtccgtttttacacatgtatctgaactctcctgcatcactcttggccattttctcgcattcgattgcttttgccgttttttatttagatcagtacttgatttcattttcattttccagtctactttggggttctcgcagtggataatttagccaaaatgtttttcttgtggagacattagctgacaattcccaccacagactggcttgtacgtcctcccagggagacctaaacctggctcccctcccaccgcagttcttaatattgtggataagagatccatctttctcattctggatacctacttagtgctcatggaagaaggggtgccctgcccagccccagctgctaagctcacacctcctgtcaaaaagtcccaggacatgcacgacgagaggagcaagctggtgaatgagtatgcgtgtcgagtgctggaacttctggggatggggcatcgtctgtttgtgcctcggcttctggcggtgagattgtttttcattgaacttcatttgtagggaatctgctatcctctgtgaaaattccttgtatctctgaaagaggcttgttgtctctggttttcttctccttctccccattctgccgagaaggaaatgctgagtggccactgttgtgcagctcatttggagcctggtccacaccaccccttaattggttagaggagatcatggctcttttctcagagcccagggtcacattagtggcattatctctgtggcagcaaaaaaatggttttctgcctggctaggctcagcaataaagcagaatacccaagtgcttgatgtaggcattctgttatgtatatctccaaagggttaaattttacaacagacatagcaacttatctagactgtgtgtggtttgctttctaacctccccattagattgccaatttgattgttgttttgttttgttttttgatagagaattttaccacctaaaaatactttggtaggaaattttaggtttctctcctagaatgattgaactgtttatctgtgaaacagcttaaagctgctggcttctgtgctgtgaatctgggaagtctgacttgcttgttatttgatttcctgaataagagaaaaatcacccttcctcatttcctaccaagggttaaaattaaatacccacaatcgctgttgcaggcttgagaactatacctagcaactattctataaggtaattggtttacagtagtcctataccattatgtggtaatggaataagaataatttagccttgtctgttttatagaatggagtttaataccattttagactatttcctcactatggttctctcatattagagtcttttcagtacagtatttacatgactgaatttaactcttttctctcctatatctcccttcactataattcatctctatttatacttatctttacaattactagttcagtctttatgtatgtatttacatgcaaatataatctcttctgtacaatcataacagacatgttagatagccatgtaaataagaaatttcccatcctaaggaaagtctatttgtcattccaaaacaaagtttgatgcagtgactagcatacaattataggggggatatttttgagaaatgtagttcctttgtcatttaaagaagaaataaaaagagctgaagacatgtgttttaatgtccaggtgaagtcattacttccctgaacctcatctttttcttaaaggagaaaactaaggattcatgattctatttagaaaggagttttgttttgttttgttttgttttgtaagtgaaatgagaagcattttatttcaggagttttgatattgtgaagtgctaaactatatttcaacaaattctctacatctctgaggaatcaggcttggtctaatatatttctgcatcctaaagactactcaactttgtgactcaaaggcttccaatggtaactttccagtaatttggtgccacctctctttggcatttacattttcagtgttttgaaggaaaacataaattggtaattaagaatattttgcatactcaactctgcattagggatgaatttaaactgcctctagtctgaaaaaattaattagcaataaaatccacagggagttgggttctcaagcttgagctctttggaggtcatgtatatctgtgtattgcaattgtaccaactctggttggttgccaaattaggcatctgaagtagtgcatctctcaggtggtcttgagaccttacttaggctctatcagttagagcctaagtaataatgccacctgcattatgtgtgaaaagcatatgctaggccagatgcagtggctcaagcctgtatacccagcactttgggaggctgaggcgggcagatcacctgaggttgggagtttgagaccagcctgaccaacaatggagaaaccccatctctactaaaaatacaaaattagccgggcgtggtggcacgtgcctttaatcccagttatttgggaggctgagacaggagaattgcttgaatccgggaggcagagattgcggtgagctgagatcgtgccattgcactccagcctgggcaataagagctaaactccatctcaaaaagaaaaagaaaagcatacgctgatttatcttgggggccacttgaaaatctctggctttgttttacacagttgcacttgaaaaattattggtaatacgagggtactctacattttgggaaattacaagttctttaattagcaatatggctgttagttgggctctgctattcagtaagttactgctcaaagtttagcatgtgtaccagggggaaattgttcagccttgtgttattgaactggctaatgatgtgggatcaatggctaatctgcacaggacactcctaagaggaatcctgccacatgcagtattgcaatcttttcatttctagtcaagaggaagtactaaagtgtaaaacatctctttacctttttagtcatgtttcaaacatgaatgcttgtgggttaagcacatacaagtactttattttacttttaagatcccattatttttttttcatcataaaaccagtcatttttcaaaaaaatcaaataaatgaagatttaccaagatagtgttgtggatttggtctctgagccttattacttattgttccctgattcacagagggatcgtcaaactactagaactctaggtttctttaaccttcagttggaaggaggttactgatataatagaggatgcacatttggaatttttgcttgttacccttcaaaggtacacccagttaaggacaattttcctttaataaatcaggtgcaagcatgtcattttagatattaccacaaggcctaaattctatgtgtacattcaccaaacatgtttttcttttgtgaaattaaaatactgaaacaggagatgcaaacatcctagacatcagctaactggtatttcccttttctaaagcctgtgctttcaaatgattctcagacctccagaaatttttagctgaataaaaattctgttagataccataactaaaggaaaaagaagccatttaggataaaaatagtgaagataagaaagagaatcacatttagattttttttttttcaaatagtcccctaaaagaatcaaacatagaatctgctgcttattagaggcccttaaagaaatatttattcaagaatagtgagaagtttggaatagaagcatctggagctaatactcaaacagtggaaatatttccacccaccctacctctttcaaaaaaaaaatcaggccaagcgcagtggctcacgcctgtaatcccagcatgttgggaggctgaggcaggcggatcacctgaggtcaggagttcaagaccagcctggcccacatggcaaaatcccatctctcctaaaaatacaaaaattagtcaggtgtgggggtgggcgcctgtaatcccagctactctgggaggctgaggcaggagaatcacttgaacccagaaggtgggatgcaccactgcactccagcctaggtgacagaatgagattccgtctaaaaaaaaaaaaattcaccttaaaatatgatactcttgcactgaatttttcagtgggaaaaacacattgaaaatggtatcagtggtggcatgtggccagagtccatactctgtaagtgtgtgatatttggagaaggaggagaaactttgactttgcttatattcaaaatctccccttttccctgcggatgttttttttttgtttgttttgttttgttttgttttttgtttttttttttgagatagggtttcagttacccaggctggagtgcagtggtgtgattttggctcactgcaacctccgcctcccaggctcaggcaatcctcccacctcatcctcctgagcagctgggactacaggcgcccaccaccatgcctggcttatttttgtattttttgtagaactgaggtttcatctcatctctacaaaactggaaaggctgttcttcacctgggaaattcttgccaacgctggtctaaaactcctgagctcaagcgatctctccagcttggccttccaaagtgttgggattacaggtgtgaaccaccgtgcccggcctccctcgggatttttaattttgctactatatgccataagaagttatcagatcattttatgttaaaattagtgttatctggagtttgaatacagctactcattttccacagtgaatcgaaggagggttgattatacatacacaaatgatctagctgtcccttttcgtagccattttaaggtttcattttggtcaaagtacttatgctgataaattgcatcctaatcttgtttgtttttaactttgtagactttcttaaacattaagtttaaggaaggatgaaagagcagaggagaatatgtcttccctttttacctctgttgttaacagctgcaaggattgctctttaaagagaggttacaacttataacagaagttaaaaacccaaatgcagaagttgccatgtatacttctgataccccccaaaaaatctaaaaatcaatttttatatgaaaataagtcctaaatacactccataatttccattgtatacatcttaacttttgaatattggatatgcttgaagtggagccttaataaattcatggaacaaatttatgtcgatatctattatgtgtcaggcaatttgcttaattcatatcactggggtaagtgcaaaggatacttacattaacattctacttacctttccctctggatatttcttcctacctacttgaaagggaaaagaagtaggacttgtttaaatgactttacttttatctttttatatagttctatgcaaatgaagaaagaagtaatgtcacctttgaaatgtaattggtaaacatggttcatattatttaaaaggatttgtcagaaagctcagggagcaaaagacggttgtgtagtagagccactaatttcaaaaagttatcctttattagttcttattttattttatttttggagacaaagtctcgttctgttgcccaggctggagtgcagtggcatgatctcggttcactgcaacctccatctcctgggttcttgcaattctcctgcctcagcctcccaagtagctgagactacaggtgcgtgccaccacgcccagctaatttttgtatttttagtagagatggggttttgccatgttggttaggctggttttgaacacctgacctcaagtgattcactctcctcggcttcccaaagtgctgggattacaggtgtaagccactgcgcccggcctattagttcttatttaaaagctggtagagttattttctttattttccaagggaaggaaacatgcctctgcttattgaaattgtcgaaatcttattcgtattatcttctggctaacattacttaactaatgttgggaaaggagttgcattttcattattttactcttccctcgccattgttctgaaagcaatatagaaaagctctaacaatttcccagttgaagaacagcctttccagtttaaatcagtttttctagcctgaagggattttgttcagtgagcacagatgtataattgtaaaccagaagccagcacaacctattttgggtacttggtttggtttttgaagtgttagtctgccttttaggggtacatttttaaagcatagatcttatgatcgcaagatcattcgttaagcctcttcattgtcagggtaagggtttagtattcatacaattataaactcaattatgagcactaattatctgcagagccagctcattaataattagtatgtgtgcaggcatggtagctcactcctgtaatcttagctactaggaagactgaggcaggagaatggcttgaggccaggagttaaaaaccaatctgggcaacatagcaaaaccccatctgtaaaagaaacaaacaaaaaaacaaatttgccaggtgtggtggtgcatgcctgtagtccaagctactaggaaggctgagacaggaggattgcttaagcccaggagtttgaggctctagtgagctatgattgtgctaccgcacttcagactggatgacagagcaagaccctgcctctaaaaaagtaacaacaataataacaataattagtgctaggatggtgagatagtagcactaggatggtgagaactggttctggagccctggttgacaccatgttttattttcataaacagcactactacttgtattttagactaattacattacattaatgcttgacattcataaagcttatttatttatttattttgagacaaggtctcactctgtcacctaggctggagtacagtggtgcaatatcagctcactgcagcctccatgtcccaggttcaagcaattctcctgcctcagcctccagaatatctgggattacaggcgtgtgccactacgcccggctaatttttgtatttttagtagatacagggtttcaccatgttgaccaggctggtctcgaactcctgacctcaaagtgatccgcccaccttggcctcccaaaatgctgagattacaggtgtaagccaccatgcctggcctgtaaagcatatatatttaacaaaataatatgtataggtgattcaaattttgttaaatatgtgtaagatatgtatgtaatgatggggtaaaggactataaataatgtaataaaatattaattatgtttatctctgtagtcagaccttatattaggcttttaaaaaattttttattttgggccatgaatatgtaatcaagaaaaagtttatgaccccaccatgtagacaatacacatacatatgtacgaattatgattgaaaaagtattcttttaaaaaaaaagccaaacaacttttgataaattcttagtgaaacatccaaatctttgcagaacaagaaaacatccaatctttgccgagcaagaagtgtctatcccttgattgtagagggaaaaacctcttagatacagttgtcagcaaatgaagagttatctctgtaagcttataatctgcttatggcattacaaaggcatttgaggtaatacttaatgattatggaagtctctcgaagatagaaaattggaggaaaaaacccatcagaatcaaagtaggactaactacaggttgtcttctagaatactggcagcaaggtttttgttttatgtgttttgtgcttactggcatttttgttttcgttcacaatgaaattagctgtattgcagcccataagaaaaatataagttcttccaacttagactgcccactttatggaattaaaaatatcagtgaggccaggcacagtggttcacatctgtaatcccaacactttgggaggcctgggtgggaggactgcttaaggccaggagtttgagaccagcctgtgcaacgtagcgagacccccatctctaccaaaaacaaaacaaaacaacaacaacaacaacaacaacaaattcttttttttttttttttttgagatggagtctcactgtattgcccaggctggagtgcagtgcagtggcgcgatctcggcccactgcaagctccgcctcctgggttcatgccattctcctgcctcagcctccccagtagctgggactacaggcacccatcaccatgcccggctaaaattttttttgtatttttagtagagatggggtttcaccgtgttagccaggatggtctcaatctcctgatctcgtgatctgcccgtctcagcctcccaaagtactgggattacaggcatgagctaccgtgcccagccaaaaaagaattcttaaaacgtagctggcatggtggcacacgcatgtagtcctggctactcgggagcctaagatgggaaggtttcttgagcccaggagttcgaggctgcagtgagctatgattgcaccatcgtactccagcctgggcaacaaattgaggccctgtctcaaaaaacaaacaaaaaattcagtgagagcaaggtactgcttttagccactaagatatctatttttgagcatatttgagcaacacagatgctatcaccccttatatttcttttggaattcaaaaaatgcactcttataccttaaattatttcattctcaaatacttgtttttttggtgtgtgtgtgtgttggtttttctttctttcttttttttttttgagacagagtttcactcttgttgcccaggctggagtgcaatggtgcagtctcggctctctgcaacctccacctcctggattcaagcgattctcctgcctcagcctcccaagtagctgggattacaggcatgcgccaccacgcctggctaattttttttatatttttagtagagatggagtttcaccgtgttggtcaggctgatctggaacccctgacctcaagtgatccacccgcctcggcctcccaaagtactgggaatacaggtatgagccaccaagcacggcctcattctcaaatacttgtgattaaagatattcccattttttaaatgggaaaacttacatagcactacaagtttgccaaagttgaagttaaaatgaatttattacatcctttgcaaccctgagtacctttaatgtgtcaagtactccagaggctgaggttagcaaattgaataagatgcagttttcacacctttgtatacttgagcctccctgccccatggttgccagatctcttctcttcttgagcttaactgagctgggcaatccatgtgatttgcagcaatatcaacaccaacaatgtctaggaaaggacagccacagggaactctggcttctcgtgtccagagacttaacctgagttaggcttcagccccaccctggtgggaaccccattgctgtaccctccctgaggctattagcctctcttaagcagcatctctgcctacatggccatccctgcttgactagaggtccggtgtgtgagaatgtaggattcctcattcttgataccaatctatctgcttttgtatgtgctaaaaggctggatttgaaattaggccttggcaatattagaaaattagataactatgctactgtctgcagagaagagatcgcccatcaccattttggggcatctgtttccaggtaactagaggttaattgcattgaaaatagaagaggtgccttcagaggactttcggtagtgaggaaagggttaatcctgtttctccacaaaccctggaagcagtttgtctggaattgtccaaaccactaccagagagctaatcatcagaactggtattacatgtgaaaaacgaagcctagggatgtgtggtacatctggtagaattggtagctggatgctttcccccataattcagccgttgatattttagttagagaggctctctctcagactgaagttgtttccagtaactgccttttccagctaagttaaggtgagttgagagcatgctaagcattctccaccacttgttgctattgcatctgtatgtttatgaggaaagagaaatctgagatgtactggagttttttgttttttcattaccactgttagcctagctccattttttgattactaatttgtggacctttgtgaaactgcctggtatgaatatgttcttttctttcacatttctgtttaaagggcaggggaaaagggaagcaaactctagcaaaagagagatgaaagtagatttcattcatttattctgttagaaatttgagtgcctcctatattctgggcattgttcttgttgctgtggatgtagcagtgtgaaagacagacaaagaggggaagaaggggagcagatataaaactggaaagtgaattggtggggaatgggctaggaggaagaatttaagtgctcagagaaggtctcactcagatcttatattgagctaaaatctagattacaagatgttgctaggattggactacatgtcttgctagtcatgataatgacttggaccagggtggtgatgacgaaaactgagaccctgttacaagcaggaatttctctggcttcctgcctactttttcagtgcagtctttaatcagctttacattttaatttaaataaagtaatattttgacacagcatgtagttatgtgatttctgggtgcttttttaattgttgaagtttttgactattaagtactgactgtaaaacatctaatttgtttttggcttctgtgtactcatcttcctaaatctataatatgtatcacagtgtttgccaaagttgtttatagctgtttattaaaatatttattgtctttcttattataaaagcgttatacagaaagtataacaaaatgtaatgaaaaaaataaccttcaggttacagtgacccatgcctgtaatcccagcactttgggaggctgaggtgggaagataccctgagcccaggagttatcagcttgggcaacagagtgagactcccatctctatttaaaaaaaaaaaaattataagtagctgggtgtggtggtgtgtgcctgtagttccatctactcaggaggctgaggcgggaggatcacttgagcctgggaggttgaggttgcagggagccatgattgcactatgcactcccgcctgggcaacaggagaccttgtctcaaaaaaagtaaaaataagtggtataacccatgattccactatacagataaacattttgttttctttttagtcttttttctgtgcacagatatatttatttccaaatggttttttagtttttgaagaagtaaatttggtaaacaatagttttcagaagagatcagtagttaggtggtttgtttcatttactttttcatagcattcttcaaggtatgggatcaatttcctattcttttcacttgaactgctgctgtcattagttgaaaagccatcttcccattaggtgtttattgtgtaactgatgtattttggttgcattttctatgtcttcagccagctttttaataatatccttaaaatgttcattgagctgaagtcacagattagtcctagagtccagtttcttttccttttttagccttattcttttctcagagctgtaacttggtaagctttgccaggaaccatcattctaattttcaggtaatatgaattcagtatgttagtttgttcattaactcttagattgcttctgtgatttatggtgatttatttcagcttatagtaacatcatctaaatattgaaatgttagaaatatcttcttaaaatgtttggaactaacttagatcttagctataaaagtatattcaagaaaatataaattctttttgaaatatatttgtcctcaaagcaggctgaaatgtaatgacgattcttgatgattattttgcagacctcaaaggaagaccttctgcaggctgattttgaaggtgctttaaagttctttagagttcagcttccaaagagatacagggcagaggaaaatgcaagaagactgatggagcaggcttgcaatattaaagtaagaacatgagtttttatataataaaggtaaaatatgagtgcagaataatatgacaaattatgtaaaaatttttttatatgttgcaaggtttgattatgtttaagattagattgtgtatgaactgatttctcccagatgtgtttgtcaggctaatgtgtgtatagtagctgtaccttctagtaggacttaaagttggcaggctcagattataacaataggaagataaacatttatctcataggtggggctctagagtgggctgctgtgatagtggtttccatggaagcagacttagtatttagcttttgccatctgttttaagattatttaggacaaagcaagaaaagcttgcttaggcaatgctttcatttctctaagtgacttggaaagtttgagtcttgatctgcccattcccatcccacacctgccaaatatctgtggatacattggtccatgtcacatgtctgataaagctaaacacattttataaatcaatttgaaattgaaaactctttccagaaagttgtagtattaaggtgagagagcactcttaaaatatttggaaccaatttactgatgttaattcttatacctctacaatataccagggtatctttttacctaaccataacgtaaatataaattgttttcctaaacaaacagagatcctggtcttagggactttacattcttgcagaaggaaacagacaataagcaacataataaatacattatttatttaacatgttagaaagtgataaatagctgtgaaaaaaaagagagtaggggaagataaagggaggttggattagtgggggagcaaaggttatgattgttattagatagtcaatgtggacctcactgagtcaatgaaggagatgagagattagtcatggagatgtcctggggaaaagctttctaggcagagtcaatagccagttcaaaggtccagagactgcctcatgcctgggtgggcttgagaaacaggaaggccagtgcagctggagtgaagtgaatgaaatgggagtagtaggaatgctcacaaagagccagaaaatgtaggccattgtaagcatttaggctttactttgagtgaagcagggagctcttgcagggtttttagtggagcaatgatatgatctgtctgaggtttttaaaggatcacaatggctattttgttaaaaacaaccataggaaggtaagagaagtagggacatcaaacaggagattttggagtaatcctcttgagagatgatgatagactgaaccagggtgttaacagtggagatagagatggagtggagatggagatggttggaacctgagtatttttgaaagagaaccaataagatttcctgatatattaaatgtgagtgtgaggagaaaagaagagttaaaatgattgcactgattttgaactacgcaactaggagataagagtcaccatcaacttattaagcatattacttaaaaggtactttgacacagacttcttttaggcaccagagccactgtaacattttttggtataacacaatctttttaaatttaaatcaaattataaatgttaaaaagtacagttaaaaagtacactgaaagtaagtaactgggcagaaaaaaattattttgtctttcaagtgagctttatattcaaagagatcattttccaaagctatcataagaaagatggatttctgaagttttcattctgaaatgcaaactctttaaagccttcacgactgattgttttatttggccaaagtgtaagccacatttatttgtaactttgaaagtatactctagtgggcatgatgcctttgactgaattttgtgggtggtgagtttgaaaggtaggcttcagccaactgattgtttcggagatgccagagagaagtattgtaaattgggtcaatgttgtaggcatcctttaaaataaaatatttatttctaagaataaaagagtagagaaataagaggtacaggtaaggtgaaaagttaaaggttttcaagggaaatctcagaggattgccaagtcactgaggacaaaagaaacccaggaaaacaattgaaaaacatgaaatgtatagggaaaatttttttctccaatataatttatgaagttcctggaggtggctagttattatcaatccagaaacatgggatctgagagatggagaagcgtaaaatgttagaaaacaagttcaaaatataatccaaatggactgctcctggaagggaagtgctgggtacaaccagaataaattttttggacatgaataggtaaatatgaatatttttaaagcttttaataagatttcaataatttaaaatttttaataatttaataatttgtaaagttttaatagttttttgtggggttttctttgcattatctaaggagaatgcctttttcttggatatttaagacggtatccacgggacaccatttcatttataacatataattgtagagtgaatgattgtgaggcagatgtgaggtgaaactgaaagaaggaagacataagtcatccagtattgggctgggattgtgctgggactagaatgtaggtctccaatccaaaggtctaaaattgtttttaaaccaagacctatattttggttgcttttatgtcaagaccatgactatatgtacgtacttacatacacataactgaagagatacttacccttacactgaggcactctgatgttttttgttctattgtattgtatttccttttttttttttgaaatggagtctcattctgttgcccaggctggagtgcagtggcacaatctctgctcactgcaacctcccaggttcaagcaattctcctgcctcagcctcctgagtagctgggactacagtcatgtgccaccacgcctggctatttttgtatttttagtagagacagggtttcaccatgttggccaggctggtctcgaactcctgaccccaagtaatccgtccgtctcagcttcccaaagtgctgggattacaggtgtgagccaccattgcccaacctattgtattgtattgtattgtattttaaacttctccccggatcccaagaaaatccccaaaccaaaaggctgaccacaacccactaaatcgattttacaatagcttgtagttttgaaaaaacactaagacctatcccactgttcctaccacctccccgttccccactctgatctgccacaacccatgagaggctgtagatgacgaggtgttacaatgaataatggaagtgcatgtgtaggtaaggatgtgagtcatcatgccatcattacagcagcttgtgctggcagttggaaattttaggagatgatggacttatagactgagacttatgtgttagacaaagcattcatggacaaaggtgactgcaggcatggaataggcaagaaagtttaactccttatccatagcctatttaagattaaagatagaatttctgccaaaagtaatcaagttttaaacatttttaaattattttcaaagttggtgttgtatatagttgtgtcttttttgaatggacatgttcccatttaattaccccccaaaataatcactttcctttaattttaaggaactgtaaccagtgatttcagtgaaactgaaactggctttaaaatagatgcagcagttgcaagcaaaaaataacttgttagctctgtatgtggtttatttctgtgagtgtaccaacaagatttgttaataaagcacattagattggataaataattttatttttccaaaacttgtatgacattaaatatcaggaacattttcaatagcttctaaactggtaatttaactaatgtgactccaagttattctaatacccttctgttcctatggtttcaactaggccaaaatcagaaaacatattgacccatcaggctttactttgaacagtcatttggttacttttaatattgaaatcaagacctaaataaaagatgtttaaagtgcctaatatgaatatcctgtattttcccagggagtcagtttttattaaatatcatactttgatttttgccttatagttaaaaatgctgccattgcagagcttcttaaacttggattttggcttcagagactctgaattaccagaaatttgaatttctttgtatgaacatatgagcattttgtttttcttagtaacataatacatagcttttttttttttttttttttttgagatagagttttgctcttgttgcccaggctggagtgcaatggtgccatctcagctcactgcaacctccgcctcccggattcaagcaattctcctgcttcagcctcccgagtagctgggattataggcatgcaccaccacgcccagataatgttctatttttagtagagatggggtttctccatcaggctagtctcatactcccgacctcaggttatccaccccccttggccacccaaagtgttaggattacaggcgtgagccaccacaccaggcctcgtaatatatagctttattaagtgcatatacacataatctttataattcttgatctgattacctgtttttctacatatttttattcaataccatttatattgtatcaggttgaattgatgaaattaccattcctgttggtcagaaactgtcaggtatttgattggtttatgatttatgattcagtattttatgcctccttacagctcaaataggtgcatatgtagcttagctctatggccatgtaaacttttcctgagaattattctccaaaggctaagaaacaagtcttttttttttttttttgagatggagtcttgctctgtcaccaggctggaatgcaatggcgcgatccctgcctcctgcaaccttcgcctccctggttcaagcagttcccctgcccagccttccgagtagctgggactacaggcgtgcgccaccatgcctggctaattttttgtgttttagtagattcagggtttcaccatgttggccaggatagtctcgatctcctgatctcatgatccacccaccttggcttcccaaagtactgggattacaggcgtgagccactgcactcggtcagtcctttttttttgttttgttttgtttttaagttgatttttatttggaataatgttccaagtaccatatttacgatggacttcagtagtagcaaagttcataagcacaatcatccaaaattttctgttggtagagctttataatagagctttttaaaatatgttagtttatttcacttgtatttcattagtaaaataatttgagcaaaattaaaaggcaaaatctgacattaacctaaaggaagaaaattaggaaagaaaagttatttattgagtgcctgttgtgtcccaggaactatgccaagaggacttttcagaggaagtaagagttaaaatgaaatctgaaagattattaggagttaaggagtgtatcaaggcagggagaaggatgtttcatgcagacaatatgcagaagcccataggtaaaaaaaatatggagttgcccaagacctgaatgtaggtcatgactggagagtaggttgcaaggagggagaggcagttaggggagtagatagagaaaagactagagaggtaagcaggagccagccagcttgtgcagagccttgtaaaccacggtaagcaatttggattttatcctgaggggagtgataagcactgaaggatttaaaataggagacataaattatcaggttattgttaggaaggtcattctggttgctgtgtgggaatggattgaaagggttaagattcggtattggtgacagaccatttcaggagctgttgcagtcatctaggtgagaagagaccagagtttttgtaataggctgaagaaattatggatgaattccagagacattcaagacataaaattaacagattttagtgattacatgtgagcctcagggcagataaagagagccagcgatagcacttaggattcttacttaagcaacttggtggaaatcacactgagaaaggaaacaaacaagagaacaaattataagcactaaagataatgagttaacttttgaatatgttgttcgtggtacatatccacaactcatatccaagtagatataaatatccaataggcaggtggatactgaagtgagatctgagctaaaagtagacatttgggagtcatcagcattgaaaccatgggagtgggtgaattcttatagcggagtatatacaatgagcagagagaagggtggaggatagatgcattcacatgtaaaatacagatgagggaatagaagctggtgagactagaaggcaggaagaaacccagaagagtatgactgtgaacactaagggaaaaggtgtttgttttcaagaaggaaggagttgaacaagtgtcagtggtacctagaggtcatgtataaggtactgagaagtggaaagtagctattgtgcaatatttaacgaaaagacatccttaatggtcttaatgaaagtagtttcagttaagttatgacaaataaaagccaatgattcaaggaataaatagcaggtgagtaaatagagaaatgaagatgagactgtttttctaagaaggttagtatggggagaggatggaaaatggaagagatagccggtaattggactgagcatggtggctcacacctgtaatcccaacactttgggaggcggaggtaggaggatcacctgaagtcaggagtttgagagcagcctgggcaacgaagtgagaccccatctctacaaaatatttgaaaaggctgggtgtgatggctcacacctgtaatcccagcactttgggaggctgagacaggtggatcacttgagcccaggagtttaagaccagcctgggcaacatggtgaaaccccgtctctaccagtaaaaaagaaaaaaaaaaattagccaggcatggtgacatgtgtctgtagtttcagctactcaggaggctgagatgggaggattttttgagcttgggaggcatgggttgcagtgagctaagatcatgccactgcactccagcctgggtgacaagagtgagaccctgtctcaaaaaaactccaaaaattatctgggcatggtggcacatgccgggagtcctagctacttgattggctgaagtggaaggttggcttgagcccaggagttggaggctgcagtgagctatgactgtgtcattgcattccagcccaggtgacagagcaagactctgcctgtctctaaaaaaaaaaaaaaaaaaaaaaaaaagagatagtcagcaagcctgagagtaagtatgggagagagagagatgagtaagtacaagagagagagataagaggatgttgagactaagatggatttttggaggatgggaaagatgagtctttaatgctaaaaaaatttccaatgactcttaatttcttctttgagcacctactatatgccaggcattgtaccagatagacccagggaatatgagattgagcaaaagcacatatgctctcagagctcatggaattcacagtgttaatttaatcaccttaataaatgtatacttacagagtgagataaatgttcagaagagatataataaagatatatgagagcaaagagcaaaggaacctgaccttgactcaatgatctagagaaagcattcttgaactgagattacaaggtattccagactgaaaagcagcatatgcaaagcctgtgaagagggagagaatatagtaagttgtagaaactaggagaaggccagtttgactgtacttcagagaatgatgacagttgatatccagggaccaaaccacttcatctaccaataagaaggaaaagcccacagaaagagaaaagttaaagattaaataaagaaagggaaatatattaacaggaaaaggactctgaggaggtaagggattaacctcaaaagaatggacctttcattacaagctggagggaataggcaagggaaggatggggaaaatggtgaatgtgtagtttggtgaggaagaaattgaggatatttcatttgaagttttctattgtttctgttaaacaggatctaggatgaagggaatgcagtaaagtgacagctttgagaaacatggaagagcttttagactggaaaaactcaaaagaacagctagtctatattgttgtagactatgagttcatagtggcaaaaatctacagtgttttgtaattttctttagaaacatttagtagtccaaatgtatatatgaagaagacagaaggttattttaaccacagttgaggtttgccaatatgaggcaaaggaaggacatggggccagggcagttgtgctaataaactgtatattgggttggggagtaagagggagtagagaaagaggtatccctgatttgtagcgtttgcccatttccatggtatgaatactcccaccatggccaaatttcaagctaccaatgacttaaccgccccactcaatttctgaatattaagagccacttttgagctggtagtttctgacactggtacaccacagggttgaggagatgaggctaatagcaggagagtggttgacatgatgggaaatggagtctaattaatagaaaagagagtgaagatagatgggactgaaagactacaagaaaagggcctgggagaagggaacaaagaattattggactcaggaagaatggcggaagaggagattaattcccttattgggggttacccaagataaaaagcatctttttctcaaaaattcatatattttaaagagaactttctgatactagaaagtaatattgccctgggctcgcccctgtaatcttagcaccttgggaggctgaggcgggcagatcgcctgagctcagggcttcaagatgagcctggccaacatggtgaaaacccgtatctactaaaatacaaaaatttccctaggcatggtggcacgtgcctataatcctagctactcaggaggctgaggcgtgggaattgctggagtccgggaggtggaggttgcagtgaactgacattgcaccactgcactccagcctgggcgacagagtgagactccatctcaaaaagaaaaaaaaaaaaaaactgccctgtgctcataatttccagtgatcgcagcaaaaccatgccaattactattttggcattcatggccacctcctatgatttacttctctttgtcctaataattctgccaccatcactaccattttactctgatcacatgattaagagttggaaatgcattgtgggaggaatagacaaagatggcagaggcagtgcaggtagcgggaatgagggaatgaggaagggcactcatggttaaaaacagaatcctgacccagcatcttctcacacaccaaaattgtcttcctaccccgtgctaaagaggtagctaccaatgataagatgttacttatcacctacttgcctcagaaaattctaagctctgctccagctcaattacctatatattgtgctggactattttctactctcccaaagttgcaaatacaatttgatcttacccctcacaaatcatgtttttaatgagacagtggtagattcctttatctagaatttaattttttttctccgaagacctccatattcataactggatttgaatgtttttgaaaataactttcacagtagagcaaaactgtaaagaacaattgcattaaaagcaatttacctctaatttcttcatgctgtttgctatttattcctggctgttgttgctgtacgtgaacaagaatgtactctctgaaatagaggctttctttgaattagcactgaggtcctacagaagtttttgtcaacttcatggatctaaaatgtgtgcttttatgtacaccattgaaaagattcacttttgattaaaacacatcttgtgttccttttctataaagacctctatatgttgacaaccacatttgagttgttaggtttagtgtcataatcttctgctggagaaatgttatcatgttataggatacagatgtgataattaacacattgataataaagctgggtgcggtggctcacgcctgtaatcccagccctttgggaggccgaggcgggtggatcacgaggtcaggagttggagaccaacctggccaacacagtgaaaccctgtctctactaaaaatacaaaaattagccgggcatggtggcgcacgcctgtagtcccagctactcgagaggctgaggcaggagaatcacttgaacctgggaggcggaagttgtggtgagcggagattgcaccgctgcactgcaagcctgggcaatggaacaagactgtgtctcaaacaaacaaaaaaaattgataatgaagtagtttctatatcaaagcatttgccactgtttgcctttgagacttctattaacactcatagtcttcagtgcaccttagattggggtattgttttgttttattcccagtgagcagggaacatgttaatgttggacatgttctgaaacagttgataacaggcagaggaaacaggtcagagctccagatgcttaggcatcaggcaccttccacatttaaaaaactcagcttttgtggcccttcctaatcagctagaacagtggtctcctaccagggatcattttcatggaagacaatttttccatggtggagggggagggcattagattctcatagacagagcagtctagatcccttgcatgtgcagttcacaatagggttcacgctcctatgaaaatctaatgctactgctgatcagacaggaggcagagctcaggccataatgcttgctctcccacgaggcacctctttctgtgtggcccggttcctaatgaccggtactggtccgctgcctggtggtagggacccctgagctagaacacatttgtcttctttatttgcttctgccattttgtttctaccctgtacctacttctgccagtcattttctggcagttcattaaaaagaaagccatacatacattttaaaattaacctgatgggtaaactaatggatataaaaattgatttatatttgggcaactcttttcttagaaaaacaaatagtaaaccataggaatagagcattatgcctttatagacgttccaaaattggaactatgtgcattccatgcataattaacaacaaaaagaacatcagaattgctatctcacctagtagtttatttttcttcaaaaactttaagttttctttttttccctgcacctaattcacgcccagcagtcttataatggatcaaaacctaatgattatgctcttaaataagagtttccatattttgtttacctttctgaagtgttttgccaattaccttttatccagtagttgtgatttatatctatcagagttgccataacgttagaacttgtcttcactattgggaacagcagtaatcaataattttcccgcaaccatttaccgtgattctacatttctttgaattattttatttatttattatcacttgaattcatattaacattatgtttaaagtgtgcttcatgatttgtatttggggatccgatttacagaagaaaagaaaacattcctctgaacccttgttgcttctcactggaaataatttcattatgttaggcaacaataaaaataaatgaagagaggttggttaatgagcacacaagcatacactttgatagaaggaataagttatagtattcagtagcacatcagggtgactatagttaataatttattgtgtacttcaaaatagaagattcaaaaggttcccaacaaaaagaattgacacatgtttgaggtgatcgatatcctagtactctgatgtaatcattacacatagcattcagggagcaaaatatcgcatgttctccataaatatgtacaattattatgtatcagtaaaaataaattagaaattggctgggtaagtggctcatgcctgtaatacttgcctttgcctcccaatactttgggatactttgccgatcacttgaggtcaggaatttgaaaccagctttaccaacatggtgaaatcctgtctctactaaaaatacaaaatttaggccaggcgcagtggctcacacctgtaatcatagcacttcgggaagccaaggtgggtggatcacctaaggtcaggagttcgagaccagcttggccaacagggtgaaaccccgtctctactaaaaatacaaaacttagccaggtgtggtgacacgtgcctgtaatcccagctactagggaggctggggcaagagagtctcttgaaccaggaaggcagaggttgcagtgagctgagttcgctccacttccctccagcctgggcgaaagagtaaaactccatctcaaaaaaaatatatagatatagatatatacatatctatatatatattagtacaaaaattagctgggcatggtgacacacgcctatagtcccagctacttgggaggctgaggcaggagagtcacttgaacccaggagggggaggtttcagtgagctgagatcgtgccactgcactctggcctgggcgacagagcaagactctgtctctaaataaataagaaataaacttaaatgaaacttaggtgtttcagataagttacattaggaaggttgggccattggatcctgagggtttagtgttctaaacacttaaagcacaactgttttagataccaatgcctgtactctggggaatataaaatataattatattagatttactgagtaatttttcatattttcatttctccaactcagatccatttaccttgcaaataactaaatctaattaatattctggagaaattgcttatttcactcttgggcctttttctctcctcctctctcccctactgttcctaaaaaaaaattttttttttgaaatggtggcagcaacatgtaaatgaccatagcaaccaaaaaaagcgaaatattttaaatgttgttcacatatctccaactgttgtttgtcaagccttctgaagttccacttaaagacaacaaactactgaggagaaaattatattccttgctgtagttaatagttgtgatcaaatgggcattcttttctcattgccaaaccctctgacttggggattttgttacttcaacctgtgagaggaacagagctattgctttcatctagaacatctaccttttgccttttttcttagcctgaggcacttcctacccaaatcattactgtatatgtagttaatatagtctcttttaaatactcattattggttttgcttttttgatttttataatgtgaaggaatcttggagtacaaacgacataaagaggtggtaaaacagtgttctgatagtagtttaggctaggagaagcgtcacgttctcattgtggcacaagttcaacagatttatcagtgtgttagcctttccaggcactgccttattctgttatccctaacccgtagagtcaccatactttctactaactcttgctacttttatcctgaaaagttttagctgaagtttcttacaaaattggttcctgaagaggtcatacttttgtttctgtttctcatgtctgctgttttacatctgcattcattttctagggatgccctaacaaaataaatacacactggaaggattctttactcaacttttattttagaatcgagggtgtggccaggcatggtggctcacacctgtaatcccagcactttgggaggccaaggtggtggatcacttgaggccaggagtttgagaccagcctggccaaaatggcaaaaccccatctctactaaagatacaaaattagctgggtgtggtggcgcatgcctgtaatcccagctgtaatcccaactcgggaggctgaggcaggagaatcgcttgaacccaggaggcagaggttacagtgactggagatggtgccgctgctctccagcctgggcgacagagcaaaactctgtctcaaaacaaacaaacaaacaaaaaaagaatcaagggtacaggtgcaggtttgtcacatgaatatattgcgagatgctgaggcttggagtacaaaggaatctctcacccagatagtgagcttggtgcgcaacaggtggtttttcagctcttggctacttcctgcctccctcaaatagtcctgagtatctgttgttcccatctctatgtccaggtgtactcaatgtttagctcccacttataagtaaaacatgcagtatttggttttctgtttgtgcattagtttgcttaggataatgacctccagttgcatccacgttgctgcagaaaaggtgatttcagttttctttttttctttttttggagacagagtttcactctcattgcccaggctggagtgcaatggtgcgatcttccctcacgcctctcgggttcaagtgattctcctgcctcagcctcctgaatagctgggaatacaggtgtgtgccaccatcctcagctaatttttgtattattagtagagatggggtttcaccatgttggccaggctgctcttgaactcctgacctcaggtaatccacctgcctcggcctctgaaagtgctgagattacaagcgtgagccaccacgcccggccaccacattttctttatccagtccaccgttgataggcacctgcttgattctaagtctttgctgttatgaatagctttgtggtgaacatacaggtacatgtgtctttttggtagaacaatttattttcctctgcgtgtatacccagtaatgggattgctggttcaaatagtaattcaacatttctttgataaatctctaatctgttcaccgcagtggctagagtaatttacattcccaccaacaatgtataagcattcccttttctctgcggcctcgccaacatcttattttttgacattttaacaaaagccattctgactggtgtgacatggtatctcattgtggttttgatttgcatttctctgatgattagtgatgatgagcatttcttcatatgtgtttaggctggttggatgcatagactgggaggcttaaacaacagaaatttgctttctcacagttctgaaggttagaagtccaagatcaagatgttggcagggttgatttcttttgaggcctctcttcttggtttccacatgggatggtcaccatctcattgtatcctcacatgattattcctctgtctatattatctgtgtcctaatctctctctgtctttgtttttttttaagagatggtgtctcaccatgttgcccagactggtgtgcagtggctagtcacaggtgtgattatagctcactgcaatcttgaactactgggctcaaacgatcctcatggcttagcctcctactgagtagcaaggactataggcatgtgccactgtgcccagctctaatctctttttataaggacaccagtcatattggattagagcccaccctaaggacccattttaacttaattgtctctttaaaggccttatctcccaatacagatactggaggtactgggagttaggatttcaacatattaattgggggggcacaattcaccccataacagtgttgttctcatagtaactgagtgcgcatttcttctcaatttctctgaaaacattctcttctgaacgtgaatcttgcttggcagctctgagctatacctccaatatcttataacacgtgacagtttcctatttttgtcagcatacccaacatcacccattttctcctaaactctcagatgatctaaaagatcctatttttttttacagctccaccctccacttctatcagcccacttggttggcaaggaattttctctggcatgcatgatagcttgttagaagttctaatttaccttacataccctgttctagtatggtcttgttgcattaactttcttataatcctgcttttatattgtatcctatgttatgcagaccataacctgccttattcctctcttttcctgaaagagaggcagtgaattgtgcaagtaagttgtatctttgcacaatgtccagtggtagaagaaagtctatattgtattataatagagtattttaagcaacaacatatgttgaatactatataggacacaggtacttagtttactttctagaattatttacataaaaacttttgtccctaaattttgacccaattttaggatggccattatttaagaagccagatggcagacattgcttctgtgaaggaaacattttgaagattgtctgacatagtaggatcttcttagagccatcagaatttgcagtttcaggttcctgacattgcttgtctggagtgctataactgtctcataactggtctctccggctttggtttctgtcccctctagtttcctctgcatgcgaccatttgagttgtctgtctggaaaactaacctcagtttatcactcctcagaggacactgaagctccctgttacctgcaagacaatcccacacacctcaggttggcacacttccctttcactcataccaatatgccatggccttgtcacatcctgtttctgctgcctaggttgctttctgtctgtggagtgcctggagaaggcagaggctttgggagtggacaagtctaggtttgaattctggctccagttcttactgagtgatcctgagaaagttacttgatctccttcgagtatgagtttcctcatcgtgaaacaaggctaatacctactgcacagagatgttgtaagaattaattaaattaaacacatgtgtgaagcattggctaaattaattccttgttgtagctatgtagtcaagcaaactcctatttaccctttaggttgcaggtcaaacatcacctgctctggaaacctaggctgttatttattctgactctggcaattcctacactagagcaccactgttggcgttaagaacgtggttttctgaagccacattgttggagtttaaatttagccttttccatttaattagtagctgtttgatctctggcaagttacttattgtacctcagttatctcttctgtaaaatggagatcctattttctatgaaataggattgctatcaagattataaataggataatataaataagaaacttggcacaatgtagtccataattagtgtacaaccaagatagtcattatgactctagtttctctcattgtgaggtcctcaaggctgtgactcttccttgcccctccctagatgcctgaaccaacacctagcatagtagatgaatcaaggagtccatctactatttatttatatttattgaggtaacaaaccctgtttataaaagatgaagaatattgggctttgcattttccctgaaaatacttctggtaataaacaggaaaatcctcaaatgttacactgagtggtattccaggtttattcctatagaaaaatgaaataaaaagtgaaatctgtctgaattttgcttttaagagtggtgtttattatactgtgtagcttagagggctcatgcaatataaatttgtgaattttccaccattccagaccgttaagacttagatagaaggtcatcattcttccttgatgttgtggataaccagatgccctccctcatccctattagatttttttggattattatacagtgattttaggatactaaaagttttttcaagtttcatttgcataagtttcttagtcgtgtgtgatcaaaataactgtgttgaaagaattgaggctaagatgtatatgccacagactttaaaacagagtagaatgtcagattaaaagagtttatagtcaaaagattgctaatgtaattactaatgtaatataattactaatagatcacaaatgatagactagttatttccatctttatgtatgaagttataatcacattttatattttgatgtacaattttttatgcatttcataattatccatttattttcttcataaattcaaagactgtcatgagtatatctgcatatttatggttgcccattgtatcaattatctattgctgtataacaaaccatcccaaaacttacaggtttaaaacaacaatatttttcgtgattctgtgagttggctaggtggttcttctgttggtatctcctggattcactcatgtggtagcattcaactgttggaacagcttagaacagggcccctctttccccatgcttactcatgctcagcatcttcacaatactgtgatccatgttctcaagaaggcaagatccagtgcacaaacactttatcaagctgtttcaaacataccacaagggaaagggataccaggagtcatgactgattagaagccattcctgtaacaatctgccacattcatgcatggaaaatttgtgtttcagtacaaaaaaaaaaactagcttagtttctgaggagagagctgaaagtctggtgtggaaaggagacttccttcccattcaataaaatttgcttttactcgttaatactttttgtttaatttaatctatttatttttatttataatgtgatttaataatttccttttatataatttggtttttttttgccatgaggtgttatttttcttttttttcttttgaggcagagtctcactctatctcccaggctggagtgcagtggcacgatgtcggctcactgcaacctctgcctcccaggttcaagcgattctccttccttagcctcccaactagctgggactacaggcatgtgccaccatgcctggccaatttttgtatttttagtagagacaaggtttcatcatgttggccaggctggtctcgaactcctgacctcaggtgatctgcccacctcggcatcccaaagtgctgggattacaggcatgagctaccgcacctggtgagctgttatttttcaaacaaaacaaaaatacttcacaaaaccaatgaatgagtgaacctggcatcagtttagggtctctgatagcagaaacagtagatgattatgaattggtaataacatttgagtagagatactctgattacaaggagcatctaacctatgatactgattctatcatacatcagaaaggtgggtttccagagttcggaggaggctcagaattgtttcagttgtctacctcatggttattaataatttataggagatttgagggaaattttcaattttgtttatttaattttattttaatttgacaatactttggtatcttttggttgtgctggttcattgttctgttgaacaatgctaactctaaaaagaacgttttagacaacataaatcaatggaggaagagaatacatttgccaaaattaacatgaacactttcttaagaaaatagcacttgagaatattgcaattaaagactaagagagtactccgagtctcccaaagtacctacattcttagccaagatacagcagcagctgacctttaaattcatatattccaatttaaataggaagttaaagttgaatattacaattggtttttcagggtaaatgttgcccttttttcctgaggatgagtccaccttgtcttaaagaaaggacaactggcaattctttctctgacactgaccaattgaaaatatgagagaaccaaacaaaagctttccatataatatcaacctaactattcagtgttttgctatagacagactctttgattggccctagttaatctgttcttgttttaattcatctcaaggttcagcattagtcattttatcccaacagatataaccttagattctttctatggataatatatttagactcatcttaatgtaaatttttcatggaggttcatgggtagaacctctaggtgactaaaaaaaaactagctttatgtctagataaaacgctacaactttgttccttataaaataatcagacctgtatagtcagtgaaatatcacaagatccaaattctagtgacttaactttagattgatctaacacctaaggtaggagagtggagttgggggtaagcaaaggagaggagatcatgtaatacattctcagtatttggagaacaatgcggtggaaacaagaaagaatacaaaagaaaattcaaaagatctagtattttgtcttttgaaaaataagatccaggctaggtgcggtggttcatgcctataatcctagcactttgggaggccaaggcagacggatcacctgaggccaggagttcgagactagcctggccatcatagtgaaaccctgtctctacaaaaaatgcaaaaattagccaggtgtggtgtcaggcacctgtaatcccagctactcaggaggctgaggcaggagaatcgcttgaacccgggaggtggaggttgcagtgagccgagatcgtgccactacattccagcctgggcgatagagcaagactctatctcaaaaaagaaaaaagaaaaagaaaaagaaaaaagaaaaagaaaaggaaaagaaaaaagaggtccatgagtagagtactgcatttgtcaggaaaactactacattagacaaaacttgcctttaatgcctggagatacttgctgctgtcaaaaggtgcacaacttaattttgcctctttggctgatgttccccactattctagatgaactgcgcccaaaaacagatccaaagatatccttccccacagagagttggtgatggatcttaggaactaagtgctatgagcatgttgcaaaaggagatcacagacccagttcaggctccctccagcagccccttctcccatgacctctatgtcagttacatccatgtgctgacagtgggcacacccacagccactactggctaccttcctcctggctgtctctgtgtgttcatgacttttgctggcacatctgtagccccaggtccctttctccagcttgccactcctacatatttttcccttatgattctatgctgtttgccatttttgtttgaaagcagtgcattggttaacaataactttgtagtgatagcaaccaccatagcaataatgtcctgcttccttgtatgcctggcatgtttatcatttaatcatcacaacaccatgaagtaaatactcttattgacccaattctatagatcagaaaacaggcctagaatgtgtaagtccctaatgaaggctacttggctaataaatgacaaagccaaattttgaatccaggcagtatggtttcagagtctttgctttactacctcttttactcactatttttgtactaatcttacactttactacatattttctgaaggcagtcaaaatttaaaagttgattattactgccagtatttatcagtcgcataatgtatttatttttattttctgagacagggtgtcactccatcacctaggctagagtgtagtggtgtgatcacagctcactgcagcttcaacctcctaggttcaagagatcctctcatcacagctactggagtagctgggactacaggcgcatgccaccacaaccagctaatttgtgtgtgtgtgtgtgtgtgtgtgtgtgtgtgtatgtgtgtatgtgtgtgtgtgtatatatatatgtgtgtgtgtgtagagatatatatatatatatatagtagagacagggttctgtcatgttgcccaaactcctgggctcaagtgatccacctgcatcagcctcccaaagtgctaggattacaggcatgagccatcacacccagcccagtaacagaatttaagactactctagtgcagtatgatcatttacatggcatccactcattctttcacttaatctttaccacttattatgtacccactaggtcctagtactgcagtaggcactccattcagttatgatcataacagaaaatattcctatcctcctgaagctttcaggataatggaagggacagataacacaaaaataatataaaatcgcaagttgtgataaatgttacaaaaggaaacagaaagttgttttaagacagaaaatagtaggaagctaacttagattgaggaatgatgatcaaggagaacttttctgaggaagtgacattgtaagttgaggccctaacagaccaataggagctaaccagctaaagaggaataattaagtatgcttttagaggagcttgtatttctggaaaaatagtagactagatgtcaatataagttctgcctaaaataattaaaaatttttaatgtgtggcttagtaggaaaataaggagcatttttagaagccaggaattatgagaaagtctgaatcctgatatagaagtaaattctaggccaggcacggtggctcacacctgtaatccctgcactttgggaggccaaggcgggaagatcacctgaggttgggagttcaagaccagcctgaccaacatggggaaaccctctctctactaaaaatacaaaattagcagggtgtggtggcacacgcatgtaatcccagctacttgggaggctgaggcaggagaatcgcttgaacctgggaggcggaggttgcagtgagccaagatggcaccattgcactccagcctgggcaacaagagtgaaactccgtctgaaaaaaaaaaaaaaaagtaaattctaaacctgtgttttttttctctgggcatttgccaatccctcgtggccaaaaccatgggctttaatagatcttgtgcaggagacaaaaggcaaagccaggactctcaaagacttctctctcagtaagtgaactaggagaaaaagcccatccccgccccccccgccgccccccattaacctgttcttcccacagacatgctgttgggataattgcctgtcttaaccttagtgcttgaatgggtgggagtcatatatatcaattatatttttatatgcaaatacatttcatcataaaaagaaaagcataaaactctctagacaagcaatactatattgcaaggccctcagtaagaaaggtatttagcctttttcaaaaaagtaaaaggctggtacacatagaacaaaataagtgctggaaaatgaggttggagatgaagccagggaccagattcatgcaggtccttgaaggccttggttaagagtttgaattgtatcctgcaaatcttttgaagggttcctctctaaagatggaaggagagaggaaactgtagcagtattccaggtgagagggagatatgacttggattagaggaaactggaagaaatgaatggattaaagatacattttgaaggtaaaatgtgtctaacctgctgataaattagatgaaagacttgagagtgagtaaaatataaagggttattcctaagcacctgacttgaaaaactgcttgtccaaaagtctttttttctgagctgaggaagtcaggaggaaatttggaggggggaatgatcaagagttcagttttagaaatattaagtttgataaataaagaatgctaatggagatggtaccactgatataataaaactaaagaggtttttaaaatattcttagttagttgaactcgtaatcgaacaagtcaggatgtaatgataatgaaaatttaccttttataggcaattcaatttatagtaaatttcactgagaggcaaattttttaaagtagaatttcaatgcaataaatacaccattcatttaaattcacattcctgggacagaagagctggatgaatttgcagataaagtaaaatattcggagagagacgctgtggcagagattggctaactgttcaccaaatctattttcttttctttctgctgacacagctggactatatttcccagcctcctctggcttctaaaattattttcttttctgttttataagatgataataaaactctgttctcatagggattgtgatgagcaaactaaaatcagttctgaattgtcaaacgtgaaataaaaattcatttttattagtataggcatgtgactgagactgggccaaggaatgggaataaaagtgatgtatatttcttcctttggtctggttatgtaaaaaaaaaattccttatgcagctttcatgctgtctatcccttgtgtcaactggatattggcacccaaagtgacctcggaagccacacattgagggtgaaagaaccaccttcagttgaaattcctaaaatgactgcatggttcagaatccccatgcctacttttctgccatctgaactttgcataaacaaaaaaataaactattattttaaatcattgagattctgtaattcaactgcttcagcagctagcatatattaaaagatgttaatttgatttcaaggtggtatcaagaacataattttattcccattcatttcttttctcttttttttcaacatgtattttctgtcatacatgaccaggcaaattgagtagattaggatgttaggaggtttgtacagggagtgagggaagctaagatgtttgaggtatgagagaggagttgaaggatatactttctttctatgctccatatcagataatctgtttttctctctccctctgtctgacccagtaattcatttcaaagatgtattcttctgtagctatttctttccacctgctaatagcaccctcattgtaaaacagagacttgatgacaatcttgatctctctcttcttgcccagtttaataatcaagtttttacactgggatacaaaataatcataaatcaaagttgagaaatatgttttcttcctttgtacatctgatagtagatttcatagtatctcttgaggtaaacgcttttgagagtatgcaaagtgtgacatatctctgataggacttgctgaagccagaatgtgccctctgtatctttggccaatggattagccagctagacatactctgacattgttctctgttatatttacttatcagtctttttgcattgttggcttcatcgctccttctcttgagggaaggtatgaggtaaattcagttccctatgctgaacacccagcatgattcctggcaaaatgatattataagtgctttgtaactccttggatgaaaaccaaatgaatgctgaaagtagtgtggtatgtatctgactaataaaaatatgttccaggcggggcgcagtggctcatgcctgtaatcccagcactttgggaggccaaggtgggcaaatcacctgaggtcaggagttcaagaccagcctggccaacatgatgaaaccccatctctactgaaaatacaaaaattagctgggcgtggtggcgcatgcctgtaattccagttacttggggggctgaggtgggagaatcacttgaacccgggagggagaggttgcactgagccgagatcgtgccattgcactcctgcctgggcaacaagagcaaaactcggtctcaaaaaaaaaaaaaaatgttccttgtagaatgaattttctgtattattcactataaagaatttatttttaaccacatcaataatatgtctataagatataggtcattacctggaaattgaaaatatttttatgagaaacttctcattatgatgtttattgtgtaaggatcttaagttgttatcacctttgtttgatgaatgtatcttctacttgtgtactctaaaaaattatcagattatttttatgattggtagagtttatagttttgcaagaattgggcaaatctcacacacagggacaggtggaagagcatgcccccatgagagctttaaaggaatacattctggccctgtggagaattgcctcctcttcaattccagtggcatatggttagatttgggcaaacaaatgctatgccaaatatggcatttattgcctcagttcagatgccaggccaggctgaagtttacagctgtgtcctggttgaaattctaaaacaaaaggagtttattcttttaatctagtgtacccctaatctagaatgatggcattgttagcatctagaattattttctttcccattttatatgatgataataaaagctattctcataggaattgttatgagcagacctaaattcagtgctgatttgtcaaaagtgaaataaaaaaatcttttgtctgtgtggtcttaggtggcagaaatgtaattataagtaagccctaatttctgctaggtatactagtgcttgaccctagtgaatggatagtctctttatagaagtagatatattaatccctttaaccccttgaaaactagtagtagtagctatttgatatacctctttccaaaaagtttctagctggccaggctaagttctcatgcctttggtggtatagcatatggacatttatcttggcagtgattacgtgtaagtataaaagaaatacttaaaatgcaataaaatgagcatatctgtttcacaagactaatgtttcttgctaatcatagagaacctaggataaaatgcataatgttgatcattggaactgaggaaagcttaacaattatactatattggataggtgaaatctaggagtttctgtatacccagagtcctttcctaaggggtcctacctgtagcctcttgctaaggataccaactctagctagatacatatagatggccatgttctatattgcatgactttaccatcttgaccacatctcagaacatttgacctaaagcattcaggtagcttgaaggctgacagatttaacgacctagtacaagtgttttatctaactgatgatagtgacatagtggactgatcagatgttctttcttaggaaatttttaatttgaaatagagagtattatttgataggagcaaacaccaactgcttaaccagaaaaagaggcagacaaaaatgacatgggccgggcgctgtggctcacgcttgtaatcccagcactttgggaggccgaggcgggcggatcacgaggtcaggggatcgagaccacagtgaaaccccgtctctactaaaaatacaaaaaattagccgggcttgctggcgggcgcctgtagtcccagctactcggagaggctgaggcgggagaatggcgtgaacccgggaggcggagcttgtagtgagccgagatcgcaccactgcactccagcctgggcgacaaagcgagactccgtctcaaaaaaaaaaaaaaaaaaaaaaaaaaaaaaaaaaaaatgacatgagtcagtagaagccatgaataagcaagagtgacaagtaagtatgagctaagtcatgaacttttttacgtgtgtgtgtgtgtgtgtgtgtgtgtgttggtaggggtgggggtagatacatatatttaaattgtatctgtgggggaagaggatggtcaacaaattgctgccaaggggataaagaactaattacatcattacttatctattggattctgaacaacttgaaattctccatctgtgttcctatacttttcatgagacctggttaaactactttccatgagttcccataaggcctagccacaaaacatacctttgttccttattttcatgtgaaaccttacaatagctgttcccagttacccctctcacatgcacatccacacacagatacttgagacaactttactgagtctctattctttgtggtcaaaggatcctaatttatacagctgttctatgagttcagtgtttattattttagctctgtaaccaaggcaaggactgatgaacaatagcagttttgtggccacccaagaatatattgaccttgaataggaaaaagtaacgtatataatcctaattgtttaagagaggtgatgcattacagggagggctcagagaaagatggctaacactaatagcacatgttggcattgaggagactacgtggaaatgtgcatttagcaaaatagcttcagaacaatattttttctttctcccctattagattttgagttcctgaagcactcatcttggtgtgcctcaccaattcccaggagagggctctgtatataataggtgaaacactattgagtacataatgtggcccagctatggttctgtcttaaggtttagcagcagctttgaactgcctggtaaaaatattttttcaggcagactaaactgaactgaagagagagatacaagttagagacaagagtcggatttccagaaatttctgggagagatagatatagacagtgtagaacagccaagaaactatgggaggaatttcaaggaaccagataatatatgcataatgttggtcatcagaactaaggaaagctgaactattatactatattagataggccattcacatttaggggactaaggaccagaacatactgttatctagaacatcagaacatctgcagagcacagaacagcatagcatttggccagaaagcatgacatagagtatgggatagaggaggagaattggcaaaaaataaattctagattctgatttttaaaatgacagaacaaagattacagcattattttccttctcccttacaaattatccaactgcactgggagagcaacatggtagaaacatgaaccctatcttcaaagaaagatatatgcacaactccagactacaaaatgtgatgaagaatgataaatgcagttaaaaatgcccacagctgcagatctcacacaaagctggcagaactttctagggggcaaaaccaataatgcccagtttatgggataggatttgtgtactagcagcaggagctttcttggccttcctagggtataaagaagaaagcgggggtgctgggcacggtgactcacgcctgtaatcccagcactttgggaggctgaggcgtgcggatcacctgaggtcaggagctcaaaaccctgtctctactaaaaatacaaaaaaaaaaaaacaaaaaaaaagaaaaaaatttagctgggcgtggtggcaggcacctgtaatcccagctacttgggagactgaggcaggagaattgcttgaacctgggaggtggaggttgcagtgagctgagattgagccattgcattccagcctgggtgacagagtgagaatctgtctcaaaaaaaaaaataaaaaaaaaaaaagaagaagaagggtaatagactcaatgaggaatcacacagacaagatggaaaacatgggaaacacaaagaaaaaagtagagattatatctttactgtcagacaagattgaatttagtggaaaagttttaaataaggcaatgaggaataattcaaagcaacagtatagcattaaacatccataaagcagaaactacagaaaatataaagaataatagttacatagtagtgataagaatgtttattcacttctcttagttcataagagatcaagtggacaacaactaagagaaagaaaacccaaataaaataatgaagtcaatatttgagattgtcaagctttgtatcctgaaaactaagaatgtcaaataaaacattcacaaaaatagaccataaagaaaatttcaaagaatttcaaaaggcaaagtaaatatatacagcattctgtgatctcattgcaataaaagtagaacttaggaaaaagaatatcatcacctggacattttaaatttcctactaaaataattcttagatcagaagaaaccaaacaagttatagaaaatctaaaacaaaagcataatgaaaacaatacatatcagaacttgtgagatggagctaaaatagagttcagaggcacttatcttaatgaagaaagaaaataactccattaaatatctaactcaaagttagaaaaattatcaataaacataaaaaagcagaagaagggaataaaagttataaattagacaaaaattgatcagctaaataaaagagctgattttttaaaaatatgatattaagtttataaaatcaaaaagtagacaggaaagggcataaaccaagaaataatggggaaatgataaaaatagaaaagaagagaatcctaagaaaatattttgttcaatcctgtgcaaattaatttgagaacctagaagaaatggatgattttctaggaaaattgaaaaaataaatactaactttagataactagaaaatctaaactattagcacagaataactttcttttttttttttgatataggaagtcctttattttgtcatgtgaaaccatataacagctgcctaaccacaatgtagatgccaataggagatggctcagaaatagcactagtgactcaaatagtgaccattatgataaaaggaataaagttttgactgatttatagcagttttaaaatgcgttttatattgagtagttatttcatgttttctcaaaagaattattatgttaaaccaaaaataaactaggtatatagtttgttcatataacaaatctacattcaaagacatgcttacaaattttccacttagtccatttttctgttcttagcattactacaaatgcctccttccgtcatcatgttgaattcttcagcatcttctatatcatttccaggggcatctctgggaagtagtgatgcctgtcttccttcagaagcactgataaccccaatatacccacagtacacacattttccctctcctgaggtgtgctactttttggcacaacagaaaaaactcattactaggatttgaaaacctaaattctgggcctggttaggtcataaactacagaaccatagatcatatattctccccaggagcctgtttctccactgcataaataattcatatttgcttggccctttgtagtcctttactgtttcatttatcttcatgataacccttaaatttaagtaaggtagcagtatgctcattttatagaagaaattcagtctcaaagaggatacacagtctcccaaagatcccacaatagtaatatattaggcagagctaaactcacacaatcttactcaagatcctagtgctggtacatggtatgctcataagtttgctaaaatggatgaagcagcagtttctcaggtccctttcagtgatcctgttctctgcttccacttgatgttttttctctcgtctctcaactagcattaacatccaaaactatatataatcactaaatttcatttaccatcattttcttatttaattattctttaaatttttctatttccatgttaaatccagagaaatgttactttttcgaaagtttctactgctgcctgcctctctgaaggccatgggacttacctatttgtttgtcaaagcaaaaattcccaacattttgtaaacaccactaattactttttataactgtaaaaacaattattccatacttaaaaccaattcaaaataaaataaatcctcgatacttcttactccctggagtagtaattttaattagattctactgattcgtaattttttcctctgtgcctttatttgggaaatactgttagtctacctcactatcaagtctctttccctaacaagaaaatgtcacagtcttttttttttttttttttatactttaagttttagggtacatgtgcacattgtgcaggttagttacatatgtatacatgtgccatgctggtgtgctgcacccactaactcgtcatctagcattaggtatatctcccaatgctatccctcccctctccccccaccccacaacagtccccagagtgtgatattccccttcctgtgtccatgtgatctcattgttcaattcccacctatgagggagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactggtttacagtcccaccaacagtgtaaaagtgttcctatttctccacatcctctccagcacctgttgtttcctgactttttaatgatcgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttttttcttgtaaatttgttcgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacacctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgaagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagatcactcatgatttggctctctgtttgtctgttattggtgtataagaatgcttgtgatttttgtacattgattttgtatcctgagactttgctgaagttgcttatcagcttaaggagattttgggctgagatgatggagttttctagataaacaatcatgtcgtctgcaaacagggacaatttgacttcctcttttcctaattgaataccttttatttccttctcctgcctgattgccctggccagaacttccaacactatgttgaataggagcggtgagagagggcatccctgtcttgtgccagttttcaaagggagtgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactactgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggatcggtggtgatatcccctttattattttttattgtgtctatttgattcttctctcttttcttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcccgctttctcttgtgggcatttagtgctataaatttccctctacacactgctttgaatgcctcccagagattctggtatgttgtgtctttgttctcgttggtttcaaagaacatctttatttctgccttcatttcgttacgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctgttaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagttcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgttgggtcttgactctttatccaacttgccagtctgtgtcttttaattggagaattgagtccatttacatttaaagttaatattgttatgtgtgaatttgatcctgtcattatgatgttagctggtgattttgctcgttagttgatgcagtttcttctcagcatagatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttttgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggattatctttgtggcgttctctgtatttcctgagtctgaacgttggcctgccttgctagattggggaagttctcctgggtaatatcctgcagagtgttttccaacttggttccattctccacatcactttgaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagacttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgcagtgtgaggtgtcagtttgcccctgctggggggtgcctcccagttaggctgctcgggggtcaggggtcagggacccacttgaggaggcagtctgcccgttctcagatctccagctgcttgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcttcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcaccgctttctttgactcagaaagggaactccctgaccccttgcgcttcccaggtgaggcaatgcctcgccctgcttcggctcgcgcacggtgcgtgcacccactggcctgcgcccactgtctggcactccctagtgagatgaacccggtacctcagatggaaatgcagaaatcacccgtcttctgcgtggctcacgctgggagctgtagaccggagctgttcctattcggccatcttgaaaatgtcacagtcttaagagtcaggaaagcttttactttcactatcacatatgaagaatgaactaaacacctaaactggacagtaaaacttaaatgagggattcaggatatttcccaaggggccatatgacgaatttaaaagttggtatgatgtgcctaaaataacacgctcttttacttataataaaggtacagatgtagtgattagtcatgctgacatgtacatataaaatatgcctatgccaaattaaaagaaaacaaaatacattctatggcaatcctgaaaagtcagggaggtcaataaatattaagagtatgctctcacaattagcattaaacacatggtaattaacacaatttaatatgtgaaaaatgagaaaatatacaggatgagaagtacacttaggaatttgttgtgattttcttcattttgattgtattgctttcttgtcttcaggagatttcgacttctgaattcgcatctttctgttctaaatggtattcttgggctattttctcagcagttcatgtttctggataaagtttatgattattgagaagtgtcaatgcttctacaatggaaattttgcctttgggaatgatcttaatatttatcatattaaagtgatggccaaaaggcaatctgaattctttcagctcttgacatctttcagcagcttttacctgcatggaagacacaggatctttggaatcaacatacacatcttttagaaatgacagcagcttgtcatctttatgagcaatctctcccttaatttctggatagaaactaatctgctcttgcaggaggctgttggtagaggggtgtctgggattgggagggggcttcatcttgttgatttcccattcctctcagttctctaggttgaaattcctgatcctgcgagtcactgcagcccccatctcctcataacatgatgccctcaggtttacgccacacgtgggaacaccagtgcaggaaacctccggggtaccctagaataactttcttctactgaggccttggtgatttaacaggagaattctaccaaacctttcaggaataaatcaactcagtcttcccaaatacatatgctttaataaatgtggatatctctggaaggacacatgagaaactagtaaacagttattattcccagggaacagaactgggactgagggacattattagaaagaagtcttgctttttcctgtatatcttttataccttttgtgttttgtaccatttgcatatggtactcatccaagtatgaggaatttagaacatctttgttttacatttgaacaagttgacaacactgtttggcttttgttattatgtttaccttacgttttcagtaaatgtagtaggcataatttcttaaatacctcccttccccaaagatgtcccaccgtaattcctggaatcatgatgaatatgatgctctattactgattctgtgattatgttttgccatatggcacagttgacattaaaataggaaattcaagcctacattatctgagtgggcctaatcgaatcatatgagccttgaaagcagagagctttctttggctaatggcaggaaggaaagtcaaagagattggaagtatgagaaggactcagtgtgcaatagctgctttgaaagtggaggagaccacttgagaaagaaggcaagtagttttgaggagctgagggcagctcccagctgacagctagcaagggaactggccaaatccttgcaacctcaaggaactactagctctgtcaaaaacctgaaagaggttgagagtggattcttccccagtctccagatgagagtccagcccaacaggcatcttgatttcagctttgtgataccctgagcagagcccacttgggactcctgacctatggggatgtgagataataaatggatattgttttcagctgctaaatatgttatataggagtagaaactaatagagcaaaattatgttctaaaactttaatacatgtgggctttcagaggctttagagatgggagccatattccctccagtctgggtgtgatgggtagtgccaaagaagctgcagagccggtggaacagtgtcatgtgtcagccagaggctgcatcgtttccattggtgccataagtagaatatgctctgctgtcttttcattactttctccaattgtgcagagaatgaattttttatatctgtctcagtctttagaagcaattttttagcatttctgttttaaataatcttgtattttcaatgaagaagttgccatttctttctttttttttgagacagggccttgctctgtcgcccatgctggagtacaatcaccacttactgcaaccttgaccttccaggctcaagcaatcttcccatctcagtctcctgagtagcttggctacagacacgcaccaccatgcacagctttttttttttttaattttttttgatagagacagagtctctctgtggttgcccaggctggtctcgaactcctgggctctagcagtcctcccacctcagcttcccaaagtgttgggattacaatgtgtgccacaacacctggccttttctttggatgtcttaggaaattaactcctacctttctaaaaattcctgggtttatgtgacctggatttaaatggtcatgagagaaatttctgatatgatagtgcaatcaagtaacactggaattctttgactaccttagtttttctagagtttcacttaaattaacccaattttgttccattggcagttttatccaagactgaataaaggtagtttaccttttaagttgctatacactagaacttacctttcaattaattcttttaatttaacagtgtggaaagctattatttactttttatttaattgatagtacttttgtaaacttttacctgaaaaaagtaactttgagaaccacagagaagaaacatattggttaaggtttctgaagagtgtcggaggattcaagagtgtggggaattgcttctgtgattcccatcacttcacattctgagtagaaaagcacacaacagaaatgctgcaagtcagcatcaggagtccatagcatccatcatcaagtgcaataagactgtgactctctgttactgagttgtgatgctttttctttttgccagtaagttacatggtccagttttttctttcttagatgacttcagggacttgttgtaagcctgctgaggtcaaggaatgcttctgccttatgtgcagtgtattataaaaagatttatctgtgataaaagtggaactcggctgggcatggtggctcacacctgtaatcccagcaatttgggaggctgaggcgggctgatcacttgaggccaggagttcgagaccagcctggccaacatagtgaaaccccatcgctactaaaaatacaaaaaaattagctgggcgtgttggcatgggcctgtaatcccagctactcaggaggctgaggcaagagaatcacttgaacccaggagacagaggctgcagtgagctgagatcatgccactgcactccagcctgggtgacagagcaagatttggtctcaaaaaaaaaaataaaaacaaaaaaaagtagaacccatgaagaaaaatttaaacaactgattttaatgactgtaaaggagtatcactagtagaaaaatgtttctatattgttaggataatcaagtttctttaaagataatattgatcatttttagcagaagtttgttatttatctttaggaaatgaaattaaatattttgctttgttttgtttttaatgtttctaaaaggaatgaaactgcattattgctgattctgttgtggattgaggcatttagagtagcaaaaattatattaatgctctgtgccaaaacacataaaatggctttatcactgattggtgtctcaattataaaaaggtaataatttgcataatatgataagaatgccacttgaaagaaaggaggctgggttgttttttttttttttaacatccagtaaaacatgattgacatcatctagtcaaattatatattatactgagctttattttctgtataaaccatattttacagatattattttaaaagaaattgaaatcttctgggcttaggtttcagagttatatataactcataagtgagctgtgtgagctgagttccttaaacctaggtctcatttcaaaggctagctttgggctggttgcagtggctcacgcctgtaatcccagcactttgggaggctgaggcaggtggatcacaaggtcaggagatcaagactatcctggctaacacggtgaaaccctgtctctactaaaaatacaaaaaattagccaggcatggtggcgcacacctgtagtcccagctactcgggaggctgagacaggagaattgcttgaacctgggaggtggaggttgcggtgagccgagatggcgccactgcactccagcctgggcgacagagcgagactccactccatctcaaaaaaacaaaaaaaacaaaaaggctagctttgttccaaagcccaaacctggctctggtagactattttctaagctatctcttgatgagctttgctaaaggaaagggaagtatggtacagatcacctcaaagtcatgtttggctctctctgcatttggagttttcctctggcatgtttatattctgaataatgcttctcctaggctaaatacagtttggaccctgcatcttacaacagatgtgacagaggaatgcttatggtcaataatgatgtacagtccacagtgataaagaaattggtgggaatgagactttgagaagtataatgaatgtcagattgcaggctgcccatagtacatccagcatcagcacactgtagtttgccttaactaatttgggcctctgcagctttgggacagtattgcaaataggtggtataataagcttaaataacagatttccatcacttaaatatgaaaatctcagatttgtcacagtaataatattgacctcatgtttttgtttttattttttgttcattgacttcatgaatgaatagtttggcaggaaagcaggtaatacacttccaggccttatattacataggtgttgaggctagagaatgtcacagaggcgtgcccttattcataaaacactaggggaaatgccttactgtgttttattaagcgaagacctttcattgtaaaggtgagattattcctttagaaaccatataaattactgaagggaattatgagcaagaatatattttgggttcatagatgccaaatgcccatctcactggatgattattattctaagtattttccattacctagtttcagctcaggaaatcaattagacccttaagggcctaagcaagcaggaaatgagtgatagatttatagattccaccagtgaatttgaaaaaaaaacttttaccttttaaattataactgcaatagactcaatataaatgctttttttttttttttttttttttttttttttttttttttttttttgagacgttgtctcactctgtcacccaggctggagcgcagtgatcttggctcactgtaacctctgcccccaggattcaagtgattctcttgcctcagcctcctgagtagctgggattacaggcacgtaccaccgcatctggctagtttttgtatttttagtagagacagggtttcgccatgttggccaggctggtctcgaactcctgacctcaagtgatccacccgcctcggcttcccaaagtgctgggattacaggagtgagccaccacacccagcccataaatgccttttttagtgctccctctttctttcctatgtaaacccttttcaagttagattttccctatgatattctcaataaagaacaaattacataaaatcaggaacctgattttatattaagtgtaggaagtcaaattaccattgagcgtaggtcatatattctagtagtagagaccaatctattttctgccttgttctggagggtcatagcaaatctgaaccaggcagccaggtagaccaccactctgatggccccattcaagcttagagcttccccagtctgaaagacactggaggaagcttcttcccaccttatttagctccaagagttcagttgtgctctgtggaacactaggaataactgtatcctagacataaaccaagggcaagacatggttttagtttccatgagggcctttgcttaagagtcagaagggctgctacacatcttaattttgccactgaatagctatgtgataccaggcctttgacataagcagttaagttagaggactccagagggcctgtccagctcttacataagtctaaattccacctgtgatttcataggatccttaagtaagcattccacttctatgggcctcattttctgcccctattaaacaaagacatggctcttgagagcctgtttaaagcaggtttttgaaaagaaagtctcaagtcaaagaaattttgaaatggatttagattaaaaggtatttttgtgtgtgtggagaatgtgggattaactcacttatttttattatgtatagaaatttcagtttgttactatagactatttacagaaatatgagttcttgagtttttcattctgctaccccagatgtgtagcactctgctttgtacatagaaagcacttagcaacttgtgtgttctcttgaatttaactgaagtcccacttgaaaaggtaaagttatataaactactttttagtatttgaagtttctttaagcctatttttaatgatggcttggtgttcatgcaatgacttatttttgtttgtactggcagagcgtagctttttcagttggccagttaaaatggaaagacaagctggacgcagtggctcacgcctgtaatcccagcactttgggaggccaaggcgagtggatcacaaggtcaggagttcaagaccagcctggccaagatggtgaaaccccatctctactaaaactacaaaaaattagccgggtgtggtggcgggcacctgtagtcccagctactcgggaggctgaggcagagaattgcttgaacacaggaggcggaagttgcagtgaaccaagatcgtgccactgcactccagcctgggtgacagaacaagactccctctcaataaaaaaaaaaaaaaaagaaaagaaaagaaagtaagacaacttgtgctcttatttttaaaatattatatacttctagccccatacaaatattctcagattagactaaccaattacacattggaatacctggacagttttaaaatacaactaaaactgaacagaagcatccaaaggtcaaccactgttttactggacataccttttactttgctattttatgtattttatattaaagttagacctttgaggccaggtgcagtggctcacacctgtaatcccagcactttgggaggctgaggtgggcagatcacctgaggacaggagtttgaaaccagactggccaacatggagaaaacccatctgtactaaaaatactaaaattagccgggcgtgctggtgcgcacctgtaatcccagctactcaggaggctgaagcaggagaatcacttgaacctgggaggcggaggttgcagtgagtcaagatcaccccactgcattccagcctgggagacagagcaagactccgtctccaaaaaaaaaaaaagttagacctttgggtttaaaagccccaggataaacacatgaaaaaaactttcaaaatttacaagtgtaaaatatgctcagtacatccttcttcccacccaaccaaacaacaacatctcaagttaaatcaagtggtataaaatgtcaacctagaattctaccactgccccagggaagttctgtctgcccactgtcgtctgcttttacaggtctacactagaaacaacttcccttgataggaagtactgactttgttcagagctgtaaaattatacccagaacctcccttgttcttgttctatatgagtcccagggcctgagagccgccatttatgacgctttggtttgtcacaccctgcacacaccattagagacatttttctctcttggctttgtatctgcttccttctgttgctaccctctccatttcctattttcctaatttttaaaaatgaaatttatttttgctttttcatttgtctaagacttaggctttcatttccccagctgtaaatcaggcattagataataatctctaaagccaattccaatactctgtgaagtcattgtatcttatatttatgagtaaatatagttatcatctttttgataataaattcatcaataaaccatggattggaatacataagaatctgaaaaccctttataaccctcctatctctgaaattcacagatactgctatatagaactgattgatgaatttcaataatatctacaccaacatataattaataatgatatgtattaataatattgataacaatgagacacccacaggtgacttgtcagtaactgatttgtgatttcctaattttaagagtgtgtgtattcttgttgtaatctatgagagcaagaaccttctcaaaataaaagaaagtttttcacagatactaattcagtgactcatttactgacaattttcagtagggtcagaaacaatatcagattggtctgaaattataaaaaatatttttaagagtctaatagttaaaagttaatttggggtgaaaaacaactcctctctataattgtattttattttattgttttattgtttaattattttattgtgtatttttaggcagggtctcactttgtaacccaggctgggatgcagtggcactcattgcagtcttgacctcccaggctcagatgatcctcctacctcagcttcccaagtagttgggattacaggcatgtgccaccatgcctggctaatttttttaaaacttttttgtagagatggggtctcactacgttacttatactggtcttgaactcctgggctcaagtgatcctcctgcccttggcttctcaaagtattggaattacaggcataagccacacactagaccagtaattttaatatactgtatatccatggtcctcaacagggagtgattttgccttgaggggacatttagcaatgtctggaagatattttggttgccataaccttgggttgtgagatgctactggtatctggtgtgcagaggccaatgattgtgcaaagcatctttaaatgcacaggatagctccccacaacaaagagtcagccattccaaaacactaatagtgccaagattgaaaaactcttccgtatgtgactgtgtgactcaactgagttctatgatttggagagtcttttcatatttaattctagaggttgtgaaaataaaatgaaggtcattataatgtcatagttcagccatgtgtaccattaccaactgcttgctgactcttggccttttatccttacctagactattagaccttcacaatggattcttaagtctggcctgagacacttattattactacaggaaaacaaaaaagaaagcaaaagatcctactatctggtaataaatgtctcatctgagcaggtttaaagatcaaataatctttgaaaaataacaattctggctattattaaaaagtcaaaaaataacagatgctggtgaggttgttgagaaaaaggaatattttacactgttgatgggagtgtaaattagttcaaccattgtggaaaagatagtgtggcgattcctcaaagacctaatgacagaaataccatttgacccagcaatccctttagtggttatataacaaaaggaatataaatcattctgttataaagacacatgcatgcgtatattcattgcaacactattcacaatagcaaagacatggaatcaacttaaatgcccatcagtgatagactgtttaaagaaaatgtgaggccgagcgtggtggctcacgcctttaatcccagcactttgggaggccaagacgggtggatcatgaggtcaggagatcgagaccatcttgcctaacatggtgaaacgccatctctactaaaaatacaaaaaaaattagccaggcgtggtggcgggtgcctgtagtcccagctactcgggaggctgaggcaggagaatggcatgaacccaggaggcagaggttgcagtgagcggagattgtgctactgcactccagcctgggagacagagcgagactccatctcaaaaaaaaagaaaatgtggtacatatataccatggaatgctatacagccataaaaaagaatgagattgtgtcctttgcagggacatggatggagctggaggccattatccttaacaaactaacaccgaatactgtgtgttctcacttacaagtgggtgctaaatgatggtcacacagaggggagcaacacacaccggggactaccagagggcagagggtaggagggagaggatcaggaaaaataactaatggatactaagcttaatacctgggtgatgaaataatctgtacaaaaaaaccccatggcacacgtttgcctgtgtaacaaacctgcacatcctacacatgtacccctgaacttaaaagttaaaaaaaaattagaaataacaatttttatatagcagtatgctttaaaatgatgtcatggactgttaaacttcagtagacttgaccaatcatttagtccaatgctttttttttttttttttttttttccaaataaagtaagagcctcactatctaagctcacatggtatattggttgcaggattaatacaaggaggcatgattacatgatcacaatccagacacaagtcacctccttcatgacaaaattcatcacaaatgtaggttctttatgtggttcttatatggccctcactagcttttgcatcaaggtttgctcagtgtggactttacgaaaatcaggaaggagatgatttagtgagtaaggggattagaaattgtatcctggcaccatttacacaactcgcaacacaatattaaaaaatgactagggagacggaggtggaaggatattttatttatataaatcttagccatgcccagtggtacacacctactgtcccaggtacttgggaggctgaggcaagataagttgaggttgcagtgagctgtgatcatgccactacactccaatctggataacagagcaagaccctgtttaaaaaaaaattaaaaatcaagtgattttttaaaaatgaagaaaaggacaagtagagaggtagggtggggaattttcccttgaatcctcaaaataataaaactgtatattccactttttatctccttccttcacaacatttgaaattccacagtaattttcccttcggttatttgcctatttcctttttaatggtttccattgttatacccagtagattaaacaacattcttctttacttattgaattgatatagtaagatctgcaaaaaaaagttattccaaaatgcttatagtaaagaacaaagtttttagggatctaatagtttctttccttcccaaccttattgagatataaatgacaaataaaaattatttatatttaaggtgtataacatgatgcatacattgtgaaataattaccacagtcaagctaattaacacatccaataccccatatagttaatgtgtgtgtgtgtgtgtatgtgtgtggtgggaacacttatgatctagcaaatctacatctcccttaccaaacttcaatatacagtagagtatcatgaacttgtagtcaccatactgtatattagatcctcagaactttgtcatcttataactgaaatttgggccctttgagcaacatctctctatcttatcccccgacaaggagcaaccaccattctactctctgcttctgtgagtttgacatttttagattccatctgtaactgaagtcatataatatttgtctttctgtgtctggcttatttcacttagcataatgtcttccagcttcatccatgttgtcatgaagggcaagatttccttcttttttatgactgaataatattctattatgtatatctataaatgtaaatatatataccaccttttttgtatccattcatccatcaacagatgcttaggttatttctatatcttggtcattatgaataattctgcagcgaatgtaggagtgcaaatatctcttcgagatactatgctgatttcattacctttggttacatatccagaagttggattgctgcagtagttccattttttatatttgaagatcctctgtactattcttcatagtaactgggccaatttacatttccaccaaaagtgtataaaagttctcttttctccatatcctcactaacaattgttatctctttttttttaaataatggccatcctaacaggtatgaggtaatatttcatggttttgatttgtatttccctaatgattaatgatgttgagcaccttttcatatacttgctggctgtatttatgacttctttgggaaaatatctattcaggtcctttggccatttttaaattgggttatttggtgttttgctgttgagttatatgaattctttaaatattttggatattaatccctcatgagatatatagtttggaaatattttcttccattttctaggttgcatttccattttgttgactgtttcctttgctgtgcagagctttttagtttgatgtagtcctacgtgtttatttttgcttttattgcctgtgcttgtgtcaaaaaatcattgccaaaatgagtgtaaaggagtttttcccttaagttttcttctaggagttttgtgatttcaggtcttaaatttaagtctttaaatatttcacgttaatgtttgttatggtataagataagggtccagtttcattctcttgcatgtggagatccagtttttccagcaccgtttattggagggactatcctttccccattgtgtattctccttggtgcccttgtcaaagagagatctagtagtttctaagcagcatcatgaagctgtatctttactgatttcatgttacaacaaaatttttttaagcacaaacccaggggtgtgacataccctgaaactggtgatttgaaaaacagtactgttagagaaagggatctatggagatcattgttagtagtagtaattggggcattggatcaggataccccagttatcctgatccaataccttaattatataattaagtttttaagtgtagaagtgggtgtaatgatcactgttttgataaaattaaaatattaatgtgttaaagtacccatctcatttggtgctagtagaaaacgaaatgcataaaaactattgctaaaagtcactaaacctctcttacagcctaattagcaagttaatgctttttccttttggctgttccctaatttttcattcaatttatcttttcctgaaaacctgctaatttcatgcactttagccctacggaagaggacgttgcttagcaactgcctaaataactaatagacctaggtatctagtaaaggcttgaaggatttacttattttaaatttatatatttgtgtattaaccatcaaatccaagaggaagttgtttcactttggtatttcttcggatttctgcatttttatgattaattcttttcttttttttttaaatggagtcttgctgtgtcgcccaggttggagtgcagtagctcgatcttggctcactgcaacctctgccacctggattcaagtgattctcctgcctcagcctcccaggtagctgggactacaggcgcacctaccatgcctggcaaatttttgtatttttagtagagacggggtttcaccatcttggccaggctgatctcgaattcctgacctcaaatgttccacccacctcggcgtcccaaagtgctgggattacaggggtgagccactgtgcctggcctgcatttttataattaatttgtacatgagttgtttgtagcaaaaaaaaaaaaaaagaaaaacagtatatttaatgggaacttcttttttctcccttcaacctcttagtaacattgctgtatttgtcatttactttagttaatcttttctaacagaataccctatcaatgatatttgctgagttaagaaatgttttctgggccgggcgcagtggctcatgcctgtaatcccagcacttttggaggccgaggcgggtggatcacgaggtcaggagatcgagaccatcctggctaacatggtgaaaccccgtctctactaaaaagacaaaaaattagccgggcatggtggcggacgcctgtagtcccagctactcgggaggctgaggcaggagaatggtgtgaacccgggaggcggagcttgcagtgagccgagatcatgccactgcactccagtctgggtgacagagcgagactccgtcttaaaaaaaaaaaaaaaggaatgttttctggccaggcacagtggctcacacctgtaatcccagcactttaggaggccaaggcaggcagatcatgaggtcaagagttcgagaccagcctggccaacatggtgaaaccctgttgctactaagaatacaaaaattagccgggagtggtggtgtgtgcctataatcctagctactcgggaggctgaggcaggagaattgcttgaacccaggaggcagaggttgcagtgagccaagatcgtgccactgcactccagccttggcaacaaagcaagactctgtcacagaaaaaaaaagttttctaattcactggatacagaattctataatatttctttttaatggtaagctaattattttagaggaaatacattaaggttttaggagaaggaatttagaaattaaattgaagtcgttgctattacctatacatgatggttttacttttggttgtttgacccagaagtatctcagaagctcatctgagctaagggttttctaaggtttgagggtatgagtggtgctgtcattttgcaatgtcctgttatacttaatttagccttggtgtgtttacttgtctgaggttaagtctccccactatgacatataaagctgtattattatccaaatctcagacctattttcttcactcttatattagttcattctcacgctgctaataaagacataccagagactggttaatttataaaggaaagttgtttaattgactcacagttcagcatggctggggaggcctcaggaaacttacagttactgcagaaggggaagcaaacatgttcttcttcacatggtggcaggaaggagaagaatgcgagcaaaatggggaaaagccccttctaaaaccatcagatctcatgagaattcactcactatcacaagaacagcatgggggaaccacccccatgatctggtcacctcccatgaggtccctcccccaacatatgggaattacaatttggattacaattcaatatgagactttgtctggggacacagccaaaccatatcaactgtgtttctgttcaactgccctgaagtaaaaacaaaataccagcaaattttcttactgcaccctttgcattctgtggtgttgagacattaaagaccatttgcatcaggctagtgtggtggctcactcctgtaatctcagcactttgggaagcctggggagaggatcacccagagctcaagggtttgagaccagcccggacaacattgccaaaccctgtctctacaaaacctacaaaaattagctggatgtggtggcacacacctgtggtcccagctacttgggaggctgaggtgggaggatcaccgaagcccgggaagtttgaggctgccgtaagccaagagattgcgccactgcactccagcctgggtgacagagtgagaccctgtctcaaaaaaagtaaataaataaataaaagaagaccacgtgccacttgcacaaatatattagcagtaaaaagaacacatagttgggcatgatggcacatgcctgtaatcccagctacttgggaggctgaggcaggggattatttgaacccaggaggtggaggttgcagtgagccgagatggtgccactgcattccagcgtgggtgacagaacaagactccctctcaaaaaagaacacaggcaacttatattaatagtgttaagcgagtctacattaaagagaaactgtgctttcaaagagttacttttgtctcagaatgaagctcctttacaaaatggctgctttagaattctatcttgcagagaggctttgggcaaatttatagcatattttctttcacaggcaagaactcctaagatatcattttgtgtaatgattaattatcctctatagatatcagagatttttttttgttttaatggagtatcttcagtaagacattaccctatcataaaataaagtgtatttaaagcaatattgccaggcacagtaacttgtgcctgtggtcccacccactcgggagctgcggtgagaagattgcttagcccaggaattcaagtctggcctgggcaacatagcaagaacctgtaactttttaaaaaaggaaatattagattattagtagctatagtaactataaataatagaacatttcatctacaattgactaatatagagcttatttataaactgcaatctgtaagactgtatgtatcatgttcacatctcaactgtgctcatatctcatttgcattgtcaaccactgtacaaagagaacaatgtaggataactagagtgaagtttaaagattcatacttagtaagttatctgatacaaagacaatatctgccaaatagtttaggacaaaaatgatttttaagagatatgtatctttgagagagagtgaaggagaggaggggagagggagggagggggagagagagagagagagagagagagagagagagagagagagagagagagagagatgccagcctgccaatattcaaagagtttaaacttcaaccataacgtttattttttctccttctctcatctttccctctatatctatctatagaaatataaaaacatattttagatttaacataaaaaattaactgtcattcaaatgaatgaaattagaatgttctgggcattgccactgccaccactatgacagctgttttagaattatgaaaatctttttattattttattttagaccattaagcaatttactattgctcttaaagcatacataaagccaatttttaacatcatggaagccatcgctgacaagaatgttgcctcaattcacatgatattttctattatagcagtctgttaatgtgtattgcattcatcagtaacttgaggaggaattgataaattgccttcagtcttctttctcctcatatttgcgaatgccttatataataaatactactacaggccaggcatggtggctcacacctgtaatcccagcactttgggaagctgaggtgggtgaatggcttgagtttgtgagttcgagaccagcctgggcaacatggtgaaaccccttctctactaaaaatataaaaaatgagccaggcttggtagtgcatgcctgtagttccagctacttgggagactgagagaggaggattacctgagcctggaaggttgaggccacagtgagctgtgatcgtgccactgcactccaccctggacaatagtgagaccctgtctcaaaaaaaaaatttttttttttaaatttaaaaattagctgggagtggtggcgcttgtagtcccaattactgtggaaactgaggtgggaggatcacttgaacccaggaggttgaggctgcagtgagctgtaaatgcatcactgcactccagcctgggcaacagagagaaaccctgtctcaaaaatgatagatagccagccatggtggctcacgcctgtaatcccagcatgttgggaggctgaggcggccggatcacgaggtcaggagttcaagatcagcctggccaacatggtgaaaccttgtttttactaaaaatacaaaaattagccgggtgtggtggtgtgcgcttatagtcccagctgcttgggaagatgaggcaggagaaatgcttgaacccgggaggtggaggttgcagtgggccgagatcgcgccaaaaaaaaaagatagatagatagatagatactgttggatgcaatataagttttcagcccatattttcgttatataaggatacaacattaagagcaaaatactaagataagagaaatatagagtctaccattagaaattttaaaacttctatttcaggatttctaaatgggctattcaaaagtgaattgaatctcctgtcttttctcttgctttcatttgtgacaaacctgatgtaggtgggaaaaaacctgagcctttgtaatcacatgtttgggtttaatcataactctcatttagtagtagtgtgacttatttatttatctgagacagagtcttgctctgtcacccaggctggactgcagtgacgtgatctcagctcactgcaacctccacctcctgagttcaagcaattctcctgccttagcctcccaagtagctgggattacaggtgcatgccaccaggctgactaatttttgtatttttagtagagatggggtttcaccatgttgttcaggctggtctcaaactcctgatctcaggtgatcctcccatctcggcctcccaaagtgctgggattacaggcatgagccactgagcccagccaaagtagtgtgactttaaattgcttaaactcttttttttttgatggagtcttgctccgtcgcccagggtggagtgcagtggcacgatctctgctcaccgcagcctccgccgcctggggttaagcctcagcctcccgagtagctagaactgtaggcacccaccaccatgaccagctaatttttttttgtatttttattagagatgaggtttcaccatgttggccaggctggtctcgaactcctgacctcaggcgattcacccaccttagcctgccaaagtgctgggattacaggcatgatttccatggcacccagcctaaattgcttaaactcttagagcaagtatctcttctgtaaaattgggataattaaatctgctacaaagtattgtgtaagaactaaaagagataatgaaattatggctcctccctagcacagtaggttttaaatatgtgttatttctctcccccttccccatttacctctgatggaaacttagttgacatctttgaagtgaagtggtttgttggtcagttcttagtttctgagttagctgctactctaagccattgcacagggtatttcttttgactcaagataaaaatgaactgtggaaaaccttattataatatagttatgaagaaggattatttattttcacatgatagcccatagtaatggtgttttgttgatcaggttacaatagattaatatcattatataacaaatgctcttttttccctgttcttttcatagttgttcaatttaatgagaggtaattgattaaattctgtttgcattgtagtcaggaaaccggagagggcagcaaactgtaggagattgtgccccaacgccccacccaggcctccctatcaagacttcacctccactaacctgtctcagtcatttctaacagaaggactcatgtaaattaccaaattactcccaaataaatcagtgtccagaaagatttagttgtttatggaaaattggtagaggattgaaattgtatgacactgttattcatctctcctggacaaggaaatacgaaaaaaaaaaatggaggcattggttgtgttctcgtatactgagaacctcactccctgccccatttctaaaggttacaattccatcttctctttagttttcatcaaatagttttgccccctgtacatcatttttattaatattgataataacaaccaacatcaatcaaatgctttccagagtcaggtacctcactgcattgttactattttctcgttttgtggatgatgacatggtttggctctgtgtccctgcccaaatatcatctcaaattgtaatccccacatgtccagggagggaggtgagtggatcatgggggagtggatcatgggaggtgagtggaacagcatccaccatgctgttcttgtgatcctgagtgagttctcacaagatctgatggttttataagcatctggcatttcccctgctttcccttctctctcctgccgccatgtgaagaaggtccttgcttccccttcaccttccgccatgattgtaagtttcccaaggcctctccagccatgtagaactgtgagtcaattaaaactctttcctttatgaattacccagtcttggggtttttcttcgtagcagtgtgaaaacggactaatacagatgagaaaaccaaggagtgagacaacttatgtaatttgctcattgtcactgctatagactgaatgtttgtgtccccccaaaattcacatgttgaaatacccaaatgtgacgatattaagagacgggatctttgactggtgattagatcatgcgggttaagttctcttgaatgagattagtgcccttataaaaaaaactccaaggagaccccttcctcattctaccatgtaaggacacagagagaagacctctgcctgtgactagaaaacacgctcccaccagacaccaaatctgccagcaccttcatcttccacactccagaaatgtgataaataaatttctgttgtgtataagttatccagtctatggtattttattctagtagcagcccaaacagactaagacagtcacatagccagtgagtggtggagcccagtatcaaaccaggttattctaaattctggagcccacacttcctttctctaatggcataaatggaagctagaaaggcaggaatttagtaatcttcaatgactggctttggcctaatttgttgacctgatatttgcaaattaccataggctaatttaaatctgcctttgtaacttctgctgtgtccagtatcagtttaccactctggtcattctaaattattttttccctgtaaaaaattatttcactttgcctatctaaattcaatccatcttttccatgaaggcttccccatctgcagagggacttcattctattacagtcctatatcactaattattgtattacatgacagacatagctttttttatagtctgtaacctatgtatgtgtgtgaaggagacatcagtgtttgagaaacagcagtgtttggcacatggctaattctggtatatgtttgcctacttccttatcctttagcttgcacactagaaacagacacacctgttttttaatcctagcagctctatttctagctgtaggtatcgagtcaaatcacaaaacttctccatattttaattatctacaaaaaaggaataattatggtatctagtttattgatttacagtgaagatgaaatgagattttgtgtttaggacatagtgaatacttattaaatattagctgccactattataacttctttttttttttttttgagatggagtctcgctctgttgcccaggctggagtgcagtggtgcgatcttagcttactgcaagctccaccttccaggctcacgccattctcctgcctcagcctcctgagtagctgggactacaggcgcctgccacaacacccggctaattttttttatatttttagtagagatggggtttcaccgtgttagccaggatggtctcgatctcctgacctcgtgatccacccacctcggcctcccaaagtgctgggattacaggcatgagccaccacgcccggcctattataacatttttagtaaatattcattgttatagattatttgtattactagattacaaaatctgtaatcccccttatgcacattataagcatttagtaaatgttgagttttttgtttgtttgtttgtttgttttttgttttgaaacagagtcttgctgtgtcacctaggctggagtgcagtggcgcgatctcagctgattctcctgcctcaggctgctgagtagctgggattacaggcatatgccaccacgcctagataatttttatacttttagtagggacggggtttcaccacgttggccaagctggtctcgaactcctgacagcgtgatctgcctgccttggcctcccaaagtgctgagattacaggcatgagccaccacacctggcctgagttgcttttttaaaataaataaagatttaattcacataccatcaaacttgtcaagttttaactgcaggttttaactgcaggatttaaccaagtgccctgctgtaaactgccagtatataacataatgcaggcatgtgaggtcccattggaaagggagttatccaggctgggagaaaaacttgagagaaatgggcacttgcatgaaatcctattgctgttccctaaacctaccctctgatcttatgaaaaaacgaatatcatgtgaaatgatttcatttcatttgattgttagtgaaatgttttaaataattatttgaatgctttagaaattaatgtatcgttatttgtaattagaattcagttgtgcactctgctcaaaatgagacaaagtgaagcattactcatgttttcaggtaagtatgaaactcttcattttgagtgataacaaatatcggtgaatgcttacaagcacttgaaacatttacttttggttaggtaaaatttaatgtgaatgtgatggcggtggattttagtttcaaatgaggtaaaaagctgaattgttaaagagttgcatctattctttcatagtctggaatctacctcaccctcattctttgtggtgagttgcaaatgaggcagcaagatacccagcatacctgttaagcaagtatttatgtcccactggtttttctttttttagtttaatgctaggttttttttttctttttttgaacaatctgttttctgaggttttgaattttcctagcaactgctaggagagataggaaggataatgagctgaatggctggtattcaacacaagaataatggtgttctttatttacctttgcataattttaaagagaacaagtttacttatcttttacttgttcttttcccattgtaaaaactcagtaggtgttactagactattctgaaatacaaattctgaaaagctttcttctgatatttctatggtttctcattcatattttctcttttgttacctcacttagagcacatgggctttgtaatgtacactgctaagagtagatagaaacctgcttggaatattgattttctgtaattaagaatgtatttatagaattttatctttcttatagttctattttttttttttttaagaggcagcatcttattctgtcacccaggctggagtgtagtggcacaattgcagttcactgtagcctgaacctcctgggttccccgcaaatagctgagactacaggaacttgctaccatgcctggctgatttttcaattttttgtaaagatgtagtctcactatgttgcccaggctggttttataatactgggctcaagcagtcctcctccctcagcctcccgggattatgagtgtgagccaccacaaccagcctttcttatagttatttatctcactgtgaacactgtgaacattttgtcattttggagatccttaacattgagtcatgtatactttgtgaatgtttgcatagagttacctaggaacatctggaagaatgttcatgaaagattagaggagggccagtcatgcaggaggaacagtttctccagggtgctacccatctatatgggggttgcagaagacctttctgccctctaaaccatatttcctttttttatttctttgagacagagttttgctctgtcgcccaggctggagtgcagtggtgcaatctcggctcactgcaacctctgcctcctgggttcaagcgattctcctgcctcagcctccagggtagctgggactacaggcacacaccaccatgcccggctaatttttttgtatttttattagagacggggtttcaccatgttggccaggctggtctccaactcctgacctcgtgatccacccgcctcggcctccaaaagtgctgggattacaggcatgagccaccgtgcctggcctaagccatatttctcttgtagttgttttgtctttctttctgtctgatcttgattttatgggtgacgtgatgagaatattcaacaagtagaatatgagatataggaaaaaggtcttgactgctactctcctgagttgagataattttttttttttttttttccgagatggaattctccctctgtcgcccaggctggagtgcagtggcacaatcttggctcactgcaacccctgcctcccgggttcaagtgattctgcttcagcctcctgagtagctgggtctacaggcgcgcgccaccacgcctggctaatttttgtatttttagtagaggtggggtttcaccatattggccaggctggtctcgaactcctgaccttgtgatccacgcacctcgtcctcctaaagtgctgggattacaggtgtgagccactgcgcccggtgaggtgagataatttttatacttgctgctttgactgatgtataaaaaaatgctactcccataatgcaactactttgctgcattggagagaacacaatagaaaaatagccacttcttattcaagcttttcttgatttttgtttcggctgtctctaaatttgacacttgagaatagatggtttatttgactcatagtatgacccaggtatgcttttgttaaaaagaacagttctaggaggatgactgttgggacaaaattagctactagtatggaatactctttcagtgtaaaatctcagaacaacatttaaaaatcattggagatattttattcataaacattttcttaataagatccagaaagggtttataaacctaataaacctattcgataggttctatcaaataaacctatttctatcaaataaacctatttgatatcttctatcaaataaacctatttgataggaggaaataggaataggacacattgcttttgactttctatacccatgtggaaaccaggaatctattctctccctctcaatttacatgaccatgaggaaactgaaacctagcgaagttaaatgacttgcccggggacggacagctagctagttcctgcttgaactgaggaccatctatttggttaccgggagtgtggctggtttctgttgcctgttttgatactcttctcctggtaagttttagcttcaaatggtattgtccacaccacagcccttgatctcaggtaattctccacaccactgcctttttttttttttttttttttttttccaatgcagttgcgtggtgtgaaggcgataactgcagacactcaggtgtaaacaacccagggaatcaatgggttggggggatggtaaaacaggagttcgtagacaggactgtgtacaatagcttctgaagttttggagggtattggtgtagctgttatttctgagaccggagaaaatgacggtagagtgacagtttctctaatcatcagttttcaaagagtatgtttttcgttggaaccacaaatatagtacacttaataaggggaaacgaaaccttgaatttttccttcccagactctgaaaagtaaagtaaactttaaggaacattttaagggtgacaaaaggtgaagattgcaaatcaaacttagagtgtccctgctcaagaaaatctgtgcactgcagctacaatagaggaccacttgggtttagaaatgacatgttattaataattctagtcactgtggctaattagaacaatctgttgaaggttataaattatagaagctttttaaaacatttatctaagaacctgtgtagaattctaaaaggactgaattatttgaagttattagtttctgtgtatgtaaacttaaactatttttaaagcctttgattatttttctaaaaatgtttttgcatgcttatagcctgatgccgtaaatgttttatgagtttaatgtacagcacctctaggtgctatttaaaattgttttttctggtccttttcttttgggttataagggttcttcgtaaccaagaagattacctatggttacgctgaatgcactctcccagggtgcataggcgctgctgaactgcggttataactcttgtttgcccctgggtggttgccagcagggagtaaggcattgtgggaagtactttctttaccttccacaacaggtgtctttgtcagtgcaccttattcagatatccatgtgtggaagctctgagtcactgaatagcaaagaaaaatatgaaagcaagaggaattgctttcacatctagaaaatgttgcaagataatctgaaatcttctggtgctggtgaatgcatgaagaggttcacagtatcttttaaagtacttctgaaaagataaggagtttaaaaggtatgaactgcctggacaccttataatgccttgtctcctgattatcatttaatttttacctggttagtcagagtcaggataaatgtgcaggaaaaaaatgttaacgaaaataatgcttaacagacaaagcagcactgtagaacaaaaatgaagtaaaaatgctttactgactccaacaagggtcaaacacagtttgaagctgttttaatcttgtggatttatttaaaatattgcatttttttgtttaaataagcttattagatttgcttgtttcctagcaatcaggtgcttttccctccttccttgtgctcgctcttataagctagaatgctatagcagttgtaaaactctactaattacatttaaatgggacaaggtgttatacaagtaatcatgttaatgtagatgaaaaaaatacttttggaaaacatgggaaaataacactatagatctcattctgagttttgttttctgaaaagcaaacaaatttaggtaacataatcctgctattggtaatgaagactaaacatttcaactggttgaaatgttttatttcaacttatttcttttgattttagacgaacttgccaaattaatttctagttctaacaaagaatatttctcatagtaagtactgcagtgtcatgatctagaaaaagcagggaagatactagcttaattaggaatattgaaaaacaacttcagagaagccttatctgtcttccccttatttttatttgcttaatcctttttccatgaaattagtatacattatatttcctgatcaagcaactttgtaatggtgattatgggcaactttcaaacttttcatctggaaatatggcagttcatttatggtctccagctgtaatttaaaaagcactactggtggttaagctaccaacagttaatggctatctactgatttgaataattaaaagaaacccctagccttaaagataaaagatgaagagaacttttatctatgggagcaaaacaaccagtttataaatgagactcttgtattgctttctgaataacaacacaaaactatgcttaaaatacttattttttttagtaggaaaagggagtaatgattattaattgatatcgctgtccctgtttcatttttatgttttggcatttttttctttaacagaaatactcagaggggaaaattttttttttcagacttcaggagatcacttgtactatgaattctttaaattctgagaaattaaaatggttttcatctgtttattttctaagattacgaaaaaataagcgttaagaacactaagaaaatttacttcttctccaagaacaatcttcatgtaataatactgcagtaagaagatgagctattatgaaaatttttaattaccaagaacataacacaaatcagttttttttgttgttgttattgctataggatatttctagttaggaaactttatttcttttttgaagtttaaaggtttccaaaaattgaattttccagcttctctgttataaatgcagaaggtgtttatagtgtatacttcctgcatagataagaaacctcttttagtttcctactgggggtgaattgctagccaagcctgtgatagcagccgctttttttttctttctctttctttctttctggatttttgacactccaccccctcgaactcaggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaggtggtgccttgcacactactctggttctgtattttcttttctaacatgatatctatactcctgtagcaactgaggcataacttgctgttggctttgtgttatgtctacaggttttcaaagatttatttacataattaaacactcatataacagtagcacacttaaaatgttaggctgatgctttcatatataatgaggttgagaggaattttagagtgccaaatatcactttgtcttaagtttctgccttgtaaatatgtatataattatcaggtaggggctagttatatttacatagcatacaattgaggctcatagaagtgtaacgtttctaccagtgagtaataacatcatctgagaattgagctacctaaacatcaggtaactttcagggtcttaaattattactaagaagaactattaggaaaataacagtacaattttagtttggctttaatatttgtaaaaaaaatttgccattctctcaggatcttagtgtgtgtgcatgtcctggcataatcaaaaacggaagttcttgcaagtgtttattgtttcttctcttagatgtcatcattataatggctattgagtttaagatatcaacgatctatacctctgaaaccaacttttttttgagatggagtttcgctcctattgcccaggttggagtgcaatggcatgttcttggctcaccgcagccgttgcctcctgggttcaagcaactctcctgtctcagcctccctagtagctgggattacaggcatgcgccaccatgcctggctaattttgtatttttagtagagatggggtttctccatgttggtcaggctggtctcaaactcctgacctcaggtgatccgcctgcctcacctcccaaagtgctgggattacaggcataagccaccacgcccggcccccaaaatcaactttttaactacaattgtagtaacttcttattatatttaatatgactcatcacaaacaacagaatgaaagagtatatcataacatttaaacctaactaatatgaagacctacttctctattttaaggcacaggaaccttaaaaacatggctatttcttgaaacaacaaattacaaaaaataaaaataaaaaaataaaggagaaagctatagattgattttaaaagacttaagggttatatcaaccagatgcaataaatcaacgttgtttaaatgctaatttgaacaaagtataaaaagaactgtaagataattgagaaaaatttgaatttgaccactcattaggtatttaataatgatattaagagaattatgtaattttttgtgcattgtttttttttttttttttttttttttgacatggagtctccctcttgttgcccaagctggagtacagtgacacgatttcagctcactgcaacctccgccttctcaggttcaagtgattctcctgcctcagcctcctgagtagctgggactacaggcacctgccaacacgcctggctgttttttttttttttttttaagatggagtctcgctctgtttcccaggctggagtgcaatggcacgatctcagatcactgcaacctccgcctcccatgttcaagtgattctcctgcttcagcctcccaagtagctgggactacaggtgcacaccaccatgcccagctaatttttgtattttagtagagacagggtttcaccatgttggccagggtgggctcaagctcttgatcttgtgatctacccgcctcggcctcccaaagtgctgggattacaggcgtgagtcacggtgcacagcctttttttttgtatttttagtagagacggtatttcatcatgttggccaggatggtctcaaacttctgacctcatgatccacccaccttggcctcccaaagtgctgggattgcaggtgtgagccactgcacccggctgatactatgatttttttaaatggtcatttagagatatatattgaatagttttggatgaaatgtctgcagagattcaaaatgaaccagtagattatgtgttgataattattgaaactgggtgataagtattaatacatagtgattcattatattctctccacttttgtagagatgcagtttaaaagaatcagctggaagacaaaaaaaagcaaaaagatttgcaaaaagcaaaacagatataaaactgtaatataatcaataaaactgtaatatactcagccaggtgtggtggaccactcctgtagtcccagcacttcgggaggctgaagcaggcagatcacttgaggccaggagttcaagaccaacctggccaacatggtgaaaccttgtctctactaaaaataacaaagatcagccaggcatagtggcgcatgcccataatctcagctactcaggagactgaggcatgagaaatgcttgaacccaggaggtggatgtcacggtgagctgagacagagcaagactctgtctcaaaaaaaaaaaaaggaaaaaaaaacaccataatatctttctggaagtgttaatagagaaacatctgacctgttgcatgctttccttgtataatatacataatttatgtttttataattacatatattatatgaagattattgccaaccccctagttaactacaatatacactataactgaatcaggataggataatccacggttgtagataatctttaaattttattttagtcattgattttacaatattccaacatgaaagcttatccagagaattcagaatatggccacgtgctgtgactcatgcctgtaatctcaacactttgggaggccaatgcaagaggaagaggattccttgaacccaggaattcaagaccagcgtaggcaacatagagagacctcatctctacagaaaaaaaaaagaggatcttgagaggaccatcataaataaacagaattctctttttttttcttttctttctttccttctttctccctccctccctccctctcttccttcctccctgcctctcttccttttttgagacaaggtctcaccatgtcaccaaggcctgagtgcagtggtgtgatcatagctcactgcagcctcaaagtcctgggctcaagcagtcttcccacctcagcctctcctgagtagctgggactacaagtgcacatcactgcccccggctaatttttttttaaagaggtagggtcttgctatgttgcccaagctggttttgaactcttgggctccagcaatcctcccacctcagcctcccagagtggtgggattacatgtatgaaccatcacacccagccaagagcctcttaagaggtctgagctgagtcttcaaaaactaacaggagttttctaggccaaaggagaaaagaaacaaatacagagatgtgaagcagcagagtatagaggacagtgatggctgaagaggtggacagtgaccaagtcatagggaacatcctatgctcaataagtataggacgttgtgtgtttgtatgtgtatggacgcaggcacataagagactgggagggagaaaaaaatgaatgaattaatataaatgtgcttatcaggaaacactcttccatttgtagattgtgtgtatattatggctcaatgcaaccctagctgcaccaaagggaattcccactcctaaccctgtagctcatttttaaatagaatttgttgactaatatggaaaagccttggagttctgatagaaacacataatattgttttatatatcaaacttttaaataatgcagatcttggggtattataaaactttctgaagatatttagttttatcagatttgaaatttaaaatcgtcttttggaggtaatatttgggtttggttcatctggaaaagttattctaaaattgtgcaagataaaaatatatatcatttgcttttttttttttttttttttttttaaatatggagtctcgctctgtcacctaggctggagtacagtggcacgatttgggatcattgcaaccttcgcctcctgggttcaagcaattcttctgcttaagcctccccaatagctaggattgcaggtgctagccaccatgcccagctaatttttgtatttttagtggagacaggatttcactatgttggccaggctggtcttgaacttctgacctcaagtgacccgcccgcctcagccccccaaagtgctgggattataggtgtgagccaccatacctggcctcatttgcttttaattccatgttgaattttttgctttgagatgaacattttttcatcaaacattttgtttttttgttttgagatgcagtttcgcacttgttgcccaggctggagtgcaatggcatgatctcagctcaccgctatctctgcctcccgggtccaagagattctcttgcctcagcctcctgagtatctgggattataggcatgcgccaccatgcctggctaattttgtatttttaatagagacggggtttctccatgttggtcaggctggtctcgaactcctgacttcagttgatctgcccacctcggcctcccagagtgctgagattacatcaatctgataactgcactgtgaagcaaattacactcttgctaacttataaaatcctccttaggtttgggttcattattaagggtatttagaaactttcttagtacaggcttaattaaatatctttctgtaattggactttgttgcataatgggaggtgttttgattccttgaatggtaaaaatccgattaaatacagtggttctcaggtgtggatactgcatttttttcttattcataagtaaccctgtgtctttcttatgtttttggtaggaatctgtagtaaaatataccttgcaagctgttacatacacaaaactgaaagaaaatttgactaaacaatacctgctgttgccacatgttatgtatgaaggggatttttctgttttattcaatcgtttaaaggctttaattgtttatgacccactaaattgaattcagaaatctctctatccacactttggaaaatatgattatatcctattgagtccttaaaagtaaatgttgatgcaagaaaatcacagacccctttacataaattacagataagaaaaaacaataaggaagccaagcataacttcttatgtcttccatatcatacacacatgagcaaactaagaaattacctagaccaatattgtttactgtgataacctaaacaaaagcctagtcactactagcagaacataagagcttttttttttttggagacagagtgtggctctgccacccaggctggagtgcagtggcttgatctctgctcactgcaacctccgcctcccaggttcaaacaattctgcctcgtccttttgagtaactgggactacaggcacacaccaccatgcctggctaatttttgtatctttagtagagatggggctttcaccatgttggccaagctggtcttgaactcctgacctcaggtgatccacctgcctcggcctcccaaagtgttgggattacaggtgtgagccaccacgcctggcctctactgggggttttaaagttacacagttctcagttcaagttttagattcgctacttaccagtgagctaagtaacttctctaagccttggttttctcatctgaaaactgagagacataatagtattacctcattggaataccatgaggttatttgagagcacttgtaaagtatttagcacagtgaaagctgtaactaattgtctccttttctaataagggaggaactaatcagactatttgaagaaggtctaaaggaagaagtgggatgaatagataaggcaccctggagacgcaggaggagttgggaggacaaaaggagaaaatgaactagttgggttaccctggagaattactttgcttgattagggaatcactatcaggataccagtcctacaggaaacttgaagccttctgccctgaagatggtgctgaagatcttaggtttgagctcagaagggtgggaaggcaatgtagaaccaatagaagggagtatatataggccaaaccttctgatgagtagatgagatcaaattactgcagcaggaatcttgcagtaatgaactggcagggcccacattgaccaaggaaaaaaattgtaaaggacattagagcaatgcaagtaaaaagagatgacaagtgtctggacttagacacttgacagtgggagtgtaaatagagattagtctacacatgttggttagttctcacaaagggaatatacattaatattatttaggaagaagcagcaactgatgttatgagaagagtaaatgattgagataagttgaaaattaagttccagccatacaaaagtggagattgctatagtgtcaaaagtctttgggaatgggaaagttaggttatcaagaatagaatggaggaaaaatgacccattctggctttaccatgttccacatctagaaattcaaggtcacagtatcacggtaagagaattgattgtccagtggttagaacactgccctttaacaaaagccatttaatcagactaacacatggctatactatattggcactggatagatattcttcactgacagaaaccaaaatagcagcactgtgccagcaaaggaagggagctctttcttggagctacagtttctctttctataaatgggagacgagggtaagcattctgtaattacttcctccttatcggattggcacagatttcatcaagcatgccaaattaaaaaacaaaattcagagcaattccatatgtcagagatggagaaaacaataaaatcaatactgttatttctaaatctttactagatatacatttcaaatattgattagaataaacataacaattaagattcatccatattttttaaaaatgttatctgaatattttttattctcattgttacatagcaagtgcacattttggcactatatcaatttcagttcagttcaagcatccaaccaatcatttggttgatcagttctaatgagttaaggttcttatagttgcaagtaataaaatcttgtgctatcttaaataagaaagggattttatcacgtggacagcaaagtgtgttcctttaaatgcaagggcagttcatctaggcaacagagctggtactggactgatgctggcaaccattctccctatctcttgccatctaattaaaacttctctcttgacatctactttatttctctgtctccaacttcttggcttctttatttctatggcagaatattgctgctacacagcatccagatttatagttctaccatctgaatcacaactccatatttctttggtgagaatctgaccgagtaatgttaggtgagttttgtgatagtatagagcagagcccctgagcacacactcaaactaaactgcctgggtccaatcctacctcacttgcaattagctctatgactttgggcagattacttaatctcaaacctcatttttctcatctgtaaaattggagtctgcaagagaaagtagtccggactgaaatcggccagaagtccctctcatgttatatctaaagtaaacctatctttaactgccaagctgtgtttcgtgtttctttcctctttctttaactcttacagaatcatgttagtagtacctgtaagattaaatcaaaattaagtttaaatttaaattaaatcagtaatatatgtaaagcacttaagaaaattaattgtcaatatatgtaaagcactggatacctagcacatagaaagtggcatgtgtatgttagttattattccaaattgattcttttattatttatgaatgaatgagacaaggtctgtcgctcactgctgcctcaacctcctaggatcaggtgatcctctctccttagccttccaagtagctaggtgtacaggtgcatgtcaccgtgcctggctaattttttatttttgtagagatggggtttcactgtgttgaccaggctaatctggaactcctgagctcaagtgatcctcccccctcggcctcccaaagtgctgagattacaagcgtgagctaccacacctggcctggttaacagaaatttaaaatgatgattaagaccaggcgtagttgctcacgcctgtaatcccagcactttgggaggctgaggcgagtggatcacgaggtcaggagatcgagaccatcttggctaacacagtgaaaccccgtctccactaaaaatacaaaaaattagccgggcatggtggcgggcgcctgtagtcccagctactcgggaggctgaggcaggagaatggcgtgaacctgggaggcggagcttgcagtgagccgagatcgcaccactgcactccagcctgggcgacagagcaggactccatctcaaaaaaaataaaaacaaaacgatgattaaattattagagaaaccaattttttttttttttttttgagacagagttttgctcttgttgcccacgctggagtacaatggcatgacctcagctcactgcaacctgtgcctcccaggttcaagcagttctcctacctcagcctatgggtagctgggattacaggcatgcaccaccacgcctgggtaattttgaaattttagtagagagagggtttctccctgttggtcaggctggtctcgacctcccgatcttaggtggtcttcccgccttgacctcccaaagtgctcagattacaggcgtaagccaccgcgcctggcgagaaaccaatattacatcaaaactcaccacagtgcgcaagctgaacgtgtaatcaaattgtagtactcaaactcattgcaaggacttcaagcttatttacaaacaggatttacagcaaacaaaacagtgtagccctgtaattgtaatgcccacaataggatttctggcaggctgaaatacagaagccctcttatccgacacagtcagggctgtagttggtttatagaaaaagttggttcaggagaagaaggataaaaattgctacatactaacttaaacatttgtttttacttaaaacttccattatcaattttgctttaaggcctttaatgctctttgtttgcttcggaattctgaaatccatatgccttctagtttcagtttccttaagaggggcagtaaattaataaatgtgtcaagcagtctaagggcaaatttgatagagattttcataacttttttctttacattttttatggcagcattgccaccatttaattcttttttttttctttttttttgagacagggtctcattctgtctggcgtgcaatggcgcaatctcggcttactgtaaccttcgccttccaggttcaagcaatcctcttgcctcagcctcctgattagctgggatttcaggcatgtgccaccacgcccagctaatttttgtatttttagtagagatgggatttcaccattggccaagctggtttcaaactcctgacctcaagtgatctgcccaccttggcctcccaaagtgctgggattataggcgcgagccaccacgcctggcctcacgctttggcttttgtccatgttccattgaccaaacaaatcaaaaggccacttccaacatcctggagaagaaaagggtactccacaataggagttgtgggaggggaaagtgagtatttgctgaacaatagtctaccacatatataattgacctaactgacccttcatatgatcaccatggttaggttagctgtgtaaaatatataagcactgtgtttctcaatagtacacttatataatattcacaaaaattgcacatgcacagattcatcatcaaaaaatgacatatactcattgaaaaatgagataaaattgaaaattcagacttaccagtcttttaccattattcattttactggaaactttaaagtgaattggcactcttttttccccatcccttccaaaggtaattaagaaacagaaatctcttgccaatgtttctagggtatgccaacattgttatctcaacctgatccatatttatagcccagggatttgcaaaaacttggggggggggtcatggattcctttggcagtgtagttaagtccatggaccccttatcagaaaaaaatgtttttaaatgtgtaacataaaatagataagactacaaaggaaatcaattgtatttaaatacaattactaaaataggccaggtgcggaggctcacactgtaatcccagcactttggaaggctgaggtgggctgatcacttgaagtcaggggttcaagaccagcctggccaacatagcaaaacccaatctctaccaaaaaaatacaaaaattagctgggtgtggtggcatgcgcctgtaattccagctactcgggaggctgaggcaagagaattgcttgaacctgggaggcagaggttgcagtgagctgagatcacgccactgcactccagcctgggggacagagcgagacttcatatcaaaagaaaaaaaaaatacgattacaaaaatagacagaaatcagatttatgatatggtaataagtacttctttattaaacacattaaatagcaagaaatggtagtgaggctactataaatgcaaaataattttgagatatatgtaatacatataatgtgaatgaaaatatctgtggtatctataggtggcaaaatcacaaataacacagtggattattggctacatttataatggaaggaattgataaatttcagttagaggttcaggaaaatagtttttttccatctaagttcaattcaatgaactccctccacatacccctaatataacctttatctgatactgtctgagacacaaagatttttacaagtcttttctttccttacagtgggctaggagaaatcttgatcatgccttccactttctctcttcctcttaatggtatagaaaattacttgtgtgattatttaatgaatctctcattaacctataacttccctatgtcagctttttttattttggaaacagaatctcactgtgtcgcccaggctggagttcaagtgattctcatgcctcagcctcccaagtagctgggattacaggtgtgcaccaccacgcccagctaatttttgtatttttttagtagagatgaggtttccccatgttggccagactggtctcaaactcctgacctcaagtgatccacccaccttgcctcccaaagtgctgggattacagacgtgagccaccatgcccggccagctatttctgtttttaccattgtatttccagcccagcattgtgcctgggggaattatacacactctgtacatatttaatgaatatattgggggaagatgaaatcccacatagttacaatcataatcttcaatatgtttgtgacaattaaatacattcatgtgtgtgtgtatgcataagatatggaatttatttttaaatctttttatccttagacccatatactaagttcttatgattgtggaatcaggttagagtctagctgagtacttaattagctcttttgttttctttttttgaatttttgttttattttttaattttaattttaactttttttttttttgagatggagtctcgctctgtcacccaggctggagggcagtagcatgatctcggctcacttcaacctccgcctccggggttcaagccattcttctgcctcagcctcctgggtagctgggactacagatgcctgccaccacaccaggctaatttttgtatgtttagtagagacagggtttcaccatattgggcaggctggtctcgaactgttgaccttgtggtccgcccgcctcagcctcccaaagtgctgggattacaggcgtgagccaccgcgtccggccctgttttatttttatttgagacaggttctctctctgttacccagtctggagtgcagtggcgtgataatggctcactgcagcctcgaactcctgggctcaaatgatcctcctgcttcaacctctcaagtagttgggattataggtgcatgtcaccatacctggctaatttttttgtttgtttttttttgtagagatgggggtgtctcacattgttgcttaggttggtcttgaacttctggcttcaagcaatcctcccacctcagcctctcatagtgctggggttgcaggcatgaaccactgtgaccagcctttctattcttttttgagatagtgtctcttactctgtcacccaggctggagtacagtggtgcaatcacggctcactgcggcctcaaatgcttgagtccaagtgattctccctcctcaggctcccaagtagctaggactgcaggcacataccaccatgcccagctaattttttccttttctttttctttttgtagagagggagcctcactatgttgctttggctggttttgaactgctgggctcaagtgatcctcctgccttgacttcccaaagattacaggtgtgagccaccactcccagccttaattagctcttaactgtttcaaaaatcaaacaaacgaacaaaaaaatgcagtgattatttctgttatacttttatttagtggttcatttaacatgtatacctcctacgtgcatagcactgtgttaagctttgagacatcgtcaaagagataacagtccagtttgggagacagccatgtaaacagccgtgtatgagtcagtgatgtgagcactgttagaaatgtgtaggtgctgtttgtcctatatgctcctgtcacaccttgcaccctgtgaactaactgaaatgggatattctatctgcttttctgagttgtacactgaagttcattttccttgtgggttgttttatttcttctctctctccctaccatagtacctggcacatagtgtcagcagccagtaaggttctaattattgaataaaggaatggtggagataattagagatattttcataaagatgtagacactttttaaagtacaggttttgatttttaagctcttacaattttactttataaataatacatgcacacagtatcagaatttcaacaaatatgaaatgatatccagtgaagttacctacccattcctgttttcccagcagttttagtagttttttttagaagtatccttctataaatatttttatacatgcaaacaaatttatatgtgttctcttttttcagagctcttggtggcccttttatgttctgtactttgcttttctcacttaacagtatgtgttgatttttctatgtcagttcatgaagggtgtccttgttcatttgaaagctacatagtatttcactgtatagatttctataatatgtgtaaccaactccctcccactctgtgagtgtgtaggttgttttcaatattttgctcctacaatactgcagtgagtaatcttatataacatttcacaaaagtgtgtgagtatatctgtagattaaattcctaggagtggaactgctgggttgaaggatacattcatttgtaattttgatagataaggccaaattgttttccttaaaggttatattagttaatataactaccagcagtgtatatctgtgcctatttaaaggtggaaacttttgaacaggaatctaagaaaaaataggaatttatcagattgtcaggggacgggaaagatgttccaggcagaaggaatagcactttgagaggcacgggatagaaagatggcacaagaggatttttaacttattccatctggctaaaatgtagggggtaggccaggaaatagagagtgggagttgatcatgataggttgtgtatgtaatgctgagtaactgatattttaaattctataaatgaaggttttgagtagggaaatgatataataaggttgattaatgtattttattaaaagaatagctatttgtgtgtatttatttaaattgaagtttgccaaaaaggtgtagtccctaaagatttttcttgctttttttgtttgtttatttggagacagggtcttactctgttgcccaggctcgtgtgcagtggtgatcagatcatagctcactgcagccttgaaattccaggtttgatcctcccacctcaccctcccaagtagctggtactacaggcacatgccaccatgcctggctaatttttaaaacattttttgtagagatagggtctcgctatgttgctcaggctggtcttgaacgcctggcttcaagcaatcctccagcctcagcctcccaaagtgctgggattataggtgtgagccaccacactcagccttttcttggatttaaatgaggttttctttttactaaggattcaaataatatgttgactatagaaaattttgaaaacacatagaaataaaaactgaaacacagaaagaaaatacagaagttactcataagtttactactctgaggtaatctccctatccaaataattcctgttgtctataaaacaataaaagaaaatcaatatatgtattaggtgggttagaaaatacaaagtgggccacagtccgggtgggcatggtggccgcagcggtagctggagcctctgcgactacacctccaaccggcctggagcccgtggcttccctggctcctgcaagcatctcgcgtggtggctctggccagctccagcactcgggttgggccggatgaccagaggcctgtagctaccagctgccctctcccgcctgggctcagccgccacccgtgagcgaactcagcccgggacacagcacacttatcaagtgggtcccatttttagccacttgctatttcagccattgctgaaaagtctagtgggaaggaaccaactggagagtcagagggagaaattagtttctatttccagctccaccactataatccctggttgaagaaatatgaatatcaacacgaaattgttcatcagcgttatttgtgccagctttttcaccttccagcttcttttctactttgtaagttactggttttcacaaaagtttctccaagtttcaatagtcttagctttgaaaagaagattgaatggaactcaagggtggtatttacatgccattctttggtggttggtgttcttggcctgtacattttcttatttgatgaggctgctaaagctgatccactttgggatggtccatcacttgcaaacgtgaatattgctattgcttcaggctacctcatttctttgttttctttcttttttttttttttgtgatggagttttgctcttgtcgcccaggctggagtgcaatggcatgatcttgactcactgcaacctccgcctcccaggttcaagcgattctcctgcctcaacctctcgagtagctgggattacaggcgcccgccacctcacccagctaatttttttttttttttttttttttttgtatttttagtagagacagggtttcaccatattgtcctggccccgaactcttgacctcatgtggtctgccagcctcagcctcccaaagtgctggggttacaggcatgagccaccacgcccagccaggctacctcatttctgatttgtccattatcattttgtattggaaagtgattggtgacaaattttttataatacatcattgtgcggccctgtgtgcatactgctttatactgatattagtgaataagaagtttaatttggcataatttcttcaagaatcagatatatcgaaacatctctccagaccacccatttggaatcacgatataaataattataaatgttttaaaaactgcttcagttctcttggccactgaaatcacaggcttagcctggctgtgcgtggattggcaagctgaatgtttaattatgtggggtgactattattttctctttggacttttatgcctttaaaataaaataaaataaaatagaaaatacaaagtggtttccaaagacaatcacttgttaagagattcttgtgattcctcctaggaagaaagaaaaaaacaaaagtgatgcatatacctgcataaattacagcataattgttaatgtagagctgtacaacaaatatcttctctttaaatatacgaatgtcttttaaagacagaaagaactgttttattttctttgagggcctcactacaagccttttagatagatccagataacatgttctactttccctctttgcaacacttcgctagcaggtacttcctaatcaggatcttgacaactatcagccacatagaatacttggaaggaggttaacttttcatactcaaaagctctcttctggaagaatcctaatattattaatagcaagtcttccacttgtagggcctgttggaacagtttgtgacaaatccttcccagactgttctttgagtatacaaattaatatctccaagtcactgatactctgagcacatgcatcctgctgctagggaagtgcattaaggtaccttcaaaaccttttttcctctgtaattacatcctaaaaattacactggagggtgggctggggtggagggaaggtcccaggtgcatttactgagctatctgtcaaagtccaccaagctagtagattgtgaccacaattttgataatttcggattccatatctgcaaggcagtgttaaaactacacaatacctgataaatgctagaatgaggataattcctctaaatagttaacatttaaccagaagctctacagtgctctccaacctaacagtcacacattaatttattccttcatgtaaaagaatcatttttattgctgctgcctgaaaggtacaaattgcttgggtgtaggctgctcagcttccttcttactaaagagacaggaaatatatcttccatttaaagtgttaatggcatctataaatgtgtagtccaatttgttattgacttgaactcttcaaagatttgagaaacaaggtttaactttagcactcaagattgttacacaagaattaaatgttttcaatgactaccttttgtagtgttgggaagggtgcaaaaaggaaagagaaggctggaaaataaatatattttatctaagagggcatgactgagttggctaagctttcaatttcatttttctcttaggaaagactttcacctattatgttacaatgtgtgctcacatttcctgattatggatcgaaatggagcttggagcactacatttggtgcaggagaggactgtcgagactagaaccaagttgggttttttgttgtttttgtttgtttgttttgttttgttttgttttgtgtgtgtgtttttgagacagttgctctgtcgccctggctgtagtgcagtgacacgatcttgactcactgcaacctccgcctcccaggttcaagccattctcctgcctcagcctcccgagtagctgagattacaggtgctcaccaccatgcccagataatttttgtatttttagtagagacgagatttcaccatgttggccacgctggtctcaaactcctgacctcaagtgatctgcccacctcggcctcttaaagtgctgggattacaggcgtgagccaccgtgcctggccccaagttgtttgttaacagacacctgccaaaagacgaggacttcctctgaacccttatcaggtcaaaacatggtagatattctactaaaattggtcaaataagtaaatgaaataaatgaatgaaaattattcattctttcaagtttgtttggagaaaataatggaaaccattcaacttgagaataaagtgtttaaaatatttataggctgtacaaatttgaagtgctattagtatcccactattaagtgccacttgttacattcccctagataatctagaaggggcaaacaaataaaaataatttaagacaaaagtaataattccacccagggtgaaatggcattcagcctattctaattctttttttttttttttgcttttggaagtttttttttattattatactttaagttctagggtacatgtgcacaacgtgcaggtttgttacatatgtatacatgtgccatgttgatgtgctgcaaccattaacttgtcgtttacattaggtatatctcctaatgctatccctccccactccccccaccccatgacgggccccagtatgtgatgttccccttcctgggtccaagtgttctcattgttcagttcccacctatgagtgagaacatgcggtgtttggttttttgtccttgtgatagtttgctgagaatgatggtttccagcttcatccatgtccctataaaggacatgaactcatccttttttgtggctgcatagtattccatggtatatatgtgccacattttcttaatccagtctttcattgctggacatttgggttggttccaggtctttgctattgtgaatagtgccacagtaaacatatgtgtgcatgtgtcttgatagcagcataatttctaatcctttgggtatatacccagtaatgggatgtctgggtcaaatggtatttctagttctagatccttgaggaatcgcctcattgtcttccacagtgggtgaactagtttccagtcccaccaacaatgtaaaagtgttcctatttctccacatcctctctagcacctgttgtttcctgactttttaatgatcgccattctaactggtgtgagatggtatctcattgtggttttggtttgcatttctctgatggccagtgatgatgagcattttttcatgtgtctgttggctgcataaatgtcttcttttgagaagtgtctgttcatatccttcacccactttttgatggggttgtttttttcttgtaaatttgtttgagttctttgtagattctggatattagtcctttgtcagatgagtagattgtaaaaattttctcccattctgtgggttgcctattcactctgatgatagtttcttctgctgtgcagaagctctttagtttaattagatcccatttgtcaattttggcttttgttgccattgcttttggtgttttagacatgaagtcgttgcccatgcctatgtcctgaatggtattgcctaggttttcttctagggtttttatggttttatgtctaacatttaagtctttaatccatcttgaattaatttttgtataaggtataaggaagggatccagttttagctttctatgtatggctagccagttttcccagcaccacttattaaatagggaatcctttccccatttcttgtttttgtcaggtttgtcaaagatcagatggttgtagatgtgtggtattatttctgagggctctgttctgttccattggtctatatctctgttttggtaccagtaccgtgctgttttggttactgtagccttgtagtatagtttgaagtcaggtagcatgatgcctccagctttgttcttttggcttaggattgacttggcgatgcaagctcttttttggttctgtatgaactttaaaatagttttttccaattctgtgaagaaagtcattggtagcttgatggggatggcattgaatctgtaaattaccttgggcagtatggccattttcatgatattgattcttcctatccatgagcatggaatgttcttccatttgtttgtgtcctcttttattttgttgagcagtgatttgtagttcttgaagaggtccttcacatcccttgtaagttggattcctaggtattttattctctttgaagcaattgtgaatgggagttcactcatgatttggctctctgtttgtctgttattggtgtataagaatgcttgtgatttttgcatattgattttgtatcctgagactttgctgaagttgcttattagcttgaggagattttgggctaagacgagcctactctaattctttaatctatgtagtagttgcttatatattaaacgtgtgaaaatcgtatgaaatcattgttaattcatactgaaatattcacttacctctgatctatttaagccaagctaataggtttcagcctgtttctgacctcaggagcctggacccacctatgctaagataaaagccatgatgactgtggcaacagtgttgctgacattgtactgaccacattgctgtaagtgtctccatggcacatctgcttctgtagattcagtcttactctgcttttagagactttcccatataacactaaaatgtacttgcctgttagtatgtttgatattcttcaaagggagagaattggcctggcatggtggctcacacctgtaatcccagcactttgggaggccgaggcaggcagatcacctgaggtaagaagtttgagaccagcctggacaacatagtgaaaccctgtctctagtaaaaattagccagtttggttgcaggtgcctgtaatcccagctactcgggaggctgaggcaggagaatctcgaacccgggaagttgaggttgccgtgagctgagatcacatcactggactccagcctggatgacagagtgagactccatctcaaaaaaaaaaaaaaaaaagaaaagggagataattaatttcatttcttcattctcactgacttcaatgaggagatttagaataggaaaagaaaattagtatacgaacaagttgagacgaaacagaactgacataagaagaacataaaaagcagagtccataaatcttgcagtatggtagcctaggtttcatcttaatagcactaatacagacacaaaataaaatgatagtttgatgaggtaagtacagtttttcaggcctgtcttacaggtggtaaatctgaagcacagattaagttacttgttcaaggtcacagtgctggaaaatggtaaagtcaggatttgagcacaggctttctggctctagggctgtgctcttaataattattccaaatgcatggcgtttgtgctttgtactcccttattagatgttacatacaatattcttttgtttatatatccctttgatgatcagaatctgaacttttctaaactgtaacagtttcttaggaaggtgataagttagacgacaaatctataattagagtttcttttacttttggagcatggattttgaaagtgaatgattaacgatgattgacattcttatcagatttttatttactttcttttaactatttggataataaagtaatgatgcttgcctgaataacagcagttctctgttgggctttgtgctttatacatggaaagagggccttggtctattgcaaggatactaaacagtgactgtatagcatgttaacaatgttttaataaatatttttagcaattatgagctaacttaagcctttttaaaatggaatatttattatttactttgtgcctagtaatgtgttagtgctaagactaaaagagcaaagcaaatgccattcctgccttcagagtgcttacagtctagcaggcaagattgatattaaacacatattcaaaaaaagggtatgagttttttaaagagaggtagtgctaaatcctctgggaacatcctctgatctcatctaaatttgaaaccctaggttctctgggaatctatagcaagaactaatccaagttaggggtcagagaagatgtgaagaatgagtaggatttagtcagctgaagagaatgaggctatggggaagcgtgttctaggaagaggagaaatatattcagcctcagagatgtgcaaaaaagaacttaaactgcagagactttcgggagaaaacaaacaaacaaaaaaaccgagcagacaaaaaaaatgcttaaagaaattaaataaatggatcgtagagtgcaaggtgaggagagctcaggagctcaggaggggcttaaaattaggctggagaagacgttaggaactaaattataaagaaccctgctatttatgataaggaattgggctttatgcaaagggcagtggaaaactgttcaaaagattttaagcagggcagtcattaattttgtggctctatcaaaaacattaggccaattatttaaacttgggcaattcatttgatcttcctagttctaaattttctcatttttagagtaggggacttggattagccctttcagatcaaagatccctaatgtgagtttatgcaccctgagaggatcatgtctagaaagaagtaacagagtatcctcatccatcctgctctctgttcttttccttttcctttcagatttcaatatcaattttctcatgaggcgtattttagtcagtattttggagaaggcattctaatgactcctatgtctatttttttgaaataaaattcattttgtcattataaaggtaatatagaaaattttttaagcatagaaaatgaagaagaaagcaatcataatcatggatgtcatgctactgaaacccttgggatataactagaatggaagtcaggctggtaaagcaaatcccatgagaggagagagtgattactgggagaggggaatgtttgggggggtagaataatcttcagattcctgaaggactatagtgcagaagttggaatagaagacagaattatggttaatgagtagaagctactagagatacagattttaactcaatttgggaaaaacaaaactagcaattgcaactgtccaccagaaaattagtgaattcctctgaatgcccataggtattctagtaaattactacatgtacttcaaggttgccagtagaaggtgttcaggttcttggcatctcgaacaaagaattagacaaaatgcacacacaacgtgaggaaaccaaagcacggatttactgaaaacaaaagtacactccacagtgtgggagcgggcctgatcataagagccccgcttacagaattttctggagtttcaatactgtagaggtttcccattggttacttggcgtatattctatgtaaatgaagagaatgaagtcacagagtcatttactcagactgcgccctattttaaatggagaggatgttgcttggtgtgtgtggtctatgtaaatggagaggatgaatgtgaagttacaaagtgtaaatgttgtggagaggatgaagtggagttgcaaagccattcacattcctgtcattactgaagtgctttcacttgatataattttaggacattagtgtggatcgggcttgtgttccctgcctccaggccctattctcctgcctcagcctcctgagtagctgggattacaggtgtgagccactacacccagctaatttttctatttttagtagagacagggtttcaccatgttggccaggctagtcttgtactccttgcctcaagtgatccacctgcattggcctcccaaagtgctggggttacaggtgtgagccactgtgcccaggctgaatttgaatgttgacctgtcttgctaggttgacgaagttctcctggatgatatcctgaaggatgttttccaacctggttattttctccccatctctttcaggtaccccagtcagtcataggtttgttctctttacataatcccatatttctcggaggttttgttcattcctttttattcttttttctctattcttgtttgcctgtcttatttccgaaagatagtcttcaagctctgaaattctttcccctctttggtctattctgctatttatacttgtgattgcattgtgaagttctcatgttgtgttttacagctccattagttagttatgttcctctctaacctggctattctggctatcagctcctgtattgttttatcatgattcttagctttgttgcattgggttatgtattaattcgttctcacactgctaataaagacatactcgagactagagaattgataaaggaaagaagtttaattgactcacagttcagaatggctggggaggcctcaggaaacttacaataatggcagaaggggaagcagacacgttcttcttcacatggtggtaggagagagaatgagtgcccggtaaagggagaagccccccttataaaaccatcagatctcatgagaactgtctgtcatgagaacaggatgagggaaactacccccatgattcagttatctccacctgagccctcccatgacacctggggattatgagaactacaattcaagatgagatttgggtggggacacagccaaaccatatcaggttacaacatgctcctttagcttagtgaagttcattaccacccaccttctgaagcctacttctgtcatttcagccatctcagcctcaacctagttctgtgttcttgctggagaagtgttaacggtcatttggaagagaacagactctctggcttttttgaggttttagcatttttgcattgatcgtttctcatctttgtgggcttatctacctttgatttttgaggttgctgacctttgagtgaggtttttgtggggtcttttttgttgatattgttgtagttttctgtttgtttttctttttaacaatcaggccactctatctatcgtaggactgctgtggtttgctgggggtccaatccagaccccagttgcctcagtttttcctgtacctggaggtatcaccagtgtaggctgagaaaaagcaaaggtggcagctagctccttccactggaagctccatcctagggggatactgaccttttgccagcccacacacacctgtaggaggtggctgaagacccacattgggaattgtcacccagtcaggaggaacgggatgagggacccacccaaagaagcagtctggctgctttttggtagagcaggtatgctgtgttggaggaggtcccttccttgtttggaccacctatattctccatagctggcagactagagcagctgacttgactgaaccatagaggtggtggctgcctctcccccccaggaactcagagttgtctctgatggactctaatccactgccattggctggctgggattccacgccagtcggtcttaacttgtgaggtgctgtggaagtggggcccacagaacgtcgctgcttgactccctggattcagctcccttcctagggatatatacagatggatttcccacctttctgggaatcctggggctggtgtatttaaaactcctgggtctctgcatgtacctaagtggctactctgccgtgactccacatagctctgtgtatcagacccaaggccctgttggcatggtctcatgaggggactctcctgataggtgagttgcaaagatctgtgggagaagtgtggtttcccaggtggggttgcacaatcactgtttcccttggctgggggtggagtttcttttggctctatgccactcctgggtgggctgtcactgccctgcctgccccacactacttttctttgttctctctgggtcaggtggtttgcctagtcagtcccagtgtaaccacctggatatttcggtgctgaattcactcttcctttttcattcgtctccatgagtgtaatggaccacagctgtttctaatcggccatcttggattgatctctgaagctaatctaaaaggtgaggaaactaaggttatgggaagttaaggaaactggctaagacatcaggactcagtgacaaagctgggatttatatttcaaattcagcagctgtaattttttttccattgtgtgcatcttctaaaataaataatcctgtatattagagatatagaggcaacagaccaattcttgtttcctggagagtttgggaaacttcctagaattccaagacacacaagtaccataagtgtaaatatccttccaaagccatttgccttcacctgggtgcctaaagcttcaatgcccagatatgccatagaaatacagatcattctgtagctggagttgtcccattacaactctgggtttatgaaatgtgcatctggtgaaatacatgagcctttgtcttcagattatgagtggaatgtgataatataaagagaaacttcttttaatacagataatgcatttttctttatcacagaccttccacaaattctgctgttctatttgggtatttgacaatggactttgtaatgtatgacagtgcatatgggaaaataaaatgttcatgtggggtatggggaaagagaattctcagcaaatgaattggaattataatataaagcagtatagcattaggatttgaatataaaatcatataaagccatataacactggatataggtggttaagaagtggataaaaaaatttcatggctgagtgcggtactaacgcctgtaatcccagcactttgggaggctgaggcgggtggatcacctgaggtcgggaatttgagaccagcctgaccaacatggagaaacatcatccctactaaaaatacaaaattagctggacatggtagcgcatgcttgtaatcccagctacttgggaggctgaggcaggagaatcgcttgaagccgtgaggtggaggttttggtgagctgagatcgcgccattgcactccagcctgggcaacaagagcgaaactctgtctcaaaagaaaaaaaaaaaaaaaaaattcctagggagatttctgattttaaaatggtgacatggaagcaagctgcctccactctcccctccccccacagaaaaccaaaaacaaatatatagcgccaagatttttgctagcaacaactctgagcagtcagtaggagaactgaacttccatatccaaggttctgctctctcccccattctgcctggcaataagcttgaggaaaatctttccccaacttagagtttctacactagaaaaactgagattgaggccaggtgtggtggctcatgcctataatccctgtactttggtggctaaggtgagaggatcacttgagcctgggggttcaaggttccagtgaactatggttgtaccactgcactccagcctgggtgactgaacaagactatgtctctaaaacaaaaagagagattgagaccatcaaccatcttttcgcaccatactgggttacctggcaggagacctgttcttgccttaacccacaggaagcatcatgactgcctaaagggaggaatattcccccaaggacaggcagacaaaggggagaaatgggactatcatccctagctctgaaaactctgctttgtaactaggccaaaggagatgccacataaaagtggctgttcagtagctctattctataggaggtacatttctttctttctttttttcttttctttttttttagggaggaggggtgtcttcctctgtcacccaggctggaatgcagtggcgtgaacacagctcactgcagcctcaactccctgggttcaagcagtcctcctacctcagcctcctgagtattgggactacaggtgggtgccaccatgcccagctaatttttaaaatttgtttgtagagacgggggtctcaccatgttgccaaggctggtctcaaactcctgggcacaaggtatcctcctacctcagcctctcaacttgctgggatgacaggcatgagaagagagtggtatatttcataggttccttggacaggaacctctagccagccttctcacactgctgggataatctctttgggaactccctagtttgggacaggcagcactccaatcatgcactagcgtcaaggtgaacctgggctttaaggtgccacaagagccaaaaaggaggaagtgacctagtagtaaagatttgctaaggaactatatctaataaaaaacaaaacaagccagacagaaaatactgaaataaataactaattcttcaatgcaaatactagaataaataactaatccttcagtgcaaaaaccatgacctttccaaagagacagagcaacaattcagtcactagccttaagtgatgatttgtaagatctgtgacctagcattcaaaatggcaattttaaggaaactcagtgatcaccatcataacaaagaagagcaattcagaaatttatcagagaagtttagcaaagattgaaataacaaaaaattaaatggaaattttagaactaaagaatacctttcctgaacagaagacttcattaaaggctctcaacagtagaatggactaaacagaggaaaaaaaaaatcagtgagttcaaagactgtctgaaaatacacagagaagtctgggtgtggtggctcatgcctgtaatcccagcactttaggaggccaaggtgggtggatcacttgaggtcaggagttcgagaccagcgtggccaacgtgatgaaacctcatctctactaaaaataccaaaattagctggacatggtgccgggtgcctgaaatcccagctactcaggaggctgaggcaggagaatcacttgaccccacaaggtggaggttgtagtgagctgagatcgcgccactgtactctagcctgggtaacagagtgagactctgtctaaaaaaagaaaaagaaaaagaaaaaagaaaatacatggaggagaataaagaaaaagaatgaaaaggaataaagatagcctacaatatatagaaaattgcctcaaaagaccaaatcttagaattactggtgttcaagagggagctaagcagaacaaggaaggggaagaaagcttattcatttcctttgagacaggatctcactctatcacccaggtcggagtgcagtggccccatctccactcactgcaacctctgcctcccaggtttgagccattcttccacctcagcctcctaagtagctaggactgtaggcatgtgccaactcgcctggctaatttttttattttttggtagagacggggtttcaccatgttagccaggctggtctcgaactcctgacttcaagtgatccacccaattcaacctcccaaagggctgggaatataggtgtgtccaccatgcctagcctagaaagcttattcaaaaaataataataggctgggtgcattggctcatgcctgtaatcccagcattttgggagaccaaggcaggcggatcacatgaggtcaggagttcgagactagcctgaccaacaaggtgaaaccccatctctactaaaaatacaaaaattagcggggtgtggtggcagatgcctataatcccagctactggggagggtgaggcaggaaaattgctggaatctgggaggcagaggttgcagtgagctgagatggcgccactgcactctagcctgggtgacagaatgagattccatctcaaaaaataaaaattaatataataataatagtaatagaaaactttccaggtacaagaaagcctgagatcactaaacagattcaacccaaataagatatcccaagggatatagtaaactctcaaagatcaaagataaggagaggatttgaaaagcagcaagagaaaagaagtaaataacatatgaaagatctccagtttggctggcaatagacttctgaatggaaaaccatataggccatgaggggatgaagtgacattttcaaagtgctcaaagaaaaaaaaaaacttgcattcaagaatactgtacccagaaaaactatccttcacatatgaaggagatataaaatctttaccagacaagtaaaaactgaatcattcaccaccaccgggcttatcttacaagaaataaagggagctttcccatttgaaagaagaaagcactaatgggttaaaaaaaaaaagttttcaagatataaaacccacttgtaaaattaagtatacggataaacccaaaatactctgttactgtcatgtaacaatagctacagcagcctgttaagagatagataatgaaaaatatataaaatcagacaactgaaagtcaaaagggggaggcagagtagaattttgtcatgtttttttattttgcctgtttctgttcttttatttgtgatccaagataagttgtctttttaatttttttttaagattgggtctcatctgtcacccagactggactgcagtggcatgattatggttcactgcagccttgaccttctgggctcaggttatcctcccacctcagcctcccaagtagctgggactgcaggtgtgtgccaccacacctggctcatttttttgtattttttgtagagacatggttttgccatgttgcccaggctggtcacaaactcctggactcaaatgatccacccacctcggcctcccaaagtgctgggattacagacatgagccacaacacctggcccctatgttgtcatcttttaaaaataatttgttatatctataagatgcttttttttctcatgataagcacagtgcaaaaaacctataatagattcactaaaaataaaagcaacaaatttactacctattaggtaggaagaaagaaaggagtctcaaaacaaccacaagacaggcaacaagtggcattagtaaatccttacttatcaataataacactgagtataaatggtctcagttctccaattaaaagccatacagtggctgaatgggtaaagaaacaagacccagctatatgctgccttcaagaaacccatttcacctatcaagacacacatagacttaatgtgaaggggttgggaaaatatattctatgcaactggaaatgagcaggaatagctacaattatatcagataaaatagtacactaatcaaagaatgtaaaaagagacaaggtcactatataatgataaaagggtcaattaagcaagagaatataacaattgtatatttttgcactcagcaccagagttcccaagtatgtaaagcagatgttaaatctaaaaggagaggtaaactgcaatacagtaatagtaggggattttaagccccactctcagtaacagatgatccagacagaaaattagcaaagaaacagtagagttaaactacacactaaatctaatagacctacctgacatttatagtacatttcacccaactgctgcagaatacacattctcttcatcagcacatggaatattccccagaatagaccatatcttagaccacaaaacaaatctgaacatattttttaaaaaagaaatcatatcaagtatcttttccaaccacaatggaataaaactagaaatctgtaacatcaaaaatacacaaacacattaaataagtaagttaaacaacatattctttttttttttttttttttttttgagagggagtctcactttgttgcccaggctggagtacaatggtgcgatcttggctcactgcaacctctgcctcctgggttcaagcaattctcctgcctcagcctcctgagtggctgggattacaggtgcccaccactacacccggctaatttttgtattttttgtagagatggggtttcaccatgttggtcaggctggtctcaaactcccgaacctcaggtgatctgcccacctcggcctccccaagtgctgggattacagacgtcagccactgcgcctggccacgagatattcttgaacaaccaatgggtcaatgaaagtactaaaaaggggccgggcacagtggctcacacctgtaatcccagcactttgggaggccgaggcgggcagatcacgaggtcaggagatcgagaccatcctggctaacatggtgaaaccccatctctactaaaaatacaaaaaaaaaccattaaccaggtatggtggtatgcgcctgtagtcccagctaattgggaggctgaggcaggagaatctcttaaacccaggaagcagaggttgcagtgagccaagatcgcgccactctactccaacctgggcaacagagtgagactctatctcaaaaaaaaaaaaaaaaagtactaaaaaggaaattttttaaaaggtttttttttgtttgtttttgagagaaggtcttactctgtcacccaggcttgagtgcagtgtcatgatctcagctcactgcaagctctacctcccaggctcaagtgatcctcccacttcagcctcccaagtagctgggactataggtatgtgccaccatacacctgactgatttttttaaatatttgtggagatgaagtatcactgtgttgctcaggatggtcttgaactgctgagctcaagctatcctctcactttggcttcccaaaatgctaggattataggcatgagccactgtgcccatcctaaaaattttttgaaacaaatggaaatggaataaaataaattaaaactatgagaacaatagaaaagatcaacaaagtgaaagtggtttttatggaaagttaaaatcgaaactttagctagactgagaaaaaaatagagaagacccaataaaatcagaaacaaaaaaggaaatataacaattgaaacctcagaaatacaaagcatcgttagagactgttatgaacaacctggaaaacctagaagtggaggaattcctgaacacatacaacctaccaagactgaaccataagaaatagaaaacttcaacaaaccaataacaagtagtgagatcagccgggtgtggtggctcatgcctgtaatcccagcactttgggaggctgaggtgggcagatcacgaggtcaggagatcgaaaccatcctagctaacacggtgaaaccccgtctgtactaaaaatacaaaatattagctgggcatggtggcgggtgtctgtagtcccagctacttgggaggctgaggcaggagaatggcgtaaacctgggatgcggagcttgcagtgagctgagatttcgcgactgcactccaacctgggtgacagagtgagagtctgtctcaaaaaaaaacacaaacaaacaagtaatgagatcaaagctgtagtttaaagtctcccatcaaagagatggagatgcaaggagggctcagtatatgcaaataaataagtgtggtacatcacatggacagaaccaataacaagaaccatttgattatttcaatagatgccaaaaaagcatttggtaaaattcagcatccctttatgataaagcccctcatcaaaatggaagtagaagaaatgattatgtaccttaataataatggaattattatacctcaataataaagaccataaatgacaaacccacaggtaacattgtactgactgggaaaagttgaagcctttcctcctaggaccagaacaagacaaggatgcccacttataccactttttttcaacgtaacagtggaagtcctggccacagcaattaggcaaaggaaagaaataaaggacatccaaattggaaaggaagaagtcaaattagccttgtttgtagatgacatgatcttactcatagaaaaacctaaagacaccaccacaaaactgatagaactgataaacaaattcagtaaacttgcagcatacaaaatcaacatacaaaaatcataattgtaagtcagagacgatctgtgcaagtatctgtttgagtccctgttttcagttattttgggtatatacctaggagtggaattgcttgcttaaatcataattctatatttaactattaaggaaccaccatactgttttcacagcagctcaaccattttacattatcaccagcaatgcagaaggttctaatttctccactcttcactaacatatgttattttccattttttgattctagccatcctagtttgtgtaaagtggcatctcattgtgattctgattgcatttccttaatgactaattatgttgagtatcttttctcgtgcttattagccatttgtatatcttctttggagaaatatctattcagattttttacctatttttaaatttttttatttttattgtcaagtaaacttttttatatattatggacagcaaatccttatcagctatatgacacagatattttcttccgttttgcaggttgtcttttcactttcaagaaagtgtttttgttaaaaaagttttaaacttgcttgaagtctcactatttttgctttttttaaagaaagcaaacctttatgtaataatgagtgcaaacggctttgttgacacttacagaaataatagctaaatttaatgcaaatttgtgtgaattgaataactttgttacattttctaagctttatctttctatgaaatagggtcccattcacctataaaggatattttgggatttttcactaaaacttataaaatctgagaatgtgcttaggagactggagataaattttgtgagcctattatctagttagtaatgacaccatcttattaaatttcaaggtgttaaatatagcccattcaaatactcgtatatgtaatctaattattattgttatagaagttaaagctcccttgctgaacctatgattcttctaagctgctgaacatagagacacatgactgagcagtaggaggtgcttattgcttccagagttgcactatgcttgccttgatggcgtagaatggccataaagatgactgtggaaacagtgatttctaaactcttctcagagttttggatatgctccatatccaaatgaaacagatgactgtgttctgttctgtagattttactacttttctctgccagtagcctctcacatttgtcacgcaataggaaccaagcaagagaatctggacagatcagctcacatctattgccctgttaaagtaactcaaagatatgcccaaagaattggatacttgtttcatcattggataagctggaactgtctataagtggctaggatgtatcatgccttatcacaagaaatagcagaaaaaaaatatatagtctttgatttcattaaattcctttgtttgtttgtttgtttgtttatttttggacacagggtctctctctgtcacccaggctggagtgcagtggtggtgctaacatatctcactgcagccttgaactcttggctgaagcaatcctcctgcctcagccttctgagtagctgggactaccagtgcatgccaccatgcccagctaactttttcatttttttgtagaaatggggcctcactttgttgctcaggctgttcttgaactcctggcctcatgtgatcctctcaccttggcctcctaaagtgctgggattgcaggccagatgagccactgcacccagccaatttcacaaagtttcagtattctcagaaaagaacatactcatatctagaaatgtcttatgacttaaaaagcaaagtataaccatgtgcatattaatagggcacaaagtgaatctggtagagtgccagctgtgtctaatctgataagtttatttcatatggaaaatgtgtgtcaatcttagatgaggctaatttgttgaaaataactgaattctggtctcttttagattgtcagaaagggattcatttaacagtaaaatttaatccagatatatgtagtcatatgtttttaaactttttaaaccctgaaaattattgaaatatgtgccattttaatagtatcagcttctgattgcttttattccatcatcatgtgatatactcctcattaagcagcaccagtaaccagagtttaattattgtgtagcactgtgtgaaagcttttgtctctttatcatatatggcacagacagtactcttggttgtaagtagggatatccagcatagtttactgtctacatgcttatttctttagctttttttttttttgagatgaagtctcactctgtcgcccaggttagagtgcaatggcacaatctcagctcactgcagcctccgcctccaaggttcaagcaattcttccacctctgcctcccgagtagctgggattacaagtgtatgccaccacgcctggctaatttttgtatttttagtagagacagggtttcaccacattggccagactggtctcgaactcctgacctcaagtgatctgcccaccttggcctcccaaagtgctaggattacaggtgtgagccactgcgcccgacctctacatgcttatttctaagagctatataataaaacaatataactatacagattttgatggtttcctccagagcctttgccttgcttatcattgctgtgtgagaagggtagcagcactaaaccttgtgtttctagagatagaagtttgtccctgtgtactgtcgattaggacaggcagtttttcttgtcttgcctgaagaaaaacgtaacttttttgagatacaatctttctgataaggtaaatatgtttagcaaagccttattttgtggaaattttccaaggcttgaccctgtaacttctatagtagagaaaagggcagtgctttcaaacttttagctcttctcctggttggttgcctgccatggtcgtattttaaattgagtagcaagtaaataaatacttagcttctctctataaatgagctgtctgcaaagggtttctttgtactatatgactgttgtaaagtttcaatggagtaattataggaaaagaaaaagaacagatttttacttagtgctgtgttaatgccagtgtttgtatgcaataaaaatgactggccactcattgtttcagaaaatagatcttaacactcaaaagaaacaaattctaaaactttaataactttgaggaacactctttaaatacctagactttagatacatactattgtccaggatagatttcccagcatatttatctacaacagatcttaaatattgaaaactaacagaagttgttgcataaatttttctgcaattagataagaacatttttatggctggtctgcaaacagtccgtaaagatagttgctgcctatcatacttagagttaagggatgaactccattctttattttctaaactgtgattgcattatcctaaaatccagtggtttttctcacatacagtctaggattgagaggtccaaggccagtagggtgcctctgcctcctctcaagctgcttccattgatgggttcagggatttgttagagcttttaccatctccctgccaacaggggaaaggaagagagaatacatcccttccgttttaggggcacaagtatcaaatgacatatatcacttttatttaccaaccagacctaatcatatggccataccaagctgcagggatggctgggaatgatcatctttagatagataaccacaagcccaattgacaggaaggattattactaaaggaagaagcagagtggatactgaagtacaactttagtagtctctgccacagtaatacctctaaatgcatacatatgagtctgtaggaacagtcctacaaaggactggtgaagctttatattaatatatagtggtttccctttctttactgtctgcagaaagattctggctagattttttttttaaactttttcaacagccttataaaggtataagttatatagtataaaattcacctgtttgtgcaatttagcagagagttcacagagttatgcatccatcatcacatccagtttcagagtattttgaacacctccctaaaattccttcatgctcatttgcagtcagccctcatcctaccccccagatccattcacccctaatctgcttttatataaatggaatgtatgtataaatggaaccatacagtatttagtcttttgtacttggcttcttttacttggcataatgattttgaggttaatctctgctatagtaaataacagttatttcttcttttttgttgcataatagtagcttgttccttttcgttgcatagtgcattgtatggatagcccacattttgtttatccatttaccagttgatggactttttgcttgtttctagtttttggctactatgaataatgctcctatgaatgttccccacaagtttttctgtgaacatgtgttttcatttctcttgggttgatgcctaggagtgaaattgctgagtatagtaagtttatgtttaacttttaagaaattgccatactattttccaaagtggctataacattttatattcccaccagttatgtataaggattccagtttctccatatcctcaacaacacttgatgtcaatcatttttgtagtagtatctcatttgaggtttttatttatattttctaatggtgttgagccccttttcatgccctttatatattttctttggtaaaatgtctgttcagagtttttgcccttttttcttttgttttttagacagtcttgctctgtcaccaggctggaatgcagtggcgtgatctcagctcactgcaacctctgcctcgcaggttcaagcgattctcctgcctcagcctcccgagtagctaggactgcaggcacacgccaccacgtccagctaatttttgtatttttagtagagatggggtttcaccatgttggccaggatcatctcaatctctcgacctcatgatccgcccacctcggcctcccaaagtgctgggattataggcgtgagccaccactcccagcctttgcccatttttaaattgggttatttgtcttcctattgagtcatgagagttctttatatattatagaaataagtcctttatgacatatatgatttataaatattttttcccaatctgtggctttttaaaaattaatggtgtgttttgaaaagcaaaggttttaataacttagccatttttttcttttatggattatgcttttggtgtcatctaataaatcttggcctaatccaagactgcaaagactttctcttatgttttcttctaaatgttttatagttttcactgttatatttaagtctataataaatttttctttagttttttttttttttttggtatggtatgaggtaagggtctatgtacattttttttttgtatagggctatccaattatcccagcactatttgttgaaaagattattctttcccctattgaatttccctggcaactttgttgaaagtcagatgaccataagggtttatgtctgaactctcaattctgttctgttaatctatatgtctctctttacctggctagatttttaagactttcacagtaatgtttctgaattcaccttcttgcttttacatgcaatcttgtcaatgatgggacctgaaatgacctcacaacacttaaatatcgctgaaaagagtgatccagaagctgaacaaagttttatattcataagccagataaataaatacaagataagaagcatgtcaacccagaggggaaaagggccaaaagggaaaatatgatagtcacaaatatgaagtttttttgtattaaaatacaggttaacgaagagatctaaccagatagttgcttaaacaagaaagatcttcatttttgtcttttagtgtcagtttcagtatacacaatccaaatttgatgtggtggctgcgttgaagtcaggaaatcagactcgctctactatctcaaaggagagcatatctcgtcctttgaaggaagtttcacacattaattttattcattccattggtgaaaacttgtcactggccatacctagatgcaaacagcacttggaagcataatctttagctgaaggccgtgtgcccaactaagacttacattactaaataacaagcaggtgtcttagtcaactcggactgccataaccaaacaccgtatacaatatcacttaaacaatgaatatttatgtctgcagttttggaggctgggaaatacaagatcagtgttccagtagatttggttcctggtgagaactcttttcctggcttgcagatagccacctttttgttgtattctcacatggcagagagggagagttttggtttctcttcctcttcttgtaaggacactaataatcatgggggctccaccctcatgactttatcaaaacctagttacctctcaaaggctgcacctccaaatgccatcacattggctgttagggcttcagtatctcagtgtgggagtgggttggggaggacataaacattcggttcatatcagggaaaatgcacacttagaggaaattggcaggttatgcttccaattacatcagtattacagatttataaatatgtgttgatattatgtatacatcagaatatataatgtatgtatgtgttgatattatgtatacatcagaagacaaacattgaggacttacattggagacactgttatggcgattgcaaagactgcctttagtgagatttccagaatttaacagctggtggaaggggaggcagttatagtgttataactttataaatgttatttctaaactgaaaatgccattttaattttccaaacacaatcactgcagatctaagctgcactatttacagtttttgtagctaccttgatatagtaattcttcacttcaaaaaatatgtattgaggctgggcgtggtggctcacgcctgtaaccccagcactttgggaggctgaggtgggttgatcacctgaggtcaggagttcaagaccagcctggccaacatgacaaaaccccatctctactaaaaatacaaaaagtagccaggcatgctggcgattacccgtgatcccagctatgcaggaggctgaggcaggagaattgctggaacctgggaggcagagttgcagtgtgctgagatcgtgccactagcactccagcctgggtgacagagtgagactctgtcttaaaaaaaaaaaaaaaaaagcccaaaaaacatgtatacgtgtattgagtgcctgtcatgtgtcagggatacaggggtaagttgtctgtaaccagaaatacaattatgtttggcctcaaacagaaagcagagtcttctcatcctgaaatattgcagttttaataataatataagaggcctttataatttagaactattatgaagtaattatgttttggaaaaatcccaggactggatgcaaagagacttaagtgtatgtcccagttctgtcactcatcgggcaactgtgggctgacctgtttcctcaggtttaaattgaaggagtttattatatattttagtttctacagtctcctttgtttctatgattctgtagctctaattatctataatgtatatatttatgtgaaatatactttattatctataatctgtacatttctatgattccatagctccagttatctttaatctgtagtcctagagtatttattgcaaaccacctcaaaacagtgtcataaaacaatggcagttatgctcacagaatctgcggagcaagaattcacacagggccaggcatggtggctcacgcctgcaatcccagcattttgggtggccaaagtaggagaattgcttgagctcaggagttagagatcagcctgggcaacatagtgaaacctcgtctctagaaaaaaagtttaaaaattagccaggcatactgctgtgcacctgtagtcccagctacctgggaggctgaggttgcttgagcccaggaggtcatggctatagtgagccaaaattgtgccactgcgcttcatcctgggagacagagcaagatcttttttcaaaaaagaagaaaagaattcagagcctgggcaacaaagtgagacccacccccccgatctctacacaaaattcaaaattaaaatttaaaaatttgtctcgtacagtggcatgtgcttgtagtctcggctattcaggaggcttgaggtgggagaattgcttaagcctaggagttagaggctgcagtgagctctgatcgtgccactgcatctgcctaagcgacagagcaagaccttgtcttttttctttttttttttttttttgagacagagtcttgctctttcacccaggctggggtgcaatggcacgatctcggctcactgcaacctccgcctcccaggttcaagtgattctcccgcctcagccttccgagtagctgggattacagacatgcgccgccatgtccagctaattttgtatttttagtagagacggggtttctccatgttggtcaggctggtctcgaactcccgacctcaggcgatccgcccgccttgacctcccaaagtgctgggattacaggcgtgagccactgcgcctggccaatccgtggttctttactcttgtgtcagccacctgaagtgggatgtttcaaagacagggctcagctgggaccattaactgaaacacctacttcggcttctccgtatgtcttgagcttcttcacagcatagtgccctgaatgtcttacatggcagctcagggttctcagaactggtgttctccaagggaaagtttttgtcttataaaataattaaaaatattttagtgtaataaaaaaattaagaattatttttaagccaggcatggtggctcactcctgtaatctcagtactttgggaggccaaggtgggaggattgcttgaatccaggaattcaagaccagcctgagaaacaaagcaacacagtgtttctacaaaaaaaaattaaaaaattatctgggcacagtggttatgcctgtagtcccagctacttgggaggttgaggcaggaggatcacttgagcccaggagtttcaggctgcagtgagctatgatcatgccactgcactccagcctggacaacatagaccttgtctcaaaacaaaacaaaaaaagaattattcaaaccaaattgatgaaaagtgttaagtattaggtaagtagagttataaaagtttatttggggtcaccaggaacttaaaactggcatttattgggtgtatactatatgcttggcattggaccataagcacttttgtggattataatgtgatttattcttcacaacagccttatgcagaaaccaaggcttagagaagttaagcatcttgtccaggtcataatgctaagtggctgaactgtgactcaaaacagatctaactccaatgttagtggcctaactactgtattagtccattttcacatgctaataaagacatacctgagactgggcagtttgcaaaggcaagaggtttaatggagaagtcacagttctacctggctggggaagcctcacaatcgtggcagaaggcaaggaggagcaagtcatgtcttacatggatggcagcaggcaaagagagagctggtgcagggaaactcccatttttaaaaccattagaacttgtaagactcattcactatcaggagaacagtgcaggaaagattcacctccataattcagtcacctctgaccaggttcctctcacaacacatgggaattacaattcaagtgggagttacaactgaagatgagacttggatggggatgcagccaaaccatatcaactactgttacgagttgaattgtctttaccgcatccctaattcatatgttgaatatgactatatttggagtatagtcagcatctcagaatatgactatatttagaggtagggtctttaaagtggtaattaaggtaaaaggaggtcattggggaaggttctaatccaatatgattagtgtccttgtaagaagaggaaatttggacacagacacacacaaaggaaagatcatgtgaggatacagggagaagatggccatctacaagccacgaattgagccctcagaagatacaaccattgccaacaacctttatcttggatttctagcctccaaaactgttaggaaagaaatttctattggttaagcccttcagtctgtggtactttgtttttttgttgttgtttgagacggagtcttgctctgtcgcccaggctggagtacagtggagcgatcttggctcactgcagcctccgcctcccgggttcaagcaattctcctgcctcagcttcctaagtggctgggattacaggcacatgccaccatgcccagctaatttttgtatttttttagtagaaacggggttttaccatgttggccaggctggtctcaaactcctgaccttgtgatccacctgccgcggcctcccagtgtgctgggattacaggcatgagccactgcgcccggcccagtctgtggtactttgttatggcagccctagcgaactaataacgtcactaatagcacattactaatgtgcatacctgggttttgttttgtttttttaaacctgttttaatcagcctactttagtgctgtccttcccattgccctctctcttacaaagatattgtggacagatacatttgttttttatagacctacaaactttcttaccattatcacatgctgagacatataataaaggtgtacaattcttcaaggtaaaaatacctccacatgggcatactctttcctataggataaaattagagttcttccctcttttgagatgtgagcatcaattaatagcccctaaggagtttattttctgcaaagatcaagattaattacaattgtttcaaagtaatccggaaatcaatgtggaaatctctggttttataaagctagttatcagctgctaacgaactgtctaaatatgccaaaaattgaactttatcatgtagcatttaccttctgaaccatgtatttatttattatggtctgtcatgtttgaattttttgtcttgtgttatatatataaatcttgcctccctaataatgagcttcctaaagatgcacatttttgaatcctctttagttagtaaaatgtaatgaatgcatttgtaggtgagcactaaatgctattaaactgaattgtaattttcagatttaggtattttgtgtacagtttccctctaaactccacttttgaaacactattgaaatcaatatgggggatgctgttttgatacattcactctgcccttcaatttttttaagtataatttccattttatttttctccagaagatagcttttcttcagtccttaaaaactcagcttcttacacaggcttggtagtggttgtagggcagcacccggaggcctaaaaatgggtgtttagtcattcccagcttcataagaacaattcctgtctaccttgctatgggtggcaccactcacacagtaacgcagttttacatacatcttgggaagcgcatagacatcaaagacactccagaaataatccctgacagctgtagcctctactatgtttcaaatgatgaacttcttaaaatggccttgtccttgggcacgcatcaggcgcagtttatgcagcaaatagacagcatgtggctgcagctctttttggcatgaccattgttccttctttatttgtcatcttggaagcaaggactgaagagctgcctttcaatttttaaaaccacagtcttctttcctgacatgttccttagacagtggctctctctcgcagcactgttttctcaccctggggcttaagaacataacctatcaatgtattggaagagaaatgtttctgaataaggaccaggcctttgatcattttgtgagatattcatggtctcctctatctgaaagagcaatgataacattatttccaaaactggaactcatgcatattcacatctcaagtatactaaaacttttcattttctggtgaagaaattcaatgtagtggttaaaagtgtgggctctgtcttagttcaaatcccttctgtgccaactaccagctgtgtgattttaggcaaatcaacttaatcttgttgaaccttgatttcctgttctataaaatgtagccaattatagaggataggccaggcacagtggctcatgcctagaatcccagcactttgggaggcccaggtagaaggatcacttgagcccaggaatttgagaccagcccgggcaacagagggagaccttgtctctacagaaatatcaaacagccaagtatggtggcacatgcctgtggtcccagctacttggggggtcaaggagattgaggctgcagaactacggacacatcactgtactccagattgtgtgacagaacaagaccctatctcagaaaaaaaaaaaaaagtagagcatatctatagagttgtagaaataaataaggtaaggtgtgttatatgcttataatagcacatgggacataggaaatcttcagtaaatgttagtcattattatcattaccattatttattggctatccagatattggagaaaactgaaatcgaccttaagactgatttgtgtaaagcacagtaagtattcagtgaatgtttattgggtaataaagacatgtcaagtgtatatggaggctttattgaatagattaccatttttcaaaaacaatgaaaggttttaaacagtttatttcagcacctcctcaatgaactggagctcaaagccttaccctagtgccctgtctggatgagtgacacatagccaaattatataataatgttaattatttgaggatattgtatataaacaaacatttagaagtcagtttgctgaccaagtacggaggcttatgcctgtaatcccagcactttgggagcccaggcgggtggatcacttgaggtcaggagtttgagacagcctggccaacatgttgaaaccccatctctactaaaaatacaaaaattagctgagtgtggtggcacgtgcctgtaatcccagctacttgggaggctgaggcaggagaatcgcgtcaacctgggaggtggaggttgcagtgagctgagattgtgccactgcattccagcctgggcgactgagcgagactgtctcaaaaaaaaaaaaaaaaagaaaaaagaaaaagtcggtttgtttaattgtagcttttgtcacctctaagatttaatcaggaaagtatttagtcaaaacttacactgctgagtagtttcattaggagatgcaaatatgactaagctattacacctggttcagggcttgtaagcattcactttcaaactactggacagtctagaaagcttcataagaaagatacaaagtactgactgggcacagtggctcacacctgtaatcccagcactttgggagggcaaggtgtgtggatcacgaggtcgagagattgagactatcctggccaacatggtgaaaccacatctttactaaaaatacaaaaatcagccgggcatgatagtgtatgcctgtagtcccagctacttgggaggctgaggcaggagaatctcttgaacccgggaggcagaggttgaagtgagccgagattgcgccactgcactccaatgtggtgacagagcaagactctgtctcaaaaaaaaaaaaaaaaaaaaagagagagatacaaagtactactgaaatctagaaaaggggaaagagcatctcttactgcagaatcagaagggaggacttcatgaaataaatggcatttatggagaactctaaaggatgactttgcttcctacttcgcagagcatttagggtaattggattctgctcagatgtattacttttccccaggcccagaaaagattttgtccccctgctattcaacattaatctattcaaccttgctttagatctggtccttcccatcttcctcagagccttgcatggaaggataatctcaacgggcacgatggtggcaacttatgatgaccttccttaagcctggaacatgttaactctcgaattaagaaaaatcagtcactattacagaccccgagaattccctacttagtagagcttaagtttaagtagagacaggcaataaacacaatacctaagtaaaaatccatagtactgtatattagaagataactaatgtggaaaaaataggacaaggtcaggaagatcagtagtgctggaagagtgcagtgttaaatagggtagtaagggtagatttcactgaaaaggtacatttgcgcaaggacttgactgaagcaagggagtgatccatccacatggctagatagagggaagaattttcaaaagagaaaagacagcgggtgggccgggcctggtggctcatgcctgtaatcccagcactttgggaggctgaggcgggcgtatcacaaggtcagtagattgagaccatcctggctaacacggtgaaaccccgtctctactaaaaatacaaaaaattagccgggcgtggtggcgggcgcctggaggttgaggcaggagaatggcgtgaacccaggaggcggagcttgcagtgagccgagatcacgccactgcactccagcctgggagacagagcgagactcgagactccgtctcaaaaaaaaaaaaaaaaaaaaaaaaacagcaaaaaacaacaacaaaaaaaacagctggtgaaaaaaccttggcaggagcatgtctggtgtaccggaggaaccacaaggaggctagagcatgatgagataagaggagagtggaggagaccagacgtagaatagccggggagaaagcgagccaggtaggggagggctttgtaggccatggcaaggcatttggtctgtaattcttttatgatttgtgcttttggtcttgatttcttccttatgaatcatagatgatgaggacttagaggaggaaaagaagaattgttaattatcctctttttaaaaacggaatttatagattttcataaagatgaaaatgttctatatgtaaatttttttgaatatttgtttttcttttttcagtttttagttttttgtgcaattaaaaaaatataatgtgagatagagaacctgatttttctcattttgttattttggttttttgggtttgttgttggttttttttttgtttttgttttttttttgtgtttttttttttttttttgataccaggctgcagtggtgtgatcttggctgactgcaacctctcctcccaggttcaagtgattctcatgcctcagcctcccaagtagctgggtctacaggtgtgcgccaccataccctgcctatttttctcattttgatcgccagttgtctgaccaacatttattaaataacttatcttttccccacctatttgtaataatactgccttaattttgtgtctgggctctttaatactgatttgttgatctgttcctgagctagtatgtcacagtttcaattagtaaaacttattataaatctttgatgtctagtagagcaaatgccttttcctttattattgtttcactattcttggtccttttctcttcagtaagaattttttgatcactttgtcaaggctcatattttaaaaatcctttgagatattgaatagaagtgtgttacatttatgaattgattatggaagaattgatatcttcatatagttcagtctccccatccgttttatttaaaccctcttttatgttaacaaaagtttttagaaaattctgcatagaggttttatcattagatttatttccaaagaccttaagtttttgtagtaagaatgaatgggctctgtttttattacattttaaattggttgttgctagtgtatagacatactattaactttgtaaattaatctcgtatgtaacaaacttgttaatgtctttctaagtggttttattgttttatcaatatgttgttttagatttttctaattaaatgactacaatcgtctgtaaaaaatgaagatttttgccttttctaatttttaactttatatttattacatcatcttacggcatcaacagtaacttctctgttaaaagggccatgacagctggacatggtggctcacacctgtaatcccagcactttgggaggcctaggcaggtggatcacaaggtcaggagtttgagaccagcctggccaatatggtgaaaccctgtctctactaaaaatacaaaaattagccaggcgtggtggcacacacctgtaattccagttactccagaggctgaggcagaagaattgcttgaacccaggaggcagaggttgcagtgagctgagattgcaccactgcactccagcctgggtgacagaataagactccgtctcaaaaaaaaaaaaaagtgggggggccatgacaataagcatccttatgttgttcctgattttaaagggaacatttttaagatttcactgttaaagattttgtgtgctttaggttcagattgatcatttatgttgggttaatagttaatagtctattctattctgttcaaattctaatttgccaagatttttaattattaaaactgcaattacttttgcaccaacctagtattaataggtatttaattttattaagtgttgtttgtatatctgttgatgaatttgtgatttttatcctgtaatatgtgaattatagtaatatttcttcttctttttttaaattagagatagggtctcgctgcattgcccaggctggtctcgaactcctgagctcatgcagtcctcctgccttggtctcccaaagtgctgtgattacaggaatgagacaacacaccaagccatatttcctctctttttaaagacgttttagagacatggttttgctatgttgatcagactggagtgcaatggctagtcacaggtgtgatcatagtgcactatagcactgaaatcctaggttcaagcgattttcctgccttggcatcccgagtagctaggactataggtgcacaccaccacagctggatgatgtttcttcttttaaaataatattttaaatagtaaaaatgaagctgttaaaaaatctgaaatgtaaatttgaacccctctaaagctactctttcatttcacttccctgtttcaaagaacagtaccattcagcctaaaatcttaggagctaatctaggcattgctcacagctgcttggtgaccagatcctgtcattttcaatattgtcgttgcctctctattctttctttgttgcctaattattctccatgtacctgcaagagcagaaaattcctttgattaaaatctttcagtgattccctaatctgtagccttcacaaatttgaactccttactgtgccctataaggcccttcaagatctggcccttccttctccagccttgcaggcccttcttgttgcactctacttcccactgattcgccagcaaatcagtcattccttggggcctttatttagcattcctctctttgtctagctgtctagcagttactcatttttccaggcccagccaagccttatctacctccataatatatgtcctaacttccagatagagtagaccgttgaatctttgtacatcctcctatgccatacaaaccttaatcttttgaaattgtgtatggtctttattcatttatgtatttatttcatctactagacttgtatctagtatcttgaagtttgtgactattttattcaccattgtattcctaacacagtgaaggtattcagttcacgtataatgatgaataaacaaaagaacaagcagacaggcaatgattgagataaaagagaaagggattattccaaaaggaaaataatgaaagcaaaagccttgttaactgttaatttcattatctacattgagtcctgggtggagccttagggaactcgggaaatgattctaatgattgtctactgattgagggaaaagattccctgacctgcaatcttttgcaaatttgttgcctttttttctctctttatgaagaagctttttctattttcctctctttggggattttctttcttttgaattcatttagtcagttaatatttattgattacttgctatataccaggctcagtgctagtgctgggaactagttagatagagcctgtctctaccctggagtatctctctggctggctggggtacaaacatgtaaacaaacaaatatagcagtgattttcaaatatctttcctaattgtcttgtcatgtttttccaccatgaaacccaccttgtaaagaagattggctgttatgttctcactcataggtgggaattgaacaatgataacacttggacacaggaaggggaacatcacacactggggcctgtcgtggggtggggctggggggagggatagcattaggagatatacctaatgtaaatgacgagttaatgggtgcagcacaccaacatggcaaatgtatacatatgtaacaaacctgaacactgtgcacatgtaccctagaacttaaaatacaataataataaaaaagaagattggctgtttattggggttttaacagttgtatttggcaaacaaaagaataactggaagtaactgagaataggatgctggaaggaaattgtctgagatgccactctcctggtttatttactactgtcttcctcactttcaactgtcagcattgaaggattgtattcctcagttaggtaaaaaatatgaccaatttatctgctttaattagttagaaattagaaatttaggggccagacacagtggctcatgcctgtaatcccagcactttgggaggccaagctgggaggatcacttgaggccagagtttgagaccagcctgggcaacataacgagatcctatctccagaagcaaattttaaaaatcagccaggtgtagtggcatgcgcctgtagtcccaactacgaggcagctgaggcaggattatggcttgagcccaagaggtcgaggctacagtgagctatgatcatatcactgcgctatattccagcctgggtgacagagggagacactgtctctacaaaaaataaataaataaataaataaataaataaataaataaataaataagaaatttaggaagtatattcatctctactgattttaaagcaaaatttaattttttttttttttttttttgagatagggtcttgctctgtctcccaggctggagtgcagtgatgcaatctcagctcactgcagcctcagcctcctgggctcaagtgatcctcccacctcagcctcctgagtacctgggactacagacaagtgccaccatgccagattttttttttttttttgtaaagacagagttttgccatgttgctctggctggtctcaaactcctgggctcatgcaatccactcaccttgtgctcccaaagtgttgggattacaggtgtgaactaccatggctggctgctaaaagtaatttctttaactcctttaaaaatttttattttatgtatttacttatgagatggggactcagtttgttgaccagactggccttgaactcctggcctctagcaatcctcctgcctcagcctctcaagtagctgggattacaagtgtatataccaccacacctagatcaaacttcttttttttttttttgagacaggatcttgctgtgttacccaggctggagtacagtgtcagatggcaggatcttggcttcctgggctcaagcagtcctcctacctcagtctctctggtagctgtgcctgcagtcacatgccaccatgcctggctaattttttattttttgtagagatagggtttcactgtgttctccaggctggtattaaactcctggactccagcaatcctcccaccttggccttccaaagtgctgggattataggcatgagccactgcgcccagcatacgaacccatttttaagttgtcaaacatacacaaaagtagagagaagagcaccgtgaacatccacgtagtcatcacccagcttcagtaaccttcagcctcatgcttttcttgttttatatctcccccatctttttttgcaagagtattaggtaaaaatttcagacatatcattttactcataaatatttaagtatatatcttaacacataaggactttaaaatcataaccataatattgatatcagacccactgaaattaatattctaatagtgggtgcatttttaaaattcaaatgaatatgaaacaaccagagtccaagtaaaggaacttataccatgttctaatttaccaagtaggggatagtttggcttttaaccccaaatgtagtgggatttttttttgttattttagccagaaacatttaaaaatcatcccatcattgtcccctcttttaaaacagagtaacaaagtaagcagagtgaatgctcttaatttataattttattttcagggtattttacaatatactgtgggtgatgggaatgaatatgtgtccagcaaaacttgatattttcttatatgatgaatatttcccattttatttaaaaggcaaagctgatgggatattctttgcattatattctgaaaataaaaatcagaatccctgctgctaatggtgagactgatattctaataccctagttctaagcctagctttgaatgctttgaataagggaagtcattccttatgacttccaatagataatgctttgtttcactgatcctctttcagggattttctttgtgaggcttttcaagctaaatagaagccagtacttctgagccaaattaaaccttgcttcagccctggaaagacttgcatgtttttttaaaaagagactagggaagaaacagttattgtcatatgttttactaggctatattagtcatctcagccacgtagttctattttgctctttgcctaaaggtattaaaaattttaattaatttgtaagctgtagccatctcaagttcagttataaaataaactgatggtactttagatgtgcatttaccacttgccatcggtcttctgtgcactaaagaaagcaaaagatgacttatattttataccagaggtctttgttaatatttcacctaaaaaaattaaatatattgccttttattacttcctgtttgaacctacaatcaagtggagaaataccatgtgaaagattgtacatgttggcttctctggtagaagacattgtttgccttccattttgtacctaggggtagatttttgaggcttgcctgcttaccattaaaataagatttaaattataaaatttctttagactgcttttttggttttttttttttttttttttttttgcctgtccagtgaagttttgagctatacttgctcaaaacactgactataccttgagctctgaatgatagataagcagttagatagtaaacagagtagaattggtaaattagaaaggacccagaggaatcatctggtacttttccttcatataggatgaaggaaaccgctccaggaagtgatccttttctctaaggttttcaaagagggatgtttattcatttatttaatacttctttgtttttttttttttaaaagaagaatgctgagcctgatgctgtgtttaactctctccttagtcaccctcagcctggaatagtttctcagtctttgacttttataatgttgatacttttgaagatgacaagctagttatttagtagaatgtttctccatttgagtttgtctggtggttccttaagattagatttaggatatgtatcatgagcaagaatattatagaagtgatgctgtttttctcatcccattcattctatcagatggagtatgattttaatttgtctcattggctggtgatgcttactctgatcatttgaccaaggtgatttctgcaaggttctttatgtaaagttgctctattccccttcctgacaaataagaattttgtggcgaagtactttgaaattatataaatatccaattcctaataaaactttcaatttatttcatttatatatagaatcatgatttcctgtttattcagtattatatcttattctaccattatttattttaatgctgaaattatcccctacttggccactgggagctccttcaggatggcttttgtgtccttttgacatgtttccattattcttcaagcgtaacttgcttttggaaaagcaagatattccaggctctttttgtactttgctggcactagccctagaatcaggtatttctccaagtagccctggttctttttggtagacactgatatatagcaaccaagatctgtgcagtagatttgctcattgtttctggatatgtattgttgcttctatatcttctcagcagacagaactagggactaaacacacacacacttacatacatacatgcatacatacatacatacatacatttatacatacatacatacatacatacaaacatacatacatttatatgcatttgcacctgtatttcttcaaccccacagagctcattctagtttttcatctttctggatcctgaacttcctgataaatcccccagtatttgccaagtagccacctctttaattgtgtggttaccctcttcaccctgttaaaatgctgcatgccagattgcacccttccatggatgcctttctgacattctgcttgggctccaacacatctgtgtcaggctgccactcttcataaatgcccttattacgatgcttgggccaggtctccccaagcacatgaaaaactgcactgttttcgtgggtttggataccaaagaaaattgaatgactgaaaagtactgaagagtttaccttaaagggaggaaactagagcagaagttctccaaatgtgatctctagactcagaacatcagcaccccctgggaacttcttggaaatgcagattcttaggctccatctcagatctgaatcagaaactctggttatggggcccagcaatttgtgctttaacaagctttctagggaattctggcacatactagtgtttgagaccctctatccaaaggagagatagagtctcaacttagtattctatcctgcatctaggttatctctggcataatgaagactccctggttgtcaaggtcttggtacaattttttagggctttggagccatcctagaaatgaagtcctcccatatggatcaagactggaataattatccagttcaacccaccatccgtggaaaacccaatcctctagggaaaatcaaggaattatactcgaattaaactgtgctttgtctttttggtatagaaacattttaattaaagccttacagttaataaatatttaaaggaaggaccagaaattagtatcaaagaaataaaagttttgcagttttcatttttgtttttttgttgttgttgttgttattttgagatggagtctcactctgttgcccaggctggagtacaatggcacaatctcagctcactgcaacctccacctcctgggttcaagcaattctcctgcctcagcctcccaagtagctggggttacaggcatgcaccaccacacccagctaattttgtatttttagtagagacggggtttcaccatgtaggtcaggctggtctcgaactcctgacctcaggtgatccacctgcctcggcctcccaggtgctgggattacaggcatgagccaccacgcccggccgaaagttgtacagtttttacttattttaagctcacatctgatgtaagaatgtacagttaatgaactgttactctcccgtactggctgtgttttctacagtatcaaaaatatacttcaaggccaggcatggtggctcgcgtgtgtaatcccagcactttgggaggctgaggcaggtggatcagttgcttgagcccaggagtttgagaccagttgggcagcacagcaaaacctcatctccccaaaaaaatacaaaaaatagctgctagtggtggcatgcacctgtggtcccagctactcaggagggtaagatggtagaatggcttgagcccaggaggtcatgccttcagtaaactgagataataccactgcacgccagcctaggcaccagagtgataccctatctcattcatatatgtgtgtgtgtatgtgtgtgtatacacatatatatgcttcacaaattttacttatatatagacatagaggcttacatttcaggtaaataagataggctccgtataaagcaatttgagaataagaaagttttatctctttttcttgagtggcatgaaaagataaacaaaatactttatttacagtagagaacacagcatattcaaattcagtattgtgaccttcacctcaactggattagccaggtagtatgttacttgcttagattcctgggtcagatgtgtcctgtatcctttagcttttctgtcagcaaaaagggataattaggacacagaacctgaattttaaaatggtttcagtttaaattaaagattcccttgaattaaagctgattcccttcttaaaggtgattgatatttatgatttttcattgtctttgttctcaaggagacttttattgtcttactgcaaaatttttgtaaatatctttgagttctgttttttctgagtttatgtgattaaggttttgagaatatctagatatagtacttctgactttttccagacaagaaacaagacatataaacatatacccactcacatttacaaagcctaggagatgaagtttcacgtaatatggactttggcttaattttgtctcgttcttataaataatcctttgaaaatgtgtctcagaaaatcattaacactgaaaaaggaaatatgaaagacttagaattctgaaaattataacatagtagactttttaatttattatcatttgtgatttcaacatttttgtgggattaccttaagagccatgacactgtaacactttgtaattttgtaaaagtcctgattgtcaatatatgcccagtgagggttggtaaagaataaatcttggccaggcacagtggctcacgcctgtaatcccagcactttgggaggccgaggcgggcggatcacctgagatcaggagttcgagatcagcctgggcaacacagtgaaaccccgtctctactaaaaataaaaaattagctgagcgtggtggcacatgcctgtaatcccagctactcagaaggctgaggcaggagaatcgcttgaacctggaaggcagaggaggtggtgagccaagattgcaccattgcactccagcctggacaacaagagtaaacctccatctcaccaaaaaaaaaaaaaaaaaaaaaaaaagagtaagtcttgataagcacacttgtttttgcagtatgtagatttaaatttaactttgtttctgggtagaaaatatatccagaaaaaaagccaaccactagtgctgatattagaattgatgagaacacaaagtccaaggacatgatgatatttaccaaggaaagagcagcttctgctgggtgtagtagctcacgctggtaatctcacaactttgaaaggctgaggtaagagaatcacttgattctcttagtagttcgagaccagcctgggcaatgtggcaagacctggtctctactaaaaataagaaaattagctgggagtgctggcatagacctgtggtgccagctacacagaaggctgaggcaggcagattgcttgagcccaggaattcaagaccagcctgggcaacatggcgaaaccctgtctccacaaaaaatacaaaaattagcttggtatggtggcacatgtctgtagtcccagctcctgtggtgggaggatcacctgagcctgggaggtcaaggctgcagtgagccatgagcatgtcactgtagcactccagcctgggcaacagagcaagaccctttctcaaaaaataaataaatacattgaagcattctttgaattggcagatatatgttttgaacctaaatgactggacaccttatagagacaacaaagtgctccctaacactaacttaatcaagatgttagccagtaaatatttgcttatgaaaagatgaaactttactaagaattagaaagtagcagagcttattactttgatcccatgtttatataaatcactttctttttttaattattaatttgcattttatagcttcaattatataattacatgttacactataagtgacatttgaaaaaattgtcttaggacaactgtcatatacatcaaggtctgtagtgagaatgaggaaggaccataatttttataagattaattttttttttttttttttttttttgtgagatggagccttgctctgttgcccaggctggagtgcagtggtatgatctcggctcactgcaacctccacctctgagttcaagcgattcttctgcctcagcctcctgagcagctgtgactacaggctcctgccaccacgcccgggtaatttttgtatttttagtagagatagggtttcaccgtgttggccaggctggcctcaaactcctgacctcaggtgatctacccgcttcggcctcccaaagtgctgggattacaggcgtgagctaccaagcccagccaagattaatttttttttctttttgagacagagttttgctcttgttgcccaggctggagtgcaatggtgtgatctcgactcactgcaacctctgcctccctggttcaggcaatttccttgcctcagcctcacaagtagctgggataataggtgcccgccaccacaccccgctgatttttttcatttttagtagagatggggtttcaccatgttggccaggctggtctcaaactcctaacctcaggcgatccacctgcctcggcctcccaaagtgctgggattacaggcatgagccaccgcatccagcccaagattaatttttaaatagcaatacttcattaaatatatatatatatatcttgcagttagaaactgtcataaatgtattacagtgcttggtgctggtttgttttgttttgttgtttgtttgtttgtttgagatggagtcttgctttatcacccaggctggagtgcagtggcacgatctcagctccctgcaaccttcacctcccgggttcaagtgattctcctgcctcagcctcccaagtagctgggattacaggcgcccgccaccaagcccagctaatttttttttctttcttttttttgtattttagtagagatggggtttcatcatgttggtcaggctggtctcaaactcctgacctcgtgatctgcccgcctcagcctcccaaagtgctaggattacaggcatgagccaccgtgcctgtcacatttcaggttattaatgagtatatttcccttgagctaaaagcatataacacagatttccatctataaataattttacatatgtattccaaagcccttggatgtagaggggaaatgggtaatatttagcaaattccagcctgtccttttcaattactaaagaaatacaggtatacctcactacttgaattcaggtgatttggatagcaatactgtatgtctgtagatttctctgctaaggcttatgtctagattttaccacattcaccaggcttagtgttcccaccctgtgggtagctgacatcttcacatagtttcttgtaataaaatataattaaatagtgtttaaatgttaaattagattcttcctccctctctttccctttctccatccatcctcagtttaattagttacccagtactttttccacacccaccatttggaggaagtttgtgacagagtgagttgatgagggtacttttgatttcactgtgtttcctattgcagtcattctctgaaaaatgatcaaagacattggaattatgaaagacagcaacagactcggcttcagaagatcccattgagtgtttttccttgcgctagttatatagtcagtttcccccttgtaaattattacagtgggggatttattagggaaaacatcatttaaaaattttaacggccgtgataaactgtcatttgcagttctcagctgacagtcaaacagctgcaatctgttagtgagcttttactttcagctgccagaggtctttcaactcctgttcccctggaaatgaggagggctgggctggacgcatagaagggaagtgagggttgaaatacacattttcccataccatatttttcatgcctccccacagtttccatagaaatgggaacataaataacaccccaccccagactttgaagagcaatcgtttatgtgtaaactgcagtagatggaccttaaagaggcacacaaaataagctaatcttagggtctttcctttacttgtgtttggccaagcctaatttcagatagattctcatttgatttactctgtacttaaaaaatgattcgatttttttaaatcaatttttagaaagtttgatattacctttttttctgaaatgagaattatcttgaacatactttgattgataggtatatatctgttgtttatgtgttaaaaatctagcaagcttggtgttctaactttcctctcatgtttgttctatccaagattaaagaaatgaattttgggccaggtgtagtggctcatgcctgtaatcccagcactttgggagactgaggcaggcaaatcacttcagatgaggaatttgagaccagcctggccaacatggcgaaaccccgtctctactaaaaaagtacaaaaattagctgggtgtggtggtgcgtgcctgttaccatctacttgggaggctgaggcagaagaattgcttgaacccaagaagcggaggttgcagtaagctgagattgcgccagcctgggtgatacagcgagactctgtctcacaaaaaaaaaaaaaaagaaaaaaagaaatgagttttgatttagggaatgctccaattgcatagtataaaaggtcttctcaaatagtcttattcttatgcattattttagaaattgccccacagaacagaggtaattattggctctgtcaaacatatcagagaaaacttccaaatttaattggttatcacaattttctcatttaggtaacaagaatatcctatgttaaatgcatttctatgtttttccacttatcagctctgtgtcatcacatatttcctgtaacacccgtacttgaggaaaatgtatgggcatagtctttatctgtttcttttattccaacatttaactaattaacaaattccatttgaatcatgagacagtaagaatatgtgtaattgagtaaatctgctttaggcatctactaagtattcagctttatgttaggttgcagtagataccaactgtaagtaaggcagaattttttccttaaggcatcccaatggagtttggaaaattcataccccaggaatagctcataacagccatatgtgattattacatgagtgacatagactgattcccatgactaggaaaacttgtttcctttccctttctactgtcacctttttcacaaagtccctttctcctgatttattttcataacttcctaaatgtcctttcaattgctacctttctccttttgtttgtttgtttgtttcttttttttttttttctgagacaggatcctgctctgtcacccaggctggaatgcagttgcacgatcaatcatagctcactgcaacctcaaacttatgggcttaagggattcttctgcctcagcctctggagtagctgggactacaggcacataccactgaccatgcctggctaatttttttttaaaattttttgtagagatggggtctcgctttgttgcccaggctggtcttgaactcttgagctcaagtgatcctttcatctcagcctcccaaaatactagaatcacaagcgtgagccactgcacctaaccctttcttcttttctttatcttcccttctactttagcatatacatgatttccagattcatatttgtaaaaccagtcttgatccttttactattttaaaacctcagtgatctcttcacatcattgtgacaagatttttcttttaaaagacagttctaacgtcagatattctgcctcataagcctggctaccaaaacaatccaaaaacttttattattttaggttctttcatattccaaattgcttctcatatccagaatggatgcaaacatctgttaagaccatctgcctggtttttatttcagaaaatatggtcactgagctagcaactaccaaaataggttcatgctttcagcgattggcagcaacctagacagtcttcattctggcttcagtgtattccttccggcctgctctgcaggtaccttatgccaggtcatctagctcctcacccaaacagaactgcttagcacattcagtaggcccacattttgtagctccatgcctttgcttacagaagtttcctttaggtatgaggaaagatagaagcaataacaagttgttccttccatctggaacttcttgtccctccctatacccctctcatagccctatcctactgtaatacaatctgtaatttacattaaaacaccccagtctacacagcgtgttagttagtctacaccttggatgtgagtgattaacatttgaaacactgataagggaatacatagtgtaagggtagttgtttggcattggaaataccctaatgaggagataactactgtaaatttaacctgcttatctttaaatctacaccagagagttttctagttagcataaaggatgtcagaaataatttcaaattggattgattagaaataccatacaggttcctctggcacatgaattgctcataagattctggcaagccaggtagcctaatgcctgcacagtgtcacccgaggcagagcactgttcgggcctgttgactatcacctaacagaagatgcttcctacctggtagaaaggtagtgaggagacctatggccatgcctgtcttcagtctttggaggcactgatatataccctcctcctcccccaccaaaacgaaacaaaacaaaacaaaacaaaacaaaacaaaaccctgacacttcggaatggtcaatagcaaaacctccctccaggacgatgcttacatgctatctcttccttaaagtctatcctaaatttcctgatggatttgtgaactcattctcctctacaccatcatagaatgaggcttatatttctgttatggcattaataaaattttaaaatttattgtaagtttcttgatgaaaggactgtgtcataactttctttgtatcccacatagcatgtggcatagtgtcttgtacacagtagatatttattataatgagcacatgcatgtacttaccaattctgtaaggaacagatccagctttgggtcatagggacactgggagccaatgtgtgagttcttagagttccattaattcactgttcatagttctaagggagtcaggagtaattgtccataactacatggctctagttagccattagtgcaaagacacactgggactgatgtcaacagcagaggaaagtagtgctgtctatgttgtcttctttcagaaactcatacctaaatgtatttcatactgctgttcggccaaatctggctctagataataaagaaggacaaatatttagggcagttatttctcttgttctatatttcctagccaatttgaagcagtatatataactaaccaagtacaccaggagaaaagtaaaggaggtgcaattatagcacacagatttaaaaaacaaagcaaaataaaacatttaatgttagtaagatgatagtatagtataatagttcaaagcaaggatattaaacccagactgcctgggttcaaattaatccccactttactagctgtgtggccttgggcaagctatttaacctttctgtgcctttgttcttcttctgtaaaatgaagatgatagaacagcacctacttcagagatgtgaggctaaaatgaattcatacatgtaaagcatatagcactcagtgcctggcacataggaagtgctggatgtgtttgctgttcctgcagtgatatggttaaatcatagctccaaaggcagaagtatgctaatttcagtcagtgtgcagtccttctgtctgtgtgctttgcagttctccgcctccaactgagtaatcttaatgccttgaagcccccaaatattggtgcttatacctttcttgtggaacctgtcacattctaccctaaattatataattatttgtaagctccttaaaagcagaaactatcttctttgtcttcctctcagcacccagcagaatgattacataacagccttgcttacacaatagctctttgctaactatttggggaaactatgaacctctgtgaggttggtccctggaggccctgcaccttggactggttcctgtgtacctctcgtactcttcagctagcaatccctctcctcactgtgctccagcaactggccttaagtcccttaaacatgcatccttttccaaaactggcttgatgtgtgtgtgacctgtgcagtcacataggtcctcatacttggttgaatgctctatcactagcttgaaattcttagtttttgtgttcaatttttatcttgcactgagcctgcaaattatgtagccggtcttgctcttggtcatcctgtgctcattgttccctgtgcctggaacaccctttctccctaatcctcactggctaacctactcttcaaggctcagcttcattgtcattcctcagagaagcaataaaaattagagccatgtattagtatccctccacattttcttctccctcagagcacttaacttactttgtaaatacagtatttatttatattgtgattatttcttttaagactttatcccaggctgggtgcggtggctcatgcctgtaatcccagcactttgggaggctgaggtaggcggatcacgaggtcaggagttcgagaccagcctggccaacatggtgaaacctggtctctactaaaaatacaaaattagccagatgtggtggcgggcacctgtaatcccagctgctcaggaggctgagacaggagaaacccttgaacccaggaggtggaggttgcagtgagccgagatcacgccactgcactccagccggcgcgacagtgcgagactccatctcaaaaaaaaagactttctccccaccagactgtaaactcctccaggggatagactgtgcctttgttccaggacggctttacctgctacatagtaaatagtaaataaatatttgttgagtgagtgaatgaataaatcatttttagaaatgccaagttgtggccagatgcaatggctcacgcctataatcccagcactatggaaggcttaggtgggcggatcacttggggtcaagagttcaagaccagcctggccaacatggcgaaaccctgtctctactaaaagtataaaaaaattagccaggtgtggtggtgtgcacctgtaatcctagctacttactcgggaggctgaggccggagaatcgcttgaacccaggaggtggagcttgcagtgagccaagattactccactgcattccagcctgggcaacagaacaagactgtctcaaaaaaaaaaaaaaaaaaaaagcaaagttgtatggataagcttttcttcccaagctaaaaagttgatgtataaaaatagcaattcaaggccaggtgtagtggcttacacctgtaatgccagcactttgggaggccaaagtgtacagatcacttgagcccaggagttcaagaccagctggggcaacacagtgaaaccccacctctacaaagaaatcagccaggcttggtgacttacacctgtggtcccaactactcaggaggctgaggtgagaggatttcttgagcctggaaagtcaaggctgaagtgagctgtgattgcaccactgcactccagcctgagcaacagagtgagaccctgtctcaaaaaattaaaaaaaaaaaaaaaaaaaagtcagtgcaatcttcatgcaatttaatattgctagtgatgacttttaaccagttctacttactgtctttatagatggatgaatacagtaaaattccccatttttcttttccactgtttgttcttctcatataatctggtatagtaaagttgaatctctctaaagtcagatttactcaggttgtcttatacattagtttcaaattaaatttcttagagcataaatgtctacagccttctgtctcttgtatttttagcaagcgacatgtatttacttttgatctaattgccagcgacaattgacataaaagtaatgcttcaggtttcttagcattttatggtggaaaggccagtactatgataatgaagttaacacttgataataatagagaacagtgtcctacttggttttcccatcattctttctctcctctcttattgtctgtgttcaaatagtttaattaactcactctgaatgcacagctgtatcagctttctgtggtccaattttggaactatatctgtttattctactccctggaatcacaccaatacaattcaacatgtaaccagatttaatgcttgccatcttactgtctcaatttttagtgcttggtagtcattccattactctccaaatactgtactaaaatttttaagtgataaatttctaaccaaaaacttatttacaaatggatttctacttgagatttacaatggattttgagcacctcccccaaaagaaataaaaaacatccaacatggtatactaacttgatattattgcttcttaatttttgcaaagaggaaaagaatcagaatttgcataatttagccccacattgagaataatcaatacagtgagagaagaatttttattgcttaaaagaaaaacaggctaaatgtcctttttttttttccttcaagtgtaaggaatctgagaaaaacagattttaaaaccaatagaaggaatggttatgatccagcagcaactgctgcatgtgggtgaagaaaagaacccagcattatttgtacaaatccataagggatgcagtgggaacagaaagaaacaaggaagtataggaaatagagaagaagggcactcagtgaagatgtaggcctcaaaaaatgttccatctaagcactgactgattccagtaccttaaggtgatctgctttaagctataaatcttctgagtggtttatgctctcaatgcttttttttcagaaggctgtgagaggaggaaaaatatattattttcagtctgccccctcttaagactttatggaattttaagcaggcttctcctagagttaaattcctgattcaaccaccccagagtctatttggctatctgtctctctctctctctcttttttttttttcctagcttgcccagaaagattaaagtaaaggtattctttctttttcttttttctttttaatctcctacgttatgcctggtaatgtggcagatatcttaggttcattacctctcagttatgcattaacagcacctccatccttgagctgattagctcagttaactgctgcaggctactgacgaggcttatcaaaggtcctaggtttgagagctatgcatgttggctagatgacaggcaatgtagatgatagtcatgtaacatagtgtatgactaaggctttaactttggtgtcaaaaagaccttttgggtagctgggtgcaggggcatgttcctgtagtcccagctacttgggaggttgagtcaggaggacttcttgagcccaggagttcatagccagcctggcaacatagtgagacccaatctcttaaaacaaaagcctatagggtctgtcattattatagggcctgtgtgtgttacttagtctttcttggtttactcaatttataaaacggatatagtaacacccagtttctttgtgaggcttaagaaatataaaaaatgctaaatgatggctgggcactgtggctcacgcctgtcatcctagcactttgagaggccgaggcaggtggatcacctgaggtcaggagtttgagaccagcctagccaacatggtaaaaccccatctctactaaaaatacaaaaattagccaagtgtggtggcaggcgcttgtaatcccagttactcgggaggctgaggcaggagaatcgcttgaactcagtgggcagaggttgcagtgagccgagatcatgccacttcactccagcctgggcaaaagagcgagactccatctcaaaaaaaaaaaaaaaaaatatatatatatatatatatatatgtgtgtgtgtgtgtgtgtgtgtgtgtgtgtgtgtgtgtgtatatatatgtatatatatatgtatgtatgtgttcagtgcttaggtcagtgctgcagcatgcattttgtgctcaattaaaggagatggtcatcgtagttgtttgtgttaccctattacaaaacataaacaattcaagttctgagtaagaggtttaagtaaattgctcataaaattatatagctagtatttggcagagaaagttttcaaatgcaagcgtgtttaatttttttctttttttttttttcagacagtttcactgagctaatttttgtatttttagtagagacagggtttcaccatgttgatcaggctggtctcaaactctcaaactcctgacctcaggtgatccacctgcctcagcctcccaaagtgctgggattatgggattacaggcgtgagctaccatgcccagccaagcctgtttaatttctttctttctttcgtttttttgttgagatggagtttcgctcctgtcacccaggctggagtacaatgccgcgatcttggctcactgcagcctcagcctcctgggttcaagcgattctcctgcctcagcctcccgagtagctgggattataggcatgagccactgtgcctggctaatgtttttgtatttttagtagagatggggttccaccatgttggccaggctggtctcaaactcccgacctcaggtgacctacttgcctcagcttcccaaagtgctgggattacaggtgtaagccaccgcacccagccagcctgtttaatttctaaaccacctcaaataaagtatcaaagagaaactgctgttcaaataattgtgctcgaagaatatggtttttctcttctttaaaacttgattttattcttatatccaagctgcttatataaatagattcttgaaatattttgggacactaaaatagtccttcctgatcttacaaatttcttctctcctaaaatttatgtataaattggttgtttgaaactcagaatggatattcccttaggaagtggtggttgtgttctcaggccaattcataaaagcttctctagcctgtctcttctccctttctagtgcttaatgtttagttcagtggttttcagatggacagtatatcaaaactgcctgagtagctttgtaaagataaaggtacttgaacaaaaaaaaaatgagaaagaatgagtaagacctcgtgtatgatagcgcagcaggatgactatagtcaataataattaattgtacatttaaaaataactaaaagagtataattgggctgggtgcagtggctcacatctgtaatcccagcactttgggaggctgaggaggtcagatcacttgagcccagggtttcaagaccagcctggtcaacatagcgagaccctgtctttacaaaaaatacaaaaaattagccaggtatggtggcgggtgcttgtagtcccagctacaggctaagaggtgggactatcacttgagcccaggaggtcgaggctacagtgagcggcactgcacttcagccgcagccacagagcgagaccctgcctcaaaaaaaaaaaaaaaaaaaaaaaggagtgtaactggcttctttgtaacacaaaggatcaatgcttgaggggatcgctaccccattttacctgatttgattatgacacattacatgccagtttcaaactatctcttgtaccccatatatagattaaattactatgtatccacaaatattaagattaaaaaaaagataaaggtgactgatcatacctcagatcttctgaatcagaattttagggtgaatgtgctcgatccatcccagcagaagcctgaggcaggggaggcatgatgtagtaaaggtactagaagaagtcctgtgtggctggagcagagaccggttgtctttaaactcttgattgtgatccttgtgaatgaaagtcatatgagccgataccaccaatatatgtatattcatttttaaataaattagccacctgtactacaataagcacaaatattttttaaaagatgaaataaaaatagtccttcctgactattttcatattctaaaaacagaacatgaaattctaataatcaccttttgctttctgtacctatttggatagttttatgtactttctgggatggacaaaccacacttttgcaaaatataggcaaagagagtgaagggaaggtagatagagactagattctgtaggaccagcagagccaagtatttctctatcctaagtgcaataggaagcaattggaaaatgttaggaaggaaaatgatgtcagatttgcatcctggaaaaaattactttggctgcccaatagcaaaaagatttagtacagcaactatgaacatggggagtccactttggaatttatggcactagttctgatgaaaggtgattatgccttgaattgggcattgccagtgaagtttaaaagaaaaacaagatagatatttttgaggcgtacagtatagaatctagtgatggattgcctgagcattggttgggggagcagacaatggtgacttgtgggtttctggcttgagcttctggatggaagatgaacagtgggagaagaacaaattgggggtagaaggtggggtattagtccaggtttaaatatcttgaatgttaaccatccaaatgatgataggaagttcacaattggatatgcaggctaagcttagtagaagttctgggcagaaaactataaatttaggagttgtcaacacatagtacagaaattcctctacctccagatattatttattgataggaaatatctaaagcagaagtgccaaggagttccacaaaaatattatacaagattagacttacaggactgaagatgaggaattaaaaatgaacaggtaagcagattctataaaatgcaagtctcccaaaattgctacagcattgggaccacagcttatactagaatgtggcaaataaagtacaaatcagtatttcagaagctctcaaagatactttgatgagcatgctacattctggagtaagccacaaacattggaaagtggctcatgtcatataagtattcatgaataaaggtccaggtacatgtcacaagtgtgcacaccactaggattgagtaattgggaaagctagacatgtcagatgagattaaaacaagtacagcaccatagattgtatgttagtatgaattcaggaggagaatgcctgggaatttgatgtctgtaagaagccttggaaattatgttagagttgcaagagagaagtatgtcctttgtccccacccccttaaaccattatgttccttaagtattagaatacaactaataatcatttacaggctctaacattctctgaaggtttcctcctgcacccaagacacatggggcaaaatatcattgtttaatatgttccctctcctcctagtgctaaaagcttaaaaggagtcaaagtgacttcttttgctgaccactatgaagaggattaagtgaagcctatagggcgtgttcctcctcttgatggatgccttctcctgattccttttcatctgtttcttctcgagtgcattatactactgcaaactgttagaattttggttgccactgatccactttatgtccagatcttgataagtccttgcaaaaataactgtgactctgacttggaaactctcagtaacccccaaatttccaaggaaagtgatactatattacatttctattttttctctgtccattgattaatatattaaatgagataatttatattcatcctaagaaactgtctgaagtgagcaagagtagcacataatggctagcacctttggcctattaattttctaggcacctgaactgagcaccaggaatcttcacttctgaaaatgttaacttgggtcatatcagcctttaaaaaagaaaaacacagtgatgtactttaccagtatttgcatccataaattaatatttttgtatctttcatttctgaattacagaagcagattcatcaaaccctgaatgatagctcttacaagtgactggcccaatgttaaaactgagcacaggagaaatgctctgtgttttaactgggcaaggaagcttgcataaaccagtcatcatgaaaatcctcctcactgaggtgcttctccctctccaaccctctgtcccacaaatttcttcttgatcatctttgtaccttttataaatatctgttattgcgcttatgaaactagatgataactagacacatatttggcactacgtctagactgtcagcttcttgagcagctttactttaatcatctggtcccaggcagtagagcaaagtggttaaagagggcaggctctggaggccaactggatttcatttctgtatgatcttgggcaagttacctatcctcaacttatttgtaaaatccaaataatacttccctcatggagttgctggcaggattaaatatagatttttctaaattaataggcttaaaactgttaggaaattttttgacttgaaggaattacatacttagtggcaattactgctaaccaataacaaagcagagggaagtggacatctgaatacatcaatgcagtgctaaaaaccttgcacactggtccaggcctctcttcttgtctttattgatagtttagctcagaggcttttagtatgaatcccacatcttctcaagcatgtacccctcaaacctaccagcccccaacatccacacctggtttagaaaggtttgtaggcatcctgtttgtcacagtgacaggcagccgctactgacatttaataggtgaaatcataaatgggcccagggatgccatgggctcagaaatggagagcggagtctacaccaaaaattattccacccaaaatgccaataatatcttaccttgagaaacactggtagtgcccagggtcttttctctactaaaatgcaaaaccaacttttcacaaaattaatatactatttcataaagtcagaatatgccaaagatcatgccatatatattacagagcatagatcaacttgaaaaatctttacgtatgtattctgttatttctcttttctgtgtgtaagttcttttcaagttactacagtgagtttcaaatttgttatttaagagttctattattctgttcattatgatccgaagtttaagatctgcggtgttgaaaagcactcctaaatatacaaagcccttgaactcctaaataaacaaagcccttgaactcctaaatgtacaaagatcttgtttgggccaggcctggtggctcacacctgtaatcccagcactttgggaggctgaggtgggaagattgcttgagccttggattttgagaccagcctgggcaacatagtgagaccctggctctaccaaaaaaaaaaaaaaaaaaaaaaaaagctaggcatggtggtgtgcccctatagtcccagctactcaggaagctaaggtgggaggatcacctgagtccaggaatttggggctgcagtgtgctgtgattgcgccactgcactccagcctgagcaacagaacaagaccctgtctcttaaaaaaaaaaatgatgattgagtttgataatcaggaaacttaaccaaatcttatatgtaagcaaataaatatgtttttatttgtttgttttattttgagacagggtctcactctgtcacctaggctggagtgcagtggcatgattttacctcattgcaacccagcctcccaggctcaggtgatcctcccacctcagcctcccaagtagctgggtctacaggcatgtgccacgatgctcagctaatttttgtatgttttgtaaacacaggttttcaccattttgtccaggctggtcttgaactcctgaactcaagtgatccacccaccttgacttcccacagggctgggattataggcatgagccaccacacctggccaaaataagttttattagaaataactcactttgggaggctgaggagggcagatcacttgaggttaggagttcaagagcagcctggccaacatggggaaactccatctcaaataaaatacaaaaattagctaggcatgggtggcatgcaaaaaaaaaaaaaaaaagaactaatgcatgtgaaattcaaatattagtaagtattcaaaataagatatgaaagtaagaatacaaaatagggtgatatcactggttgatatgattagtgagatgaacattattaaggcaaattcttccgataattattgttatacaacatgattaatatatattcagtctgaaagagtcatatatacaaatatgaaataaacacctcaaatgagaagaagagagaaaacatggagaatgaagaaagttgggtgtattcttttcagtcttcccctcccatatctccgtctgaggccagcatggctaatattgagaaagagtaaggcaaatgagtaattattgtgctctgtcttttactgttattgaaggtcactgtttaacactccctcgccattcccctaaccactcccctttgccttaaattcattaagctgtattctttgtatttcctgataacagctgacaaggacccactctcatctgtaatgacaggtgagggtattgatgataagtagagttaataaagcttctccagtgatttagaattataacgctctgagtattatcatcaggggaatagatgaaaaagcccatttcattttgtgcagtgtccttcaaactgctggttatgaaatcattttagagggtctgtgaaatcactgtggaatacgatgaaacgtaatagaaagtatcagcagacactgtgggagatcggtcagagcggtggggaaaaactatagggaaaggacgcaaaccttctgaaaggtcagaaggttctgcagagccccaggggagaatagctgaaggcagctgttctgtaaccctgaggcattgggcaaggagtaggtacaaggcagtgtaggggaatttatcttaaacaaacttgtttacttatgttgaccaggaactgacctttgatcatccgtggggacggtccccctgaaaggggaacaataaatgttaattacctaagaggtttttaaatttctttctccagaaagaaaaatttcaagcgtctgaatcccattcagtattctctaaaataaaatcaagtttgtcctgaaagatggtttaaaaactgaaaatctattttctttgattacctcataaataacaagagtttcatatcagctctcctgtctcttcctcctccactcttttcccctctttcacattgtgccaatcacacaggtggatgctcagtatcaccccacagcacaagataaataagcttggaaggtttcctagcaacatattgttctgggaacctgctctgtttccctgaacaagatgaagccaaatatcctagaatctcagccagatgggaaaggattagcttattgagagtgttattgccttttttaaaaaaatgtttcactttgaaatgaacctcttaatataagtagcaaaagtgacttttaaaaggacatgtaaaaatatccctttaaaaggacatttttttctcttacatgtaaaaaaaaattgataatagtttgaagtttaaaaatatggtttcagaattctctaggcacaagcttccagtatgtaattcagtcactggtgagtggatccattttagaaccatgtagaaaatacttccacatggaactaattctcagcctggtgtccagtggtatggtattcctgctgtaaaaatactgaaatacttccgatctggtgggaaaatggctcctggagtaggctctctcctcacaatacctttagctgctccccttggcccttgtttctgctcctagggaaacattggagacaccttgttactgcttaaaaccctgaagcttcccctttttctatagctccagggctattttagtgctagtgatttgcaacttcatcttcagagtctatttttggttttctcagtgtatgattaatgtatatagagaaaataaaagaaattgagactgctatcaaagccaagaaaaataatgttgtcgttttgttaacacatgattgtgtatatttcccttgtttatctaatgatctgtgaggctacacagttggcaggtggtgctttcctttctattgcactctagttggtcacagtatacttgttagaggtctctggagatggagtaataaaggattcgtgtttctcataacaatattcagcagtggctttgcaattcagttacaccctggaaaatgtcctcactccttgtttggctggggagacattcccccatcagccagatgaatattctcataatgtggttgttgactggtttctatcatctatcaggtttggactgagtttgtgaaacttcccaattgtggtgagaagcagataattctagtacttcatagtgttcctggataagaagaacaaagtaattagaataagatggggaatgacacctggagtctttgttttttatgtaacaaattatctggccagatgccagagaattagtactgtcctcattttaatgaaaataaggaaattgtgagataattttatattcatgctagatgctttccattctcttttgctctctcactcatatgtatatgttttctaaataccatattttaaactcaacaaggaacaatctgttgagggcctagtatgagccaaatactgctaggtattatggcagatactgagggcaacacatcatccttgccttctcagagtacgcaagaagtttgcaacatagcacgtttgtaatcttaaaccaaacaaaaacattaaggaaaggtgttgctgtgtaaaggaatcataggctaggcacagtggctcaggcctgtaatcccaatgctttgggaggctgaggaaggaggatcgcttcagcccaggagtttgagaccagcctaggcaacatagccagaccccatctctacaaaagttaaaataaaataatataagtaagggaattctataactttgattgtccaaagaaaggctaaaagtagatttaatatgtattatggaacagaataagttctaatacgttaattttgattgaatacttattttaaaaaaaattttaaaaatgtccataaaccaggcattgttttagatacctctctgttaactcatttaattctcctgacaccattatgaggtagaaattttgtttacctgctattttatagatgaagaaactgaggctaagagagtttttttgtttgtttgttttaaaagacagggtctcattctgttgcccaggctggagtaagtggccgtcatagtgcactgcagcctggaacttgtgcgctcaagcaattcttctgtctcaacctccaagtagctgggactatagatgtgcaccactgtcccctaagagaggttaaatatctgtttactgagggcttttatactacgctgtgcttatttgtttatttttaaaattctaagagtccataggaatctagtcttttttcagaaaatagtaaactactgtcttttgtggatgacataattttagcaagaaataaatgggttgtttagatgactttctattatctcatacagcataatgattctatatttgagttttcattgtcaaacactaaaacctcctttgttttcagtgtactaactccattttagaatatttttctcttctcttctttttttttttttttgagactgagtctcgctctatcacccaggctggagtgcagtggtacaatcttggttcaccgcaacctcagcttcccaggttcaagccaggctcatgcctcagcctccagagtagctgggattacagatgcccaccaccatgccccgctaatttttgtaattttagtagagaccgggtttcaccatgttggccaggctggtctcgaactcctgacctcaagtgatccgcccacctcagcctcccaaagtgctgggattacaggcatgagccaccacgcccaggccattttagaatatttcttgtagctcaattttttacttatataaaataataattttcattttcaacataatagaaggatatgagtgaattatatttaagaaagttaaaattaatagcactattaaatacattaacaagagaaggttgtgacatcagcaatattatttataacagaggtggacaaactgtagcctgtttctgtaaattaagttttcttggaacacagccaggctcatttgtttaggtatcacccatggcaggttttgtataataatgacagagttgaatctttgcaacttagactatatggcccacaaggcctaaaatatatactgtctggacctttacaggaaaagtttgccaacctctactctggaatctctatttttctcctaactttgagttgagcatgttcccttagaatgccagaaatttaactagcaaacacacctgaattttttttcataaatggtgtccttgtctaacatggttttcctcaaatccctgcaggtaccaaccaagaagctgaagaaatatgagaaagaatatcagacaatgcgagagagtcagctgcaacaggaagacccaatggatagatacaaggtatgagaaatatgttgcacctatcaaagtaccttcttttttgttttaaatgagactgagtcttgccgtgttgcccaggctggtcttgaacacctggcctcaagcaatcctcccactccagtctcccaagtagctgggattacaggcacgagccaccattcccagcaaagtacctttttttttttttttttttttttcttaaagcagcagttgtggcaagttcaattccctctgttcttccttgattgatttagatgctctctgatcatgctaactgtccaggtatgttttcatttcaggagactcccaaatagccaaccataatatttcttttctttcagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtagtggtgtttgttgcaacatttatttccacaaatgaatttatgaacaacagtgatatttgagttaaagtatgaagtttcagaatcaaaataatttcattttaatacgttcgttaattgtgaatctcttcaatggtaattagcaacactgttcccaggatgcaaagttgggaaacacttatttccaacttatttttttccaagtaaaatattatctctcttcaacatgctttaacttttcagactcacacagatacgtaacagctccttctccctccatatcaatacactaagataaaagaatactgtattttcagcactgagcagcagtgccaaaatctcctgccaagaaatggactgtgtggcattattaattaaatcacccacattgggatgacttccacttttgtaactagagttatctttatgtggtcagagctggacataggcagcatagtcacacagaacatcttatctctgttgctgaattgaatagcatgggatgtgtgcagaggaacatggtgggagtatgtaggttttgtagtcagacagacctgaactcaaatcttgctcattttttagagcacaggatttggactccaaattgagggttttaatccccatgccaccattcagcatcttcgactagttattgaacctcttcctcatctataaaagatatagtgtttctgattccttgatggattgttacaaggatgagggatgctgtatgttaaggactcagctcatagttgtgttcaataaatggctgttattttatgaagcctactactacagattatgcaattattactagaataatgccaccttatgtgggtcttcccctctagtcccttattgattgttcttatttctctcaagtattgccaaccaataatctccccttgcttatagaagtggttcaagatctgattataaaatcccacatacttctatagcagataactattaacagataatgtttgaagctaattttcaccaccaacatcccctcaataaaaccagcttttaatgtaaatcacatagcatgctgctttagaaaggcttgaaggtagtaattataaactattattaagcatccaaaatgaaggtctccttttgctaatatcattcagattttcttattactacaattattatgaataaattctgtgaagagtgctttaaaataagagagaaatggaagaccaaacttgtacatttaaaatcaggctggaattgaacttgttattgtgtcttaaatccttttttgtgccaaagcaggtatgtatacattaatagtaagatgtacattatttttaaagtacttataacatgtaagattatcaatatgtatagtttttattgagagatcaaagtaggattaaacttcttgttttgaaagcaggcattactttttaagttcaagtattgttgattcttatttacacatatcggataccctctattgctatttcttttagattattgtgataacttgtcagtacattcatctaatgtctctatactcttaataatgtctaggcatttgtcctggtaatacacttggtgaatttatagttcttagattataattacatcttcaaggtggcagtcaacaacataagtttctaaccatcaacatatttggtttgtaagatgatcaatatgcagtttaagaagccatattataattatcttaattaaagtagcaaagttagaaaataccttttacatcttctaaatttaatcctatgaagaataagatctctgtcctgggaatgagcactttgtaattcatagatcttggactgggaacccagttaatgtaaactcttaaaagactgacttgggaagatctttgagggcattgagtgagaacttgcaccagttcagtaacaacccctcctcaacattagaatctatattgcttaaaaagtcatttccacaccctagcttgccatatgacaagagagttagaaggttgtgggaaatttattttttaaagcccacatatgttatataataagatattttaagaggtatttcagttcagtgctatttcttttggacatggtggcatatgtaaaagggctatcacagggaacctagaggtgggaatacagatccagcaatgtgaggtagctctcaacagtcatacttcttgctacatctatgtaaacatgtgttttatgtctatttttatgacatatgcagatatcttcatggttaggttatatcgctgtagtcacctttattcaacacttaaatctcaaccacaaagagatgaaataatgttagtataaatttaaattttaaaactcgacatatcttgaaaatcttctggaattaggaagtagtgatgattgcacaactttgtgaatatactaaaatcattacattgcacattttaaaaacatgaattttatggtatgtgaattacatctccaaagaaaaaaaaaagcagaatattccaggaggattgtcatttagcctacccttttcctttcatgaaccctaaatcacaccagaggtacctgtttagaagcaggagggagagcttcctgttgaaattagagctaattagtgactattgatcttatatgtgtccatatttgcagaataaaagccaacacagtgggtggtacattaatttttagtgatgcccattaatttccaggtagaacatatgttgtacattatatgtatacacacatataaacatatataagtaggtaatacacacacatatatgcactgcctgtgctacctggtcttggcatcagtttatattttaaactcagtgaacaccataatgactgctttatagcctttactctttctgtttttcttcatgactagattccaagagacagaaaggaaacttttttgaaagaacaatgtagaatgtttatttcaaatctcttttatcctctttcttaacttgcacctgaccaggtttgtgtaaaattctttgtctactctaacattttggtttgtaaatttagtgattgatttctaatgaagtgaaattaggataaagatttgactgtagaataagcatgttttcatttttatacaggttcccagaagacacacatttatcaatatgtgtagctgttttagtatattttagaaactagtaactaagcccttaataagcaaagttaccaatttcagaaattaaaatactttctatcttaaagagatgaattgtttctgttgtgaggaaagttttctagtgatggtatcagttgctggtactttttggagatctgtagccttcatctacctttggagaacgatatgcttttctggtttaattaaataactatttgcacaaatgtgagttaaggcttaaaaacacagctaattggccgggcatggtggctcttgcctgtaatcccagcactttgggaggccgaggtgggtggatcacttgaggtcaggagttccagaccagcctggccaacatggtgaaatgctgcttctactaaaaaatataaaaattagctgggtgtgctggcaagcacctgtagtcccagctactcgagaggctgaggcatgagaatcgcttgagcctgggagggggaggttgcagtgagccaagatcatgccactgcactccagcgtgggcaatagagccagactctgtctcaaaaaaaaaaaaaaaaaaaaaaaagaaacgaccaggtgcagcagctcacgcctgtaatcccagcactttgggaggcagaggtgggcagatcacaaggtcaggagaatcgagaccatcctggctaacatggtgaaaccccatctctactaaaaaataaataaataaaaatataaaaaaaaattagccaggcgtggtggtgggcacctgtagtcccagctacttgggaggctgaggcaggagaatggtgtgaacccaagaggcggagtttacagtgagccaggatcacgccactgcgctccagcctgggcgacagagtgagactccgtctcaaaaaataaaaataaaaatacaccccccccccacacacacacacagctagttaattaaattcagtgaatctcccaaagcataataaaggttacctgttctagatgggaaaatactaaaagaatctggaatgcttaaactctcttgggtttgggacacagacattattataaatacataatttctaattgaagtgtcttatccatgttcagtacaattaaatttagaatgtttaacctcattcttgagattaaacaaagtaatttttaaaatcaaaatgtaatttaaacaaagaaaatgattcctctatgtttccacagagttttttcttgcacatactggtttttgtagagcaattgctcctacatgtaatttcaaattaagctattatgcatagtaaaaataatacaaatgaaatatttgaaataaagcttaattgtacttttttgccatccttaaatatctaatgcaatagtttagagtaattttcacatttcttttaaacttgacaaataaaagtttaaattagtatacatttcttacctataaaaaagagggagtagactttttaaaaaaactgttggaccctttcttactcaggggagtcaagataagtgaatccatctttgaaaaatgtttttctggctgggtgtggtggctcacacctgtaatcccagcactttgggaggccaaggcaggtggatcacttgaggtcaggagttcaagaccaacctggccaacatggtaaaaccctgtctctactaaaaatacaaaaattagctgggtgtggtggcacataacctgtagtcccagctactcagtaggctgaggcaggagaacctcttgaacctgggaggcagaggttgcagtgggcagagatcgtgccactggactcctgcctgggtgacagagcaagactccgtctcaaaaaaaaaaaaaattttttttctgccatagcaaataaacttacattttattattttttcatatcccaaaaactgtgttggcttttggaaatagtatgttatgaaataatgtgcttttaaggaatagtaatagacacaaggatggtttatatatgcctatgataacttaatgataaacttcagaagtcttccactttctctttgagcttggataatccagagagttcattgttataggatggtgaagatgcaaaactaaatccttttggcttctcaagcaatatagctaataaggagtgggcgatttctaacaatgctggtctgctagagtcccttatacttaacccttgggggaagaatatgctttaggaacactaagaatttctagtatgtttactggtgatcttcagagttttcaagaaactttcattaatttttagaaagttttcttttctgtttaagtattactgagaaaattacctgacactaatatgtttctatatcatctagaatgcatctgctttttgaaaatttgatttgtgtactagagtagagcaaggatctgcagactgtggtttataggccaaatctggctcactgccagtttttgtaaaccaagttttattggaacacaaccacacctgtttatttatttatagtgtatggctggttttgtatgacatttgtagagttgagaaatttcaacatagaccatgcgacctgcaaagcctaatatagttactttctggcaatttacactagaagtttgctgacccctgtgcaagagtataacctaagatagttttttaagcgctgaaagaaatgcagtctgtttggccagctgtcatttatcactgacaagattttgtttttagtttgacatttaaaaatttgaaattttccactacaaagataaaattggatgtgatgagtaaaggagggaagcacaaaaccttcaaatatccatattttctttctcagatcttcattatggacaacatagatatttaaacattttatctgtaggcatttgaaaacttgaatatgatagctgtcaactcttttaaaagaggtatccaaaagaaaatatgtgagagttgagtgtgttgttgctaataaatttgcactgagtcttttaggaaaacattttctcctgacccttaaaagtctttaaaagcatgtgccaagaattcatcatagcagcagacaacacccaaaatattgagctagggtttataaagccgcctccctcctcgtcattttttcctttaaagcttagtttctttacttttaattaacagttcacatttctctggtttctcatcttgaaataaatgacgttcacaatcccttgaaccgcttcacccagacttcagcccccaggtacacatgagatccaggatccatttttcttttgcattgccctgcccagcaatttcattcttttgtctgaagatgaactattttgcaagatttctgaccttgtcatataaggaagttccttccacccagctttaacaacacagtatcaacacctcacaccgtagttccttaatagtcccacatacagcattttagtcattcatgcaaactgtaaacagcaatgtggagagggaggagtttgaagatatgagtcttcctgagttgagacttgcccactggctacctcaagtatctttgttccattgaatgtttgcggtcacagagagaacttagagttatatgacactcaaaggaaaagcaaaagagcattaagaagtgtctgtttttgttattgccatttcataaatattttagtaggtgttcaatttcattggatattctttttttttaattgtctttgtacctatgattgaaaacagtagttggtctatgacttttgaggaggtaagttttttttttaatctatgtatgtctgtaacatcagtgtctgtctctttgaaaaatgcagtatcctcctcccaaaagttactaaccaaactttcccagctgtacatctcctatccataaggggtgaaactatgaggacagttgttatctgctttttgttcaaacggtgtcagttgtgtgagatggggagtatatgtttcagacagtgtgatgtgagttttaagagttatgtaagcagtgtctcctgtaatcttttctgaaaggcaagagggagccagtttgcctgttttgtttacaggctttgagcatttagcacatctgcttgtgcaaacttacagcatgtgaatttctctgggctgactgaggttattggggctgactttaagtctgtcttccatgggcaacccttgtcaacatttcaaaatgaaccaagcagggttactgccttttccaagaccatcaaaaccaaactctcttctccattctagtatacaggcaaactttttctagaattggtcagtattgaaaacagttttggctccttgagaagaactgtaaaagacagccacgttaatataagctctgtttagccctcagtaggtaagtgtgggcaagttctttgtagaaaatctccatctcagtagcagggtctcactgtagtgctcagtagcactcaccctgggttcatactttggaggatgatactgcatttttggccccgtagcttgctttcccacttgtctgtgagtgcagagcaggagtctgacacttcccactgtgctgcttgctttgcagacactaaattgaagcttcttgctaaagcaaaagccagtaggcgtgccctctaggctattttgctttgcagggactctgagacactcagtttctcccaaatcttttcccacccttgcccttgcccctttagctgtgtgtctgtaaggaagggtttcagttgcaacagtcattgtaatgagaagttactagtcagaatttcagctgaactcacacctctttcttatataacagataatccatcagacatttatctctaatcaacagtgaagtagctacctggtatgatttctaaatacttgaacaaagtacttttccatgaacatcctatgactttacttggaggttactttaactcaattctaagcatgtaattgtaacctgaaaaactggtagtggcaacattttcacttgtgccaaatgaatgtaatgtacataatagtcgagggagctttttgtactttggggttatacaagtacaatttcaatagcaataggatacttaactcaggaatacctattgaagtagtcttatcttagtttcttgaagatatttatcaagaaatgagaaaaatctcttccctggctaagcagcctgcattgtgaaatatgtcatgttgaaattgtgctggtattgttactctttcctggctgggaggaaatttattgaaaaagcttctcaaatctttttttttaatctaagtttcctatatgttttttttccatgaaaaggagtaatagatatatcagaaataaaggctaactctccagcccctgctagaaattgtgttgcttaggcaaagattcaaagatttcattgtagaagctctggctttttagaaatttgttttttagtctccacatttattatgcttctgtgggagggtgtaacttctgtagattgaggggaacagacagaatctgatgagtacaagttgcctctacaagagcattcacagtcttctcaggaacatctagggaaagagttcctcacaaggcaccacttctgaggggttacattatatcttggtcaaaaaggaggatccaatatggttttgtgtagaatatgaccttctaacagaagtggacttaaatttttttttctcattttggcatcttatcccttccaatggaattaaaattctgaattcctttttttcttaataaaactattttttaaatcctattacaaatatatattcattgtagaaaacttgaaaacatttttaaaagaacaaggacaacaataaagaaaattcactacctacagttaatattggttgtttatattgttacaatgagattctccaattatttattggggtttttttcccccctacaaggaaggcagcgtaagcatttcctgttattatattttctttctttcttttttttttttttgacacaggttctcactctgtcacccaggctagagtgcagtggcatgatcatagttcactgcagccttgacttcctgggttcaagtgattctccaacctcagcctccccagtagctgggatcatgtgtgcacaccacaccacccagctaatttttttttttttttttttttgagatggagtctcactaactctgtcacctaggctgaagtgcagtggtgcaattctggctcactgcaagctctgcctttcaggttcaagcaattctcctgcctcagcctcccgagtagctgagattacaggtgtgtatcaccacacccatctaatttttgtgttttgttttagtggagatgaggtttcaccatgttggccaggctggtcttgaactgacctcaagtggtccacccacctcagccacccaaagtgctgggattacagacatgagccactgtgcccagctgtacccagctaatttttaaaaatttttttgtagagatggggtattgccatgttgctgaggctggtcttgaattcctgggctcaagcaatcctccggtctcaggctcccaaagtattgagattacagtcatgagccactgcacccagccttctccagtattttaacactgagtagaattctattgtgaatttatttaaagtattaaagtgatttgggattgtttttatcttttttagtcgatatgtttttcaataatgttttaacattctccaactattcttatttttttccaaaaaaaaaaaaaaagacagaaatgggccctggtggctggtataatcaaggtgcggttttgtcctttaacttctctgacagccttccctgtttatggatcctctgcctctgtgaaagcctcagactttgcccttaccatgtgtttcttagcccttgttttaaaaaacaggaaaaagaaagaaattgtcttctctttcaatataacaaacaccaggttgttatatagaagatacaattaacttcacattacctggtatgcta

SEQ ID NO: 548 - DNA, 100571 bp, Homo sapiens
tttggctgggcacagtggctcacgcctgtaatcccagcactttgggaggacgaggcaggcggatcacaaggtcaggagattgagaccatcctggctaacatggtgaaaccccgtctctactaaaaatacaaaaagttaactgggtgtggtggcgggcgcctgtagtcccagctacttgggaggctgaggcaggagaatagtctgaacccaggaggtggagcttgcagcgagctgagattgcaccaccgcactccagcctggacgacagagagagactctgtctcaaaaaaaaaaaaaaattattttatttttcagaggtgaggtcttgctatgttgcttaggctggtcttgaactcctgagatcaagcagtcctcttaccatggcctcccagagtaatgggattacaggtgtgagccactgcacctggcctaaggcatgtttaaatggacagcgtattcctagataatcaagaggtaaattagtactgactccatgtggcagcggacaaggagacactctccattgtcttccagggaagcagagggttagagctgtcttctttatgcaagtgtgtgaggtctctgcggtgagtgttggcttgtctcagatctggacagactgagcttacaagggctgggcctaggtcttctcactcttgctcaaatgccagcacatagaaggaattcagggcatgcctagtgaatgaatgaattcattgaatcattttcttggggagaagtggtgcttcttacataggactaggctgccagcctcaagcctcatggtaaggacgagtcagcatctctgatgtagacatggctcagagtcgggggaaacagtgcccagaggagctgggggactagggccgcagtccttacggactctgactccactgcagtttaacctttttggatctccgtgttctcagtcctaaatgggtggtgaccatgtcacctcctaggaaagcaaggggctggaccagtgatggtttgaagtcctttgtgtggtctgagggagatgtcagtgtcctgacttgggggagcctgggcctttgctcacagcagtcgctgtcagtgttccttcctgatctcagctgtggcagtgtggctgcagctactcctagggctcctgccactcctcagtggcccacaaccaaagccttccttcctgtctgtgcttcagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtaagtacagccaggggtcttagctgtgggagctaggagaatgtttgatttgagactttattccgtccacttttaagccctccgttaccctcaagagtaactggtgagttctggcccctggctgcatgaacttcagcaagtcatttactcttcctgagcctaagtgcctgttcctataaaagatgggcaacaattcctaccaagctttctgggtgttggggaggaactcagcaaagatgatctgtgtaaaaaggtgttaaatggcactgacctgttttcatctcctagccttgtgtttgaaatccagtagtacctgcctgtagcccagttgcctgttaatcattttgagcttcgttttttccccccaccaaaaacgaaaatagggttatttgaggatgaagtggaataatgcatgtaaaacattctgcatgatgcctggcacatgggatgtgctcaatgtggccaacataggagtctcaaattctccagcaggacaggggaagagctggcatgtggagaggttactgcacgcgttctactgttcagaactccacatctgtccgctcatctcattccctcaaagaccctcctcagttacagattaggaaacaggcctggggtgcgggggtcaagtaatttgcctaaaatcgtgtggtgaaacaactgctctattgagataaaagcccacaatttaactcaccactcatccgctttctgtctctacagagttgcctattctggacacttcttataaatggaatcatagaatttggggccttttgtgcctggcccctttcactgagcatagtgttgtcagagttcatcccgactgtagcatgtgccagagtccccttctcctggcggaatatgttccattgtatggacgcagcacatttcccttatccattcctcagctagtggacatttaggctgttttaactttgcaactattatgaataatgctgctgtcaacatttgtgaacacagcatgtgggcatgtgttttcatttctcttgggtatacacctgggcgtgggattgctaggttttatggtataataactctacattaaactgttggagaatctgccagactctgttcaaagtggctgcacccttttacattctcaccagcaatgtatgagggttatttcatctgtcttttttgttgaggaaaccatatatgtgtgtgtgtgtgtgtgtgtgtgtgtgtgtgtgtgtgtgtattttttttgctttaagttctggggtacatgtgcagaatgtgtagctttgttacatgggtatccatgtgccacggtggttttctgcacctctcaacccatcacctaggttttcagccatgcatgcattagctgtttgtgctgatgttctccctccccttgcccctgcaccgacaggccccggtgtgtgatgttcccccacatgtgtccatgtgttctcattgggaaaccctattttgttaatagtaaataaggttcttggatgattgtgatttcatcttttggaatttctggtgaaggaaatgcctgtagtggtgaggcagttgagcaagaggtttagcagagagtgtgcccaggcttcgtaacatgacttctcccttagtaatctaattcttatttcaggtcttgtccagaatgccgtgtgatatcagagtttgtaattccaagtgtgtattgggtggaagatcagaataaaaagaacgagttgattgaagctttcaaacaggggatggggtaagtgcttttgagtttcgacgtgcccctgctgcctgcctggctctgctgtcagcccgtgtcctcgttctccttcccaggagtgtggtcttaggggcctcttcctctcttccttctctcaggcaccatgctgggctctgggatgcagcaatgagcaaggacatggtgatgtggacctgtttagttttggtgttttttttttttttttttttttttcggtgagatagggtctcactctgttgcccaggctggagtgcagtggtgcaatctcagctcactgcagcctcagcctcctgggctcaagcaggagcctcttgagtagctggggccaccagtagtgtgcgccaccatgcccagctaattggctaattttttttggtagagacaaggtttcgccatgtagcccaggctggtcttgaactcctaggctcaagtgatcctcctgcctcggcctcccaaagtgctgggattacaggcatgagccaccgtgcccggcctcaaatgttcctctttatcctggttgtcagcatgttgatattttgcctaggagtggagtggtttttctctacgcttatgtcactccccaagatgagcgaaattttagctattgtttcattaactttttttctgtcttgtttttttcttttcctgctgggactctacttccgtttatgatagtttttttatattgttcatagatctctggggatattcattctttttcaatctttttttcttttcatctccttgaacatagttgtagcagctactttgaaatccttgttatcttgaagttgacctctgttgtcttttaagaatggatcacattttcctgattcttcgtatgtctagtaattttagattttatccttgacattgtaaatattacattgtagagagacttaggattctgttatggtttatctgtaaagtgatgatttttttttttttgagacggagtttcactcttgttgcccaggctggagtgcagtggcacaatctcggctcactgcaacctctgcctctcgggttcaagcgattctcctgcctcagcctcccgagtagcagggattacaggcatgcaccactgcacctggccaattttttgtatttttagtagaaacggggtttcaccatgttagcctggctggtctcaaactcctgacctcaggtgatccgcccacctcggcctcccaaagtgctgggattacaggcatgagccactgcgcctggccaagtgttgctgtttttaacaggcaggtaaattgtttgaactcaaacccaggtagcagttcagatctcagttctggttttgcattcgtagctgactttgtcgcattcctgtgtggtttgggagttagtcagatttgggcagagtttatacacagcctttgagcactttttcacaggccccttactttgtgggattgcttcctcactttccaatggctgtgatttccttgaactcttgtcttttagttcttcaggccagaaagattggatttccccttggagttttagccaccccatgtggttatgattttggcctgctccaggataagagctacttctttttttttttttttttttttttttggagatggagtcttgctttgtagcccaggctggagtgcagtggcacagtctcagctcactgccacctccgccttccaggttcaagcacttctgcctcagcctcccaagaaggtgggactacaggcgcatgccgccacgcctggctaatttttgtattttagtagagacagggtttcactgtgtttcccaggctggtcttgaactcctgagctcaggcaatccacctgcctcggcctcccaaaatgctgggattacagatgtgagccacaaaagctaccttttttaaaaaaggtaacttagcctttgccattgctattcttctttgtgtttactcctccaaagaatctaactgcgtttgttcattctctggtgccttcaggtcttcttgaaatatttgtgttaagacttatctgcaggagggttgggtatggcaggcgtttacttgtcatactaaaagtgaaactatgcattaccttttttaatggttcctttatgttgcatattagtttactaaagcttgattttttttttttttttttttttaccattttttcctcatacaatcttcctgtgtgtccacaagagggcaaggcgtggcaagcagaggggtcccagcttgtagaaaagggccccagcctgtagaaaagggtcccagcctgtagaaaggggctctgctgaaaagcagtctggagattgttattgctatttggatctttccttgctttgctttcctttaatgactgtgttttttgcaatccacaaacatttactgagtactcactatgggtcaggtaccttctagctaagcaccactgggggatgtagagattagtaagacaatttcttttttctttcgagtctcgctctgtcacccaggctggcagtggcatgatttcagctcactgcaacctccgcctccagggttcaagtgattcttctgcctcagcctcccgagtagctgggattacaggtgtgcgccacgacacccagctaatttttgtatttttttagtagggatggggtttcgccatgttggccaggctggtcttgaactcctggcctcagatgatctacccacctcagcttcccaaagtgctaggattataggtgtgagccactgtgccccgccaagtaagacaacttcatgggaaactgcaaaagggcaattatgatacaggtttgctggtgaccagttcttcatgagggaccatctatcacaacagagaaagcacttggatccaccgggggctgccaggggaagcagcatgggagcctgaaccatgaagcaggaagcacctgtctgtagggggaagtgatggaaggacatgggcacagaagggtgtaggttttgtgtctgggggacactgggagtggctcctggcattgaaacaggtgtgtagaaggatgtggtgggacctacagactggaatctaagggacacttgaatcccagtgtgaccatggtctttaagaacaggttggggccaggcgcagtggcttatgcctgtaatcccagcactttgggaggctgaggagggcagattgcttaagtccaggggagacatagggagacctcatctctttaaagaaaaaaaaaaggttgggaagctcctccgtgctgctctgaaggtggaaactggtgggagtgggagggaggccagtgaggaagtggccctggcaggcaggccccagaggcttccacaagtgtgggaacccaaaggaaggggagattgggaagtgatttgtaaacagaatgaacacagttgggtgtgagagccgaggacacagagtgagtcagagtgaactggaggcttttggccttggtgaccagataagcctgggggaggaaaaagagtaatattcttgtgagagtgggggaccagtatataatgtgtttgacctgatcgagttcatagccagtgtgctaggatgctctggagttgtccagcaggctctggtgagagcaaactgctcacggtcatttgaagtccgctcagaactccaggcaagcaggggcctggaggatgtgtcgtccacacacctgctctccagccacctgtgctcaaatcagatcagctggccagggagcttgttctctctccccccaccctacccccccgccaccacccccagtgagacgaagtctcactctgtctcccaggctggagtgcagtggcacaatcttggctcactgcagcctccacctcctgggttcaagcaattctcctgcctcagcctcagcctcccgagtagctgggattacaggtgccagccaccacacccagctcatttgtgtatttttagtagagatggggtttcgctgtgttggccaggctggtctcaaactcctgacctcaagtgatccacccaccttggcctcccaaaatgctggaattacaggtgtgagccaccacacccggccagagggcttttctttatgctgctatgaagccgtcctcagagaacttcaccaccggcctgcggccatcccatctgacaagacggaaaaccactggattcaggagcctcctttccctgttcttgtctcccgctgtcacacaccccagctgcccctgacagcagcgtgccctttctgttgtttggctttatttctgtgactttccccttcctctgtactccgagatggccctctggattcttgggtatctttttttttttaacttcagtttgggatcctttatgattggataaaccagagttcatttgagcaaaatgggaattcatttgattgagtttccttgggcagggttcttaacatagaggtctgtggggagaatggtagaattaagagagagggaaaacattttgaactgtttggtcactgtatgctgtagacccatgttttatgcattgaaaaacactgttcagagaaggggtccaaagcacataaggcgtgaagaagccctccctggtgccgaggttggagacaggaaaactggaaggagacctatggctttaggcagttgctaaaaccctctgctttccctgtagccaccttgacagcactgcggccaggaggaaggggagagttggcttggtggggtacctagggaactttgagcagagacaagtggcccagcttcagagcttagtgcccagaggagtgaccaggcctggcttagctctgtggtgacccaggaggtgctctggagctgccggagggcctgtggagcactgcagtctccacacagcaagtccccaggcaggttaatatcctttgcaaggctgcaggtaagtggggatacttcctatcctgcttggaaatcagaatcccagctgtgtgtgacctgagacaaatcactcaacctctcccagcctcagctgccccacctagaatgtgaggctgacctacctctggcgtaagggtggtaaggatggaggcaggcagtggcccagtttggacccctcattttcccaccagcctcttgactttttctttctgcttttcaggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgagggtaaggactttagccatctctagttggggacacttagcagctgtgggcatttccaggtaccgttcctggcagagaaatggggtaggcaaaagaacgatcaaggaacgcagccttcctgttgctcttagcagtaaccaggcatgtccactggctgtttttgcagttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaagaaaacctgtattcctggcttccttgtatacacatgatgtgactagagaaacaaggctgtttgtttgtttgtttgttagagaaacaaggctggccctgcggccccgccccataggggcagctcctggaagacaaaattcagcatgatggaagactgctccctgagagggctgagatgcggattggccgagtgccttgcctggaaaaccatcccaatgcactggacaccttagaagctgtgaaaggaggacgtgtcccctaagaaaagttccatagtaccaaagcaggctccttcgggcggccagagtctcggcagtcctgggctgtttggtgccttatgtgcaaaatgtctggcgctgcaccactctctgaagaaagtcccgcctgtgacatgcattcctccagaagctgatttccaaaatcccatgtgtctccacatcagggctggactgcctgctaccttacttcctctaaatactcatgtagccaacagctggggctgggcccctgctttttgtactaccatcaacatccacttgcgcatctacagaaggctgggccttgagcatggggaatgtggggagggagcaggacacaccagcactgcaaatggcttccttctcccagggcccaaagggatagaaaagaaggcaacatgaagttaaggccctgtgagcagtctagaaggtccttagcagcagcttctctgaaaacatgtgttctgcctctggagaaagggagcagaaaagtggtgcctgctggcttctcctcctcccctggcagcctgaagacaggtgcaaagtcaactagaagacaggcagcctcggggacgtggtcagcgtgcaagcattgatatcctcagtgtgggctgcccgatgcaaggatggctcggaagcgctccggttgatcttcggtagagagtgttggagcagctcaatggaagacaggatctgaaacaaagcccaagaatgctctcattagctgtgtctcaaagacacaggatgtaccctgccccccaccatcttgtagaggacctgggtcccctccctataaaacaaaacaaaacactcccaccttatattgccatctttacgaaccaacccatgctttaatcacattctagcagccctgagccttacctggggaaaaagaggcctctcttcctttactttcttcacacagtcagctaccagcctcttcattgctttggggcagttcttatatagcttactaagatctggggaggcatatcctcggcccaccatgaagatgatctaagggaaagaaaacagctgagctaatggggggtgaatgaacaacagataataacaagtcctaaccctctagctgcttaggctggcggaggcccaggggctcccacgagttgggtcctttcgcaccagcacagacttacctgatctcggttgttgatgtgagaataaggaagctcccccgtcatcagttcatacaatacgatgccataggagtagacatccgactggaaactgaatgggttgttatcctgcattcggatcacctctggggcctacatgtatcaccatatgacaaaagtgcatttatcaccatatgacaggcctcacagacatctaggggccaggctgtccctttcattagttatgaatgagtccattcttcagtccccacatagcttttcccccaaaggactccaactcaggcactggttaaaacagctcaggaatccttgtctttaaaggaccaagacccagcatttctgtcacccagcttattaactcctctccacactaagcttcacagtggttctgatcaacagcttcctcaagaaaatctacaattgccctgaggctggctgtcactaggggtcatgtggatttcggggaaatgtacagaaacgctttaagtttgcacataaatctccaaggcattccttttgccctataccagagactgctggtgggagcccagattctcaccatccagaggacagagccagtaggttgttcaacctgctgagaaccactccagcgtgactttactgttgccaaaccaaaatctccaattttcactgttaagccttcatggagaaatatatctcaatgcttgttaaggactctggtttcaaaagaatggtcaggttaattttgaaaaatatcccaaagttctttataacacggtaatctctccaccttacctctgtcacagcctctctgcactgaacttcctaaggtttctgaagttctttaaagtgcttttgaaatgcaccttcttccagaagacaggcagggattggtcaatgtgccagattatttggccctagccaaaagcaagccagcgtttcttccctgcttcttctccccatttgcacatctaggtgctgggtctctggccttgtgacctttccacataatacaggtacttgaaaccctaacaggatgagcagaggccacactccagtgctccccagagggccaaggatggcctgacagcttacagtcgtttctgcctgtattctgccctcaaatcaccatctgaaacttgagtggttaacaaaatagcaaatcccttactgagtgttcaatgttgtagtaagaaattcctcactagaatcggtaccactcagtgacttcaaaatgagaactgaagtcggctcgcttctgggtaaagaagtcatacagtttaagtcaaacttgtgaggaaaaaaaaattaaaaaagaacaaaaaattaaaaaacaaaacacacacaaagtaacttgtgatgttggtgcccaggaattcacacctccttaaatctgtggtgtctgctttcatggtataatgtttggctgctaaaaaccccaccactgaaaggtgttccacacctcagacatgtacctaaaataggccatgtcccataatccaacacaactatcatgcctctcactgctcaagaggcaaaacgtgggttgtaatgccatctttctttcacaaggaaaggctcgtggagggtggcagattcaaaattgttaaatttcacgcctcacagcattaaaaatacctttcttcatttactcttctataaaaacaacccctctcctcttctaatagtgacttctgaagaacccacttatgtacctttgagaaagaccattttatttatttatttttttgagacacagccttgctctgtccccaaggctggagtgcagtggcgtgatctcagctcactgcaacctctgcctcccaggttcaagcaattctcgtgcctcagcctcctgagtagctgggattataggtacgtgccaccacactcagctaatttttaaatttagagatggggtttcaccacattggccaggcaagtctcaaactcctagcctcaagtgatccacctgcctcagcctcccaaagtgctgggattataggtgtgagccatcacgcccagtcaagaaagactattttaattagtgattttggaaacctttcaacatttggcttgtagctacttgctatccacataacaagcagatagacatacacacgctggccacaaactagaaataaacttaagacaaaagcccaatccccgtcaggttacatttactaatagtgtgataaaattatgcctatttcaagcttacggaaatctctccaaatcacttttgctgagataaactcagaaaggaacctaacctaaacatcgctctcatcagtccaggtgaggcataagctgctgagggacaggccaagcctactaattttctgacttttctgttttcctgtcctctgcctctttccttaaaaagatatcccctggcaccgagagccacttgtgatagaaagcctcccttctgtttccctaaatttagaaccgagcagtcaaatgaactcaacaaccaaaggatactgttggatttcatgtctctatggatgatgttctttgcatgcaaatagctgtgaagggaaaagaaattattaaaaataagtttgaggggcatgagtagaaagcagttttaaactacagctaagaagtaaagccactgaaggcctggctccaaggagtgttacacacagggatagaccctgtgctgttcagcctggttcacatcactgcttacctgaaggtgaggccacagcacaaacatgcttacacctttttttttttttttttggagactggagtgcagtcaatagcttactgcagccttaacctcctgggctcaagtgatcctcccacctcccagtagccgggaccacaggcatgtgccaccatgccgcctttttttttttttttttttttttgggtagatacagggtcttgcactgttgcccaagctggtcttgactcctgggctcaagtgatcctcccatgttggcctccaaaatgcttggattacaggcatgggcccctggcgcctgaccattgctgacacttcttcaagcatcagttttactctaaagtaattctgataacccaatgtccataaatgatgaatgaataatgtggcatatccatacaatggaatgttactcagacacagaaaggaatgaagtagtgactcatgctacacattaaccttgaaaatactatgctaggtctaagagcccaggcacacaataccatatcttatgtattatatacagccaagcatcacttaacggcagggataccttctgagaaatgtgttgttagccaacttgtcatcatgcacacatcataaagtgtattcacacaaaccaagaaggtacagccttctacacaccctggctaaatggtataacgtgttgcacttaggctacaaaactgtatggccctcagtgtactgaatactgtagctggttgtaacatggtgagtatttgtgtctctaaacatagccaaacatagaaaaggcacagtaaaaatacagtattataatcttgtgggaccaccttcctatatgtggtcattgaccgaaacatcattatatgttacctgactatattatatcttacatgattccatttatattgaactataaagtaggcaaaatccatagaaacagaaagtagactgcaagtgggtgggaggtattgggtaacctctaatgggtatattgtttggatatctgtccactccaaatctcaagttgaaatgtgatccccagtgttggaggtgggacctaagtggcaggtgtttgggtcatggggatggattcctcacaaacggctcggtggcctccctgcagtaacgagtgagttcacacactattagctcacatgaaacctggttattaaagagtctgggacctccctccatgctctctctcttgctcctttctctcaccacatcacacgtggctccccttgccttctgccatgagtgaaagcttcctgagggcctcaccagacacagatgctggtgtcatgctttttgtacagtctgcagaaccccgagtcaaataaacctcttttctttataaattacccacccttaggtcttcctttagagcaacccaaacagactaatacaatgggcatgtgtttctttccgggataatgaaaatgttctaaaattagatagtggtggtggctgcacaactcaataccagaaaaacactgaggtaggtgtacattttaaaagggggaattttatgatgtatgaattatatctcaatttttctgaaaagtcattccatttcttaaaatacacagaaggcaacttccatatgaattttaaagacagtgtgagaatttatgtaggacttgcaagcacagctatagcttagtaactcccagatgtctaggggtacgaggagctcctctacttcagaggagaagtttgagaagcactaccctaggctagccaggaaaggtgggaggatcacttgagtccagtttgagaccagcctgggcaacatagtgagacctccgactctacaaaatacacgaaaattagctgggcacggtagcatgtgcctgcagtcccagcaacctatgagactgagccaagaggatagctggagcccaggagttcaaggatgcagtgagctatgattgcgccgctgcactctagcataggtgacagagtgagaacctgtgtctctaaggaaaaaagtgtggtttttttgggtttttttttttttttcagatggagtctggctctgtcacccaggctagagtgcaatggcacaatctccactcactgcaacctccgcctcccgggttgaagtgattcttctgcctcagcctcccgagtagctgggattacaagcgcctgccaccacaaccagctaatttttgtatttttagtagagatgagatttcaccacattggccaggctggtttcgaactcctggcctcgtcatccacccgcctcagcctcccaaagtgctgggattatgggcatgagccaccgtgcctggccaggaaaaagtttttaattaaaaaaaaaaaattatcccaaaaacaacatctgcttaaaccctcatgtgggacagccatgcctcagacagctgagcagaaggcattgccacagctgtccaagcagaaggtacatgcaccccactatattctcaggtttctgataaagccagggtagcaggcagagcccaaagctgagccccaagggggaagttcagtcccaaggaggaacctgaacttctctttttttttttttgagacagagtctcgcttctgcagccaaggttggagtgcagtaacgtgatctaagctccccgcaacctctgctttccaatgttcaagcgattctccctgtcccagttcttgagtagctgggattataggcatgtgccaccagacttggttcattcttgtattttcagtagaaacagggttttgccatattggcaaggctggtctcaaaactactggcctcaagtgatccactggccttggcctcccaaagtgctgggattacaggtgtgagccaccccacccagctggaacctgaacaactcattcctgataattggcccctccagcccaggccagaggcttgtgcaaagatatcacagaatcgcttaatggactagaaggcttttcctgatcctggttccaatttagggacaaatttgatgcctgggtcccagagaggcatcagaccatctactcactccattccctgagccgtctgccgggcaatgtcaattagctggaacatctgaaacttggtctcctggacatgcaggtgtttgtagaggctgctgccctcgcaccactgggtcacaattgccaggttgtcctttgtcatgtaccccatgaaaagcagaatgttcacatgccgtgttttgctggggaggggaggggaagagaggagagggaggaggaaagtgctcagggaggtctactgtgctttcccgtggacagtgggttctgtgctgtcgacaccacccccagtcccaacaccacccccagtcccaaaaacaaacacatggcacggctgataacccgggtggcattctgagcaaagagaagcccaccattagttcactgggccatcagttcagtgccagccttgcttacagagaggacattctctttcatcaatgtacactccatgaccctcctgtggaggtcacaaggactccttgtagaagtctccattatatgacttattcctacaagtctaaatagtgactgaaagattggaaagctgactgttctgaagtctaaaataaggcaactcagctataaaaaaaagggttctgggaaataaaggtaaaaatagggcctatttctgcccacctcaaaccaaaacccagagacagaaattgggctattgagtttactgtgcccagaggagggtattctcctaaaaaggggctcttcgaaaggcttgacaaccacataaactaaaggaaacatccctttgctctcaagggaggagcatccaaccacagaaactccacagtgagtcctaactgcctgcccgtcccaacctgcggcacagtccactaactctacagtccttgtactccccactccagcactccagagggactggaccgccagctttctactcaccgcagaacagccacctcattcctgaaggcctggaattgctctggggttgggtcgacaacctttaggatctttactgcaacatctcctgcaaaattagttggcagtcagtgcaatcagttgaatgatctcagtctttcaaataacctagttttgaggaagatacagtgaatcatttatccaaagaatcacatacctacacagatacggcaaatttccaattttttttttttttttgagacagggtctcactctgttgtctaggctagagtgcagtggcacattgcagccttgacctccagggcttaagcaatcctcccaccttggcctcccaaagtgctgggattataggtccaatctctacataattcaaatgactcaaaaaagttacataggttaactgctatcgctacagttaggccttcgatagccttggttaaactattcacaccaaccctggcaagccacagaggtgaggtcatgtgtgacaggtcaaaaccttgtcctgtggggatgaaatcagtgcatacatatgaatggcctggcaaatacagaatgactggggctggttgctggtgtaaggaagcaggccatttagcaactattgaggctgaactctgaatccacatttcagtgagacctaagatggtccctagtaaaaattcagagatatatattgaaattaagcttctctgccttcaataccattaaaaagtaattctaataatactgaatcctggcactgtgtatacttttatctctgttaatcctcacagctgccctctgacgtaaataatttatcttcacagacaacaagctgagaagtttagtcacttgcccaaggtcatacagccaaaaaacaaagaacgctgcagccaggatcaaaaccccagtctgactccaattgctattctacctataacactgacaactgattgtcaagcactgtaaaaccagcctcttgatataactttagacacatccagggatccattccactttagagtgctataaatttaaaagccacttttttttttttttttttttttgagacagagtctcgctcagtcacccaggctggagtgcagtggtgtgatctgggctcactgcaagctccacctcccaggttcacgccattctcctgcctcagcctcccgagtagctgggactacaggcacccgccaccacgtctggctaattttttgtgtgtgtttttagtagagacggggtttcaccatgttagccaggatggtctcgatctcctgaccttgtgaggcctcccacctcggcctcccaaagtgctgggattacaggtatgagccaccgtgcctggccaaaagccactttcaaaagtgtttctggagcctctctgttggagccttcctccttcctttttttttttttgagatggagactcgctctgttacctaggctggaatgcagtggcacaatcttggctcactgcaacctccgcaagcgattctcctgcctcagcctcccgagtagctgggattacaggcatgctccaccatgcccaactaatttttgtatttttgggtggagatggggtttcaccatgttgcccaggctggtctcaaactcctgacctcaaatgatctgcctgcctcggcctcctggagtgctgggattacaagcgtaagccaccccacccagccctccccatttcatttttgggaagaaaattggtagagagatggtcctcacgataggcccaaactgtctccctgtgatctctggttttatcatctaaagtttcaacgagtccccatgttttaacagcagcctccaaagtggctctcatccagttaacctgcacatgtgtttgccatgggctgccggtgaaggtgctgttgactggatgggagagatccacactatgtttggagctaccttctatctagaaaaatggatccatatgggacaccatatgggaaacgtgtataaccagccctgagtaggaggacaacaatcatttgcataagtgtccattctggtacagttggagccaagacaggagtgctggaacagaaggggagttccccaagatgggggagtaaatcctttttttttttttttttttcttttttagagatggggcctcactatgttgcccaggctggcctcaaactcctgggctcaagcaatcttccaacctcagccttccaagcagctgggactacaggtgcctaagtaaatctcttttcaaagagaatacagaaaggttttctgaaggaaatgggctataaaccaagggaaggattttagtaaataggacagagaatgtttcagactgggcacatcagaaataaaggtgaggtgagggggatgagagaaacctgagctgtgtttagtaaactctagggtaggatttggacacctgtaggagagaaagagggagaccagagaggaatctgctgcaatagctcaggaaaggtacaagaagaatggttgactgtggggactcagaaagaagggatgaaggtaagaaatcctgtgaaggtaaactgacccaatgaggcagtcaactgagtggaagtgctgggaaaatggccaacgctatgacccaggctccaggacccagaaaagggcagagcctttaacgggaggggacaggacagggctaggggttcaggcatgtggcttgggagatgctggatgatcgctcagggggaactgcttctaaggaccttcctatttcatggacctcgttttgtagtccattccctttcttatagctctcctctgggcatgctctagttgtcactgaacccaccctttggtgtcacctgttctggccctaatcagtaatataacctcagaattcagagccaagcccacgcagtgacttactctgaccttgcagtcggctgaacttccttggcagtttccacacacgttatcattaagccacatcttccccctccagttctactttttggaacaatgaatatgacttatctctgttaaaaggtgatcttttcttttttccatcatcctagccagttgaactcttctcgcttttctaaatcctcactactatgcaaatacatatcacacctctgattaagtcactgatgggaagactgaacagggtcaaccaaagacagtgcccatggtacttgcagggatccatctgccagccagctctcgttaacacagttatggtaacagattatttgcaatttcttatgaaatccagaaggaatgttctatactgcagcattcccctcatttacatataaataacccaaggactgccatgaaagggattcattcagtctgctaggatcaatgagcaaacattataggaaaacggatttcaactctaataaagaactattccatgccctcccctcgccccactctggctcttgctctgtcaccgaggctggagtgcagcagcaccatcacggctcactgcagcctcaaactcctgggctcaagggatcctcccacctcagcctcccaagtaactgggactacaatacaggtgtgcatcaccacgcccacctaatttttaaaattttttgtagagacaagggtctcatgttgcccaggctggtctcaaattcctgacttcaagtgattctcccacctcagcctcctaaagtgttggggttatagatgtgggccactgcacccaatcaaactattttctactagtaggaactacctggagttagaatgggctctcagacagataatgagctctctcatcacactcattttcaaacaaaggcttgccaaacctcctaaaggtctcgtacaaccccagatcccatttaacccaaatgatagtctttacaggaccctaaaacaccctaccactggacctcactcctattagtatacctctcactcactctaaatgaagccataagatctccttgagttctcggagcaggccaggtgagtggtccactttgcacttgatgttactgcttccctagatatctgcaccacccaccctcgccctccatgcaaatgccactttcttggcagattcctccctgaccaacctattaaaaacattgaactgggactgccactccatatctcctttcctccatttttctccttagcaattacagcatactatatattctacttttcctgtttactgtctccactagaatataaactccttaagtttctttttttttttttggacacagggtcttgttctgttgcccaggctggagtgcagtggtgttatcacggctcactgcagcctctatctcccaggctcaagtgatcctcctgcctcagtttctcgagtagcggggacaacagacacacagcaccatggtcagctaattgtgttttaagtagagacagggtctcactatgttgtccaggctggtctcgatctcctgggctaaagtgatcctcccaactcagcctcccaaagtgctagggattacaggtgtgaaccaccacacctggcctatagaaagaatttttctttcttttttttttttttttttgagatagagtctcgttctgtcgcccaggctggagtgctgtggtatgatcttggctcactgcaacctcgcctcctgggttcaagcaattctcctgccttagcctcctaagtagctgggattacaggcgcatgccatcacacccggctaatttttttatttttagtggagacagggtttcaccatgtcggtcaggctggtcttgaactcctgacctcaaatgatctccctgccttggcctcccaaagtgctgggattacaggcatgagccaccgcacccagccttgatgccaaatttaatgcccaaaaggaggttgtgagctttgggcctgacagatgctgctttaaataaatatgttgagttttaaatcatgcacctgaggcttctgagttgctttgagaccctttctgctttacttccataagtgggtgggctgagttaaaaaaatcttcaatcaaaatcatgaaaacagttgtaatttttaagatactgaacagatatactgtatacaggaaccagaatatggcggaaaaaagtattgcacaaaacaatctagaagttatgtttcctggaccactcatttttcttcttcattcatagaccagagcttgctttctgaaagcatggcataaaagtccactgctcctcactcctctgacttttgagactttctgacttaaaaaacctagaatctttttttttttttgagacggagtctcgctctgtcacccaggctgaagtggagtggcacgatctcggctcactgtaagctctgcctcccgggttcacgccattctcctgcctcagcctccaaagtagctgggactacaggcgcccacccccacgcccggctaatttgttgtatttttagtagagacggggtttcaccgtgttagccaggatggtctcaatctactgacctcgtgatccacccacctcggcctcccaaagtgctgggattacaggcgtgagccaccgcacctggcctaaaaaacctagaatcttaaaaacaagttatctccattctaatagcagtctttatggaagtaacactgtaacaaataatctttatcacagtttgaaagctcactctattgagagaagacaaagctcagaagcagtaccacgtaccaatgccttgaaaaattatgaatccccaaatgaaagtgcgcaaccagaggaaaattaaacttgggtacaacttaaaacttcatccgctggcttttagctggggcttttaaaatgtgatataaaaatgttctaatgctaacagaagcaataaatgcaatatccattgctctgcctcctacaactactagcagccttgttatctcagacacaagtgctctatcccacaaagtgcttgtgttctttcctaaggaatcctggagatatttatgccatctaaaatattctgcaactggctgagcacagtggctcacacctgcaatcccagtactttgggaggccgaggcaggcggatcgcttgagctcatgatttcgagaccagtctaggaaacatggcgaaaccccatctctacaaaaaatacaaaaattagccgggtgtggtggcatgtgcctgtagtcctagctacttgggaggctgaggcaggaggatggctagcttgagcccaggaggcagagactgcagtaagccaagattgtgccactactccagcctgggcaacagagccagatcttgtctctaaatacatataaataaatattctacaacagtatcatttctctgggacccaggagacagcccagtagtacatactagatgcaattttcttttcctttttttttttttttctgagacagggtcttgccctttcacccaggctggagtacagtagtgtgtactcactgtattgagctcactacaacattcgcctcctgagctcaagcaatcttcctgcctcagccttccaagtagctgggactacaggcgagtgccatcacatctacctaatttttggtagagatggggtttcacgatgttgcccaagctgttcttgaactcctaggctcaagtgttctgcctgcctcagcctcccaaagtgctgggatgacaggcgtgagccaccctgcccagccagatgcaattttcaaaggaaaaggaatcattccacatgtactttacaaatgttcagtcgggtgccaatcctcttaaggaactagaaattggtcagatgattaattacaagtggtaaaaaccatgcattaacgagcacatggtaaggctgggcacagtggctcatgcctgtaatcccagcattttgagagacccaagaggactgcttgagtccaggagttggagaccagcctgggcaacatagtgagaccttgtctctacaaaaggtaaaacaaattagctgggcattcacctgtggtcccagctacttgggaggcttaggcaggaggactgtttgagcccaagagttggaggctgcagtgagctgtgattgtgccactgtactccagcctgggcaacagagcaagaatctatctcaaaaaaaaaaaaaaaaaaaaaaaaaaaaccaccaagtactcaaaactggaggtgtttgatattttcagtaccttgaattttaatactccattcatttgatgcttttaacttctctcaatctttgcacatttatctctaaagataattccagtgtcatccaaagtagtataggcaccaagggactctgtgatttttgctttattgtaatctgaatttagaagagatgactttttgggaacatgcagcattttcaaggaaatacctattatttcccaaagtcctaaagccagaggcattaaaaacctaacagagaaatgctaagtatgttgccaaaatgttcagtgttgccaaaatacacaagctgtaactacataagttaaatagtacctttcttccaagtgacaaagtgtttccattaaaatcagaacattaatattccacatagattcaagaattaagtcaatgccttccctgtttgatagggacacccacagctaatcctagggcaggacaaagagaagttacttcaggagatttccagctttcctatgcctaactgcatgaccatgggcaaatcagtccccatttcaatctctaaggtcctttccagcttaaagtttctagaacccatgctccctccatagcagcagactcttgctcacttaaggagcttccaagcatgacccatgtgcagactgtatttaatcagtttaaaggagaagtactcctgacatttgattatagggctcaagtcttattcactaatttctaattatcctgggagctttataagaacttagtctaaaaagaattaagttcaatcttcaggtataatcaagtatgtaagggagagtactgctataagcccaggagcactcagtcctctcctcctcctggccccctgggctgaaacttgacttcacaccaaagccctgcagttagtaaagggagggccccaagcttaccgtgccatttacccttataaacagttccaaaagagcctgacccaatccgagtggacagcatcacttcactggcttctatttcccaataatagcttgaatctctctgtccacgaggcctctgaaacaagtagagatcattattatactccatgcaatggtaataatcttttgataatgagggcatcaaaggatcaacccatgtcatctgtttccatatcttttaaagataaacatattaaccatacttccaatttttgtcttttgagaaataccattttagttatagcactggcaaactgtctgatgcaagtgtgccaaaaatgacagtaacatttataatctccttcattgaatgtattttattagaatcttctcccaaaataagtttaagtattctaatttccaacgaggtttttcttactgaaccctaattggcaggaggtactgttgtctatactcacaattttgtttttctcctgggtcccagatactggtgcccgctctctttgtgctggcacgggggttttcggctgtgaccagcctgttgggctcagattgttggggctactggacagggctgaaggtgaggcttaatagacaagacaaacagaagccacacaaggataagccaacagaagatacaccgcataaagaaaaaaagcccattattgttggctaaatgactatggaaaagtacctgattcgctgtgacttcgaattgcatcctgaaacagaaaaggaaagctggtcaactcctacacacaaaagattttctctgggggagggaaaaaagaggaggaggatgtgcaagaacaaaatagattataaaaacctctaaaaaccatagaaatcctaaacatactctaatcaacgttccttgattaaattcagcaaatatcagtggccagtatctccaaggctgatttttcattaaatattagaaggatttaatattccacctcccaggttcaagcaattctcctgcctcagtctcccgagtagctgggattacaggtgtgcaccagcacgcccggctaatttttgcatttttagtagagacagggcttcgccatgttggccaggctcgtcttgaactcctgacctgaggtgatcctctcgcctcggcctcccaaagtgctgggattacaggcgtgagccaccgtgccaagcctggtattagtttttcatatataatgaaaaccacattctttttctcaaaagaaagcaatgtacacaacaaacatactctttcaagggaagctagcaaagttactctcagctgagacccttccaaagattgggattcttgttccactgaggctcaaaactttttttaaaaagccagggtggggaggtggattctgggggaagctcactcttactccacaaggagttaggctaaattgactagaagttggatttgaaaaaggtaagcagcctatatactttatccaagcctaaaatcacagaaagctggaaagaccacaaatccaagttcaaaacctacattttacatataagaaaacacatctgaacaggtagagagacttggcagggtcacttggcagaaccagtaggtggcagaaatagaaccagaaaccatcatatatggatctcagccctcagctctttcaccacaaaacactgccttatgggtaaatttggaaatcggttacattctcctcatgggagaaagcaaaggctatctttagaatttattagaaactgtttggaaaatagtttaaattgcagagggctctatgagacctaaaccccaatctaaaattcatcgcttggaatagaacagtataatagaataatataaaaccacttggcccccatatcctaaaaaaggacattttttggggggaagtcctactatattctctttgtgtaactacagtatagacaagatacttgttccacacaactattactagaatgctcccactcaattatataaaaagataaaattatatatctaattatataattagataaaaagaatcaaaccaagctgttcccctgctcccaaaacataattcggaatttaacaagaaagcctagttctggttcccaaaactagctagtcttcagaattacctggagagtgattctgactctggaaagaagaatgaagatccacccctaatccccgacccacgattgactgagcatgttttggaggggaatgtgagaagtccaggaatgtgtgtttttaagtacagcaggataactgccaggtgggcaaaacactggcaaaaaataatgtggatttcaatagaaatcggcagctgtaatttcattatccaactaagctgttctttgtttttaaagcaaagcacaatttatttttattaaccacaattatattcctatgtagcagaatattttccttaatgttatggtaattttcttccctgtatcaattaaatatcccatattttattctgtgctaatttctatagttggatcaatttattctagaaagaattttcctattgttcctggagtctaaatactcaagagaactatgaataatttgagacccacaaataatttgaataaagcaacaattagtctactttaaaaatgctgacttatatgtgattaaattaacaggaatcaaaatttaccctgcttctaaagtaaaaaatgattaggcacaacaattgtgctaattcttttataataaaaactcaaaaattcttacttgacacaatcatacacagctcactacaacctcaaactcctgggctcaagtaatcctcctgcccaagcctcctgagtaactaggactgcaggtgcacaccaccaagcccagctaatttttacatttttttttgtagaggtggggttttgctacatatagcccaggtaggtcttgaactcctggtcgcaagtgatcttcccacccagccaattctgacctttactgttccctgtaagtattacagtgttcatacaggaacaaaccatttaatagaagtagcagtaactggtatattattgtattatcaggactaatcataatgataaagtcaaaataataaaatttatagcttatacatgatctcctcacaatagtggcaggacaattatgttgaaagtgatttgaggtctgaatgagataaactgtgcctaaggcagcaggtgtctacatgatgagagagagcatagttgtctctgataagctttcaataaagaatatttattctagggtttatcaaccaaaaacacatttggttactaatgtataaacagaataccaatgctgtgagcaccaactaagtaagtctaacattagcctttggttggaattgatttaaaaaaaaaactttttaatgcccttggcctcaaaatctaacttaacattttttgtttgtttttaaggtggattcttattatgttgccccagttggagtgcaatggctattcacaggcacaattgtagctccctacagcctagaacttctgggctccagtgatcctcctgccttagcctctggagtagctgggacaacagacatacaccgtcatgcctggcctaacttcagaaattcatttcacctatcatcaataccacatacaacattttttttacttctatatactctactgccaaaaaaaattttaaaaagaaagaaagaaaaagaaaacatggaaacaagtgacaagaaatataaatttaacttagcaactatttcatttttggtagtctgctgtctgacagttttagcaatcctgttaattacaagaaagcaaaggcatgaagaaaaatacctactcttcccctcaaacaaaatcgtctggaccacgccctgggagaagcactcaggttgttattctagtccaaagcaatgagaaataaagaagaataaagaacaaaggaagtatttaagtgtattcagttgttattaaagatgaagcagaaagcaaattaaaccaataggacataaccaaaaagccaagagaagaaaaagcagttcaaaaacactagctttgggcactttgacatctccccaaacacctgcttattaaagtcctaggactccacccttttatttctaaataaaatcacaaaagtcttccagagaatctgtagttctccatcactgttaatttctgtcccacaccaaaactaaactgctctttaaatatcttagacacttgttcattaatagcctattcaaatctgataatgggaagagttcaaatgttaacattttttcaggaagttttagttctccagttgaatgatatactaaccagactattcagccagtctgaagatattatggatataaaataaactgtaaaagtccagagacctgagaaagtgttgcaacattccttgatcagatttgaaacccaaaactctgaaataagtatcaacctcaccccattaattgactgacattaccacccccaaggtgccctattacctcaatcatcctgctgtccacaggcagggtggtgctgaccatgtggacattaggtgtggatgtcgacctctgcctctgggagagggaaccttcagatgagggactggaggtgttaaaggtgaaggcgtgaggtgtagaatatctgtgctgagaactaggaggagaaagaaaattccatgattggcacttaggctttcatactggtgaagtctttcaagtacatatttgactaagtaagatgcttaagggcaaactctacctgtacaacctttgacaaaatgtttgattctttcaaatgtgtgacatctaaaaattatcttaagtctaggtgcttttgcatacaaaatttggaacaggaaataatatatgtattgggaattcaatgaaaaggagagtgcattataagttttctttttttaaataaagcaccactctactccaaatttttacaacatctccaggaaagaacagattaacatttgacaaccacgctaccacctattaagctagttggaacacgcccagtttagagactaaatttgagaatttatttaaacagataagtagacgtgctgagcatgtctgtaaaaaggccaggattttaccctctgtttgtccttacctgctacaaccagcaaacaaagtaaataaatgggaattcagtttttagatggaaatacctaaatgtgaaattaaccactggcctcttccagtcaccaccaacccccaccaaccaaactgggaacatgcattaagaggtataacattttcattatttgctctaaagattcgttcgaggtttgttcagattcaggtaacacccatgtatgaattaaagggaaaaaggccagcttttctaagggaaattgttctattgtcttgaaaaaaatgccttcccacataatcctctgttttatggcttcagaggcctggtttcttctaatcttcagaggtaactacaaattcttggtcagatttgcttttcaaattatcaagaaaaataaaagccatacagaaatatatatccagatatatgcaaattccttattctaagatatgctgcgtttaatatttccatagtattttcacattaaacattatctgattacacattatgtgtgtgtgtgtgtgtgtgtgtgtgtgtgtgtatacataatatatttttttttggagacagagtcttgctctgtcaccaaggctggagtgcagtggtgccatctcagctcactgcctaccacgttcaagattctcctgcttcagcctcccaagtacctgggccaaaaggcacatatcaccacacccacccagttttttgtatttttagtagagatggggtttcaccatgttggccaggctagtctggaactcctgacctcaagtggtccatctgcctcggcctcccaaagtgctgggattacaggtgtgagctaccgtgcctggcctaaagtaagatattttggatgtagattttactttaggtttcaaattcatgtgtgttaacactgagcagtagataaacgcaacaaaactgattataaagctggaaaacagagtaaagaaagacaagttatatgcaaactcagagacacatgagaaacaatatttatgctgaaaatctaattaaatgtttttaaagacactagtctatttaaatacatggttttagcaaatgcatcggccacaacatgcatttcaaagttaagggttttatttttatcaaatcactgtattaagttttaggaccctttccattgaggttgaactcagtacatactgaggaaagcagaatctcaagctctttaaaatgtaatgacatattaagaaatatgctatgataacagaagaagctacagtcaaagtcactttccagaatgtaagacctacaggtccataaacagaaatttctaccttttctgtaccaccagtatcaagttccacagaagcagcaaggggtttccacgtagagaggagggaatgcgaagaaactcttattttttgtcttcaagcttccaaccccaccaccccaaataactttctaaaagaaaagctataggtaaaaaattacctaacaggcatcctggaaacagactctcgcatacgacgcatagtcaaagaaggtagtgctgggactccactatcaccaatagtggaatttggaaacaatctaaacaaaagcagggaaagactggtttttaggcttgcagtaatcttacagagacaatcagcatgccttgcttttgcaaactcagagctactaaaactgaacttttcccagtcacattttcctcaactgttttacattacctagaataaagggaacaatattccaaataactggatttgaatgattattgaatgtgaataatactgacctgccaataaacatacaggctcctgtgtgctttttctttttctttttttttaagatggagtctcactctgttgcccaggctggagtgcagaggtgtaatggcggctcactgcaacctccacctcccgggttctcctgcctcagcctcccaagtagctgggattacaggcacacaccaccatgcccagctaattttcgtattttttttttaattatactttaagttttagggtacatgtgcacaacatgcaggtttgttacataggtatacatgtgccatgttggtgtgctgcacccagtaacttgtcatttaacattaggtgtctctcctaatgctatcccttcccccaatttttgtatttttagcagagacggggtttcactatgttggccaggctggtctcgaactcctgacctcaggtgattcacctgccttggcctcccaaagtgctgggattacaggcgtgagccaccgcgcccggcccagtgtgcatttctaggaaatactggtcctgtgtctagctatatcaaaataatatttttcaaactacagtataacatttcacaaactatgtcacacacagcttctctggaaacattccatcttgaaaatgcatagataaaagactaaaatagaaggaataaatcacagaaaagtgagtaattaggcaccttttttccatgaggtgggcacttgtgcttagtaatttcacaggttatgtcagcaagcctcataagaacaatgcaaggaaggtaatatcccctttattcagatgcatgaacgaaaactcagatgtggttatggttaatgacaacactgagattttgacatatgtctgttagactcaaaagcttgtgccgccggatgcggtggctcacacctgtaaccacaacactttggaaggccaaggcggacagattgcttgagctcaggagttcgagaccagcctgggcaacatgctgaaaccccgtctctagaaaaaatacaaaaattagctaggcatgatggcatacacttgtagtcccagctactcaggaggctgaggtaggaggattacttgaacccgagaggtcgaggctacagtgagctgtgatcatgccactgcactccactgtgggagacagagcgagaccctgtctttaaaaaataataataaaaaaaaaggctgggcgtggtggctcatgcctgtaatcccagcactttgggaggccgaggtgggcagatcatgaggtcaagagatcgagaccatcctggccaagatggtgaaacctcatctctactaaaactacaaaaattagctgggcgtggtggtgtgtgcctgtagtctgagctactcgggaggctgaggcaggagaatcacttgaacctgggaggcagaggttgcagtgagccgagatcatgccactgtactccagcctaatgacagaaagagacttgtctccaaaaaaaaaaaaaaaaaaaaaaaagggtgggggacaaaaataagataaattttaaaagcttgtgccatttgtgctactcaagctctcatcacaaaatcaatacgtaagtgaccatgaaagcaaaaacattttcatcatggtctaataataacactcccttggtttctctagtactgtcaaaaaaggacaaaacttttaaacttttcatatacctagttacagtttttaaaaggcagtttggaccatgtacttttaatgtaaactttaaattctttaataacattttatctatatgaaatatattgtctcctgaaagaaacaagaatctttcaagattttatattcaaacaattttaagtccaaacaactaagttttctccagtttgaagtgaagaaaatagcatcaacggtgctttctgctccttctcaatgtcaaaggctcattcagcatattcaacaaaatacagagcagtgtctactagcaaccccagtagataatactattaagagcgaaaagcaaaaaatcttcttgttttcatatccttttgctcctttccttactgaatcacagtcacagtatgtcaatctcaatttgacagataacaagtcctactcctacctgctcattctggagtatgaatgccaccaaacctagctagtttcagaattatcactgtttctaaagtagtttctggatcacaattcattaaatgagtctagaatccagacctgtcagtcaaaatctacaacaaataccctttaaagtatgtatactcctcatccctatcttccttggataaaagaacaatgccttacaagagttgtctgatgttactccagtccacacacatagtaggtactttggtgctacagtgctcatgaaatttgtagccacaagtctgacatcgaaatccattgagcaggaatttctgacagatgtcacagaaggcaagcttcaggaacgtcttccgagcctacaacaagaacacaggtgtaaattatgctgaataaataaaagatgacaaaagacaacttcatttcttggcctccaaaaaagtttttacaaaatgaatcatacttccagcatgtacagaattcataatcacaaattagagtatatctctgactaatgaaatctaaattgccttactgtaaacaacagcataaagaactttaaacaatccaactatatatatatatacatacgcatattacctgagaaatctctgttatgcctggcaaagccctcaacatgccagaaagagaagagatctgcaacttacaaagttgtgtgttgtgaggggaacatgatccaggaaatctacttgaagttcttctccaatcaaagacgcagcatcagtattccaatctaagcgtgcttttttactagaaaggatttaaaaaaaacatgaaatgtttaaacaagatcaaagttcaatagaaataacaacagctaccatttatcacatgccatataaacacaactttatttaatccatacaacaataatttatttaattcatacaacaaacctatgaagtaggtattatttctatctgaaaaataagaaaactgggactctaagaaggtaatttgctcaaggccacacagcaagtttaagggcctatgttggaatctaggtctgttgaactccaaagcccatgttctcagaataaagttttctctttatttacttaaaaaaatgttttttggtagagagagagtcttgctgtgttgcccaggctggtcttgaatccctggcctcaagcggtcctcctgcctcagcctcccaaagtgctgggattacaggtgtgaaccaccatgtctggccagaataaagttttctttaaacaatgatatataaaatctcacaataaagtcaatatacgttaaattggaatttgtaacactaaaatcttacaaaaatccccaaatcctgtaaaatggattataaatattgctgcagtacaaaatttagtcttcagtagcctatttcaatctagataaatagaaaggaaccacaaatgaaaaatgtacttttctattaattaataacagactcaaatctgtagttgtagggtctataagtcaatgagaaacttaactgtcttaaaatctactctgaaaccacactttctgtgcctacagtataaataagacaaaaaatagatacataagtaaaaagtaatgcccaattcctttcttatgttttatccagttaatctggcccattttccaaaggaagaatattctcaggtaaagagaaaataacatgtatagcaccattcaagcctctccattatctaccagaagcctagtcaagccatttttctcactatccaacagtaaacaatacattccttaatataattacctatacagcacctggaaaacttcctataactccaaaggactattttgcccttatgaagagaaggaggacaagccttattttctcatcaatctgcagactgatcctagtgacaatctgctgtctgtcctagagactccagagtagctccaaaccagtgcagccttggatgagagtagaccaagccctccctgtctcagaatctctctagtccttaaggaacactatggattggcttagggacccaacctgggctaccttcagcaaaagttaacgtctgcttcaaagatttgcacttcaacaaacgcctcctaaattgagaattacactcaccccttcgagtagattcattccctgggctattctcccaaactgcagaactctttgaaacatgaaaaaatgtaagctaacgatgaataacataagtgacgctttccaagaagagggtaaaaaagaaccctttaaaggtttccctatattttcggggtggagggaataatggataatggataattatggacagctctgctgctttgaggtattactcctagcctttgaggggatgcctctatcttgccaccaccattaggaataggataaaccatgaatcttccctgaagcagaaatgcttctgcatctttaaacaatctatcaaacagcagggattagtacacatttaactgaataaaaaaaaaaattagtgaatgagaaaagtcaatctcccgaggatagcattctttatataaaataatgcactttctgagtgcccagtctatataatgcattagagtaaacacaaagaaaaatctttgtctcaaaaaaacacagcatctaacatcactgtttccatccatggaaacattatcaatacctaacatgtgtttgtttttgtttttttgttttttggctttttttaatagacaggatcttgctccagcccaggctggagtccagtagcacaatcatgactcactgcagcctcaagcccctggggtcatgcaatattctcacgtcagcctttcgaacagctaggactacagggccgcaccaccatgcctggctaatttttaaaaatcttttgtagagatgggccttcgctatgtgcccaggctggtcttgaactcttggcctcaagcaaccctcttgcctcagtttcccagtgttaaaattacgggtattaccatcctggctaacacggtgaaaccccgtctctactaaaaatacaaaaaattagccgggcgcggtggtgggcgcctgtagtcccagctactccggaggctgaggcaggaaaatggcgtgaacccgggaggcggagcttgcggtgagccgagatcgcgccactgcactccagcctgggcgacagagcaagactccacctcaaaaagaaaaaaaaattacaggtattggtcatcaggcccagcttaacgtgtatttaacttttcaagagaatgtccaagcaataatttcaatttcttaatacctatttttctgaattatctctttataaagaaaggtatagaaatatacaatattctataggaagctagtacaatttaatacaaacatagctatttgaagctagaagatccttactagtctgaagaagtcaattgacttttgagctcttaccctttgtgttcgtggagaagtctgaacactgcacagcactctggttgcaggcccctcaccttgagtgctttcataaggcagtcatgcaagctcattccatttcgcacattgacctacaaacaaaggaccacctttaggaccaacacaggctgcagcaccccttggaaaggtgggcacagaaataaatgcaccagtctgtattgcttgtgatggcccacgcacacacacatatacgaaacaacctgaatgtccagcaataggaaagtacttgaatggagtgtgagacatctgtattatgtcacattatgcagctattatattacttataatgacctggatggagaggagtccatgatatattaattgggggaaaatatccttcagaataatagagtaagattattttaaaggtgaagaggccaggcacggtggctcacgcctgtaatctcagcactttgggaagccgaggcgggtggatcacctgaggtcaggagtacgagaccagcctggccaacatggtgaaaccccgtctctactaaaaatacaaaaattagccgggcatggtggtggacgcctgtaatctcagctacttgggaggctgaggtaggagaattgctggaacccaggagggagaggttgcagtgagctgagatcgcaccattgcactccagcctgggtgacaagaacgagactccgtctcaaaaaaaaaaaaaaaaaaagtgaagaaatctgtatatgttatacaagtggaaagatttacacctagctgttcacatcaagagacagttaagaaagtggttagaaagtggttaagaaagataaaatgataaacttttcctttatacgtctctaattttgtgtgattagaatgtatacacatatatgttcactagattcattagagaggaaataagccaatctgatctataaacaaacgagtttttatgatcaaaatttgtacttcaacctctttcaacaaaaatgactgatgattctaacaaaaattccatctcacaagtacttaacactagtgaaggcaaagcaggaagtggaagatatagaactccagccctgctgtagggacaaacaccaatcttagtttaaatatatgtgcacaccataccaagcagccttagtggcacatacttctctatattcccctgtactcaatcctcaaaaagctaggcaggtactcagaaccctactgggaagtgtgagtgcccaggatactcacaattaatggcagctgtaaaaaaatttgaatgaaaatttcagagttttgataaaagccctccatgtttaacttcaaagccaagaattaatcaaaagtaaggtaactagagtcagtatggccagcaaggagggcaaaacagagatttgcagtgcttgtgaactgcctaccaggttcctcctctgattgaaagtgctaacagctgacagcagccagccaaccgctcccccaccccgccatccccccccacaccccgcccccagaaggtggtgagtgtatgcatatatctacctatgtgggtacacggggagggggaaggaagtaaagcagggctgcaaaaggcccaaagtgttcttaatcttggctcttactccagccacctcaatgccaatccagccaaccttctctagctggtttacaacagaaaaaagtcttaagaaagaggacatagttatctgggcccttctagttaccaggctccaaactagggcatagtatgtggatgcaaagcagagaaaacaatctaggaaagaagggaatgcatgtaagcataaggaatttgaaaacatcagagaggggcaacgtaagaagtttttcacaaggctttattttgctatcaccagggactgaaggggacttatctgcccagtaatcattctttgaagcccaaagatggactccacattgagagtacagtatagaagaatttgaacttgtaacagattagtcgagaaggtgatgggagtggggaaggaatattctccaggaggatcaatcatctgggagaaggaaaagattctccaaacgaaaaaagttcctttggagtttgtgatagcctccttagctaccgatggtttttcctctccttcagagatgtggaagaaaggaaaggtcgtgaacaacagggtaaggggaaaccaactgattcttcgaatagataaagattgatcataagaaacctctgaggaaaagaaatggggatacaggggcaggggtcacccaagacttttggctcatatgaatgctttacctatttaaaaataaataaaattagcattctttaaaagtttcttgtacataccaaaatagttcagacaaatgatacctgggatttgtgtcaaaacactgggaaaggagtggatgaaaacagattaagcaggcctgccatggttagctaagtgttgaaagtgggtaaggggtacatcagatttgttattttctctacgtgcgtgcgtgtgtgtgtgtgtgtaaaatctatattatatatactgagacagaatcttgctctgtcatctaggctggaatacaatggcatgatcatgacacatgtaccctttaccaccccagtttaagtgatccccctgcctcagcctcggctgggaccacaggtgggcagcaccacttctagctaatgttttttttttttgtagagacaagatctcactatattgcccaggctggtctcaaactcctgggctcaagcaatccttccacctcagcctcccaaagtgctgggattacagggaagagcctctgcacccagcctgtatatattttttaatgttccaaaataagtttattttaaaagtttcttgacgcagtgatacccaccaacttccagcttttcagaaacaaaacaagtaagctatactgatgtgaactactaagacactaagaatgaggaaaacaaagagtaataaacatacctaacggaatcatgacctgcatcaaatactgtatagcaatgttttctaagctataaagtgatatctgttacattatcagtcttcactaaatcatactgcaagctggacagttctttaaatatcatctaatccagtcagattcccaaatgtagctggcattagaatcctcagagaagcttgagaaaatatagattccatctacctgtccaacacatccaaggattctgattcagttagtatggaataaagcccattcatacagaatgaatctgtattttaacctgctggtcagctgactctaatagtagtggtcctcggctccagtcaatcacttatctaataataattagaagcagtagcagcagcagcaatagcagcaacagcagcaggaggaagtcaaagaggcacacatttagaaaataaaaattccaagaaacattcaaaaacctaattatcacatctaaaattatttaaatcagatacgcgtcctctgtctcattctcctctttacagccctccatggatacatgctgaaatcagttaaataatttctagaacccactgagtgattatgagagtcattctgggttcaggaagtaaagcaacctggggaggagtaaaaagagctgactgatggtgctggcctagctaagcaactcttccctcttctaccgctttcctcaagctgcgtgcctggtgaaagcagctagttcttccacagttagttcatctttacccaaagaaacaggcaaaactaacctaggctacaaccttctcataagctgtaggagaagtcaagcttggcttccaaccaccagctgtgctcaaatggaggggatcaaggactacatagatgtataaaaagctaagaaataatcatagcagccgggtgcagtggctcatgtctgtaatcccagcactttgggaagacgaggcaggcggatcagaaggtcaggagtttgagaccagccttgccaacatggtaaaccctgtctctactaaaaatacaaacaaattagccaggcgtggtggcgggtgcctgcaatcccagctacttgggaggctgaggcaaggagaatcgcttgaacctgggaggtagaggttgcagtgagccgagattgggccactgcactccagcctgggtgacagtgagagcctccatctaaaaaaaatacatataataataataataatagctaccacttcacttatgaatcagccactgtgctaagtacaagcctcatttcataaaggtcaggaaagaggatcaaaaaagtacagaacttgtctaaatgatacagctaataaaaggcaatgaggatttaaattgggattttcttgttttaaaggttcatacacttaatcactatgccaaattaagtttcccagccttctgggcaaactggtagcagatggggatggagaagatagtctcaataacactttgaagaagcaccaaatggtcttcagcttctcataacacacacttcctatctgacttctcaatttaaggtcacaaagaaaattaatgagaaacagtaggcaaaattactttgcaaatggaagaccattgttcagatataggggattattactgcttattttgccagccataaaattttcatttttaggaagagagacaaagataaacttactcaaactttaattaaagttagacttttgagttttgccttcagttcaaaatgcacctaagtattcaacactacacttgggaggctccttaggttcacaaaaaaagtataaacaatttattaacaaattgggaagagtggaactgttagaagcaaacagaaaactctggactggggttccccacctcagaaccttgcttcacctgactatatggaataaacacaatgcattgattttacacaaagaacagaggatgggaaaggaagaggcatggaagttttgaacccaagttttctcaaaagttccaccaagcaaaaccaatgcaatttcacttttctgttttggccaggtggttggttttgtttgttttatccataatagtagaaaactttttttgtttttcttttctttgagaaggggtctggctctctgtcacccaggctggggtgaagtggtgcaatctcagctcactgcaacctttgcctcctgggctcaagccatcctcccacctcagcctcccgagtaccgagtagctgggactacagacgtgtgccaccacgcccggctacatttttgttgttatttctttttttaatatagtctcaccctttcgcccaggctggagtgcagtggcgcaatcctggcccactgcaacctctgcctcccgggttcgagtgattctcctgcctcagcctcccaagtagctgggattacaaacgtgcaacaccatgcctggctgtaatttttgcaattttagtagagatggggtttcaccatgttggccaggcttgtctcgaactcctgacctcaagtaatgagctggcctcagcctcccaaagtgctaggattacaggcgtaagccactgcaccaggcctacttttttgaatttttttttgtagagatggggtttgccacgttgcccgactggtctcgaactcctgagctcaagcaatctgcccacctcggtctcccaaagtgctgggattacaggtataaatcaccacacccagccagaaaactttttgagagctaaattcttagaaaaattgaagttttgttatcaggctgggcgtggtgtctcatgttggtaatcccagcagtttgggaggccgaggcaggtggattacctgaggtcaggagtttgagaccagcctggttaacatggtgaaaccccgtctctactaaaaatacaaaaaacaaaaatcagccaggcgtggcggtgtgtgcctgtagtcccagctatttgggaggctgaggcaggagaatcacttcaacccaggaggcagaggttgcagtgagctgcactccagcctgggtgacagagtgagaatccgtctcaaaaaaaaaaaaaagaaaagaaaaagaaaaagaaattttctatcagaaaacctagtggcagtgtcctgccatgatgccaatatgaacctgtcactggcactgaaaaaataaactacgcagaactaagtggctggtgtcagtgccctgaaaaagaagattctatgatttctaagctgcctccagactggtcctgggcctatgaaatatacaaaaataatcttttctatgtaactttactttcttctttatacttgattgtaatagtcaaaaagctttaggtgaatattttaatagaagaaataaaatgtcttctaaaataagtagttggaaaggcctagagacttctcaaagaaaagtctttgaaatatacccataagaatgtactatttgtttggatgaagtggcacaaaggaagacattccaggcaagagtaacagaaggaaggccaagaggtaggaaaaaatagggggtgtggaaggaacagcaatataaaaaaataaatctgcagttagaaaaaaaaaaataaagaccctaaatgacaatgaatattttgcctgtctttaagttgaacatgatccttaatgtgctccacaggcagataaatagctaaatttcctaagtagaatgttcacataccactgttctttgcttgttcggcaagaaaacacggatagtgttgcttgtcttagaaggatctgtgagtttgccatcatctgatgcccggcgctgatagccaaactgctgaactattgtaggagagatgcagctggagccatcaaacacggcatctttgaatccaaaaccattgctgatcgtcttccaagctccctgtatgtgctccattgatgcagcttaaacaattcttaaacctggtaagaaacacaaataattgtaactctagaacaaaagtattcaacccaagaacacaatacataaagagtaattatgaaaatagcactatgtgggtttttaatgatacctcctgcattcatcagcaaagaaaagtttctttaatagtacacttccattaaatatttcatagatgaggaaaatgggaccagcagttaaaagatttagcaagcaactgcggggcacggtggctcacgcctgtaatcccagcactttgggaggccgaggtgggtgcatcacgaggtcaggagatggagaccatcctggctaacacggtgaaaccccatctctactaaaaatacaaaaaattagccgggcgtggtggcgggcgcctgtagtcccagctactcgggaggctgaggcaggagaatggcgggaacctgggaggcggagcttgcagtgagcggagatcatgccaccgcactccagcctgggtgacagagcaagactccacctcaaaaacaaaacaaaacaaaacaaaacatttagcaagggaccaggcacagtggctcatgcctgtaatcccagcactttgggaggccgaggccagcgcatcacttgaggccaggagttcaagaccagcctggctaacatggtaaaatgctgtcactacttaaaatacaaaaattagccaggcatggtggtgggtgtctgtcatcccagctactagggaggctgaggcaggagaaatcacttgaacccaggaggtggaggttgcagtgagtcgatatcgtgtcattgcactccaggctgggggacaagagcgagactccatctcccaaaaaaaaaaaaaaaagccaacttggaacatgagcccaggtctcaagacttctagtctattactttttcaactacatttctcttcttcctaagcaactactacccttgagtgtgagcaacacattagtactatgagaaatacctgaaaaaaagtgtaagccataatttatgacttcaaggaagaaaaactaatatttctaggatgtattttaggcactttataaattatctcaagccgggcatggtggctcatacctgtaatcccagcactttgggaggccgagatgggcggatcacaaggtcaggagatcgagaccatcctagctaacacagggataccctgtctctactaaaaatacaaaaaattagccaggcatggtggcgggcgcctgtagtcccagctactcaggaggctgaggcaggggaatggcgtgaacccgggaggcagagcttgcggtgagctgagatcgcaccactgcactccagcctgggggacagagcaagactccatctcaaaaaaaataataataataaattatctcatttaatttgtgtaagaaccccaaagattttcttttcttttcttttcttttgagacagagtctcactctattgccaggctggagtgtagtggcgcgatcttggctcactgaacctcccaggttcaagcgattctcctgcctcagcctcccgagtagccgggattacaggcatgcaccaccacgcccgactgatttttgtatttttagtagagatggggttggccatgttggccaggatggtctcaatctcttgacctcgtgatctgtccgcctcggcctcccaaatcacgcctgggattacaggcatgagccaccgtgcccagccagatttttaatcccttcctccatccacactttctttttaattaatttattttctgagacagggtcttgctctgttgcccaggctggggtgcagtgacatgatcacagctcactgcagcttcaattttccaggctcaaatgattctcctacctcagcttcccacatagctgggaccacagacgtgcatcaccatgcccagctaatttttaagaacagttttttttgttgagaaaggctctcactatgttgcccaggctggtcttgaactcctgagctcaggcaatccactctccttagcctcccaaagtactgggattacaggttcagtcactgcaaaccctttcttttttggacacagaagtcatgctacttgcccaagaacaccccagcagtgggtaaaataaccagattctttatctgtttaaatttaaagtccatgaattttctaccataacattcagagttcagagttcagttcattcagagttcagagttcagttcattcagagttcagagttcagttcatggtcagaaaccatgcagaagtaaggggggtagggtttcctcctttagaaaactttgaggttgataaggaatcccatcttttcaagccttcctccttcagaaacttgttttattattaacagtagctaccatttactaaaagcttactattatgaggcaggatacacagcatacattccaatcattatccaccttaatacttacagtattactctaggtaggaattatgtccccattttacagttgagaaaattctcacacacacagcttgtaagtggcaaactgggattctgaactgggctgcactgactccatagcccttaccttcccatatataacactaacactcaaatcattttagtcagagctgaaatggcctagaattaaagaccacagaatccaaaccttgttttcaaccaaaagtttctaactgaatatccactatatgctaaatcacatcacatgcccaaatcaagagggaggttagatacttagtattcttagatgacagctaagaaaaccaaagaggtttagagacaacttaagatcacaacatggagttattctcatacagtctttgtacattctttttgggaaagaatacggtaatatctattaaaagtttgaaatgttcttaaagaatgacctagtattctactccagaaatttgtcctacagaagcctaagacaagtgtataaaaacatgtgtaagcatattccttgcagcactattcatacccttgaaaaactgtggtaaagaccaaatacctaacaatagggaattaaataaaccatgttaatatccacgtgataaataaagtagatccatatatacagaggtgggaaaagatatccaagacaacaaaaaatgaacaagtctgaaccctttaatattaatctacaaagagggaaatctagaaataaataaatggatggggaactctagaattaaagtgttaacagtaatcatttcagcaggactgtgaagggtttttattttctacattacttactttttgtttttatattttactattacactataaacttttatcggcatattttatttctgtaagaggggatgacagaacaagatctcgctgcctcctgcctctaaagcctcaacctgagccctgactcactcctacataactctatccccaggttactatgaggtccctttttaggagtacatacagctcctcttttttctagatctttgagtttttttccaactaaaaaggaaaagatggaggagcttaagaccagataagagagaaatagatgacggaagagacagaaggcagactcatctgagcatctcactagcctgaaatgatacagctcctaataatccatgtaacagcctgaacaggcttaaaatgcaactcattgtgtcactcccgttttaaaactcagaataaaatctaaactccctgacaaggcgtctaaaggccttctttcgtaacatgccagactttgtgcctcaagacttctgaacttcgtgtttctcttcacctgcaaggctgaaaccccaaaaacaggcaagctggttttttcacatcttgtctccacccaagagacatctctttagagaggctttccctaaccacactagccaaaatagcctgctctccttctgccaattaatactgtttcattttctgcatggtacttatgttagacagttttcaagttttagtcagtccccctaccttccttctgctccataagggcagaaccctgccaatcttgctcagtatctggaatacaaaggcactcaaatatttactaaattaagggaaaagccagaataatgctacaaaaacagtaatgtttttaaatagaaaagacctgtcaaaaactatcaaatgtgaatcaaatctccatttagtggtacatctttaaaaaatactttgtcagccgggcgcagttgttcacacctgtaatcccagcactttgggaggcccagatgggaggacagcttgaggccaagagttcaagaccagcctggtcaacacagcaagaccccatttctaaatttaaaaaaaaaattttaattacaaaaacagtattttgttttccagcaagatgaactgtaataaattttattttttatatagatatatattttcaattgagatgaggtctcactatgttgcccaggctggtcttgaactcctaggctcaagcactcctgccacacttgtgcccctgcacccagcttgcaatagattttattctatattcaactgtgggggaagactgtattggaattgactgattccaatcgattggtgaagaatccactgataagactaaaatgtaacctcagtccaagaacagtaattttacaatgaattctaagtcttgcaggcactcaaaatatagtgctggtactcagtagagaatatactgcaataacttttaataaaaagtgacaaaataaaaatacacctactttatttaattcaagttttagattatttgtcattcatagtattttattttctatctccatatcaagaccacttacagcttaagaggcaggctaagggttgggtgcgggggctcacgcctgtaatcccagcacttagggaggccgaggcagatggatcacgaggtcaggagatggagaccatcctggctaacagggtgaaacccctctactaaaaatacaaaaaattagccgggcgtggtggtgggcacctgtagtcccagctactcaggaggctgaggcaggagaatggcatgaacctgggaggcggagcttgcagtgagccgagatcatgccactgcactccaaccagcctgggcgacagagcgagactctgtctcaaaaaaaaaaaaaaaaaaaaaagaggcaggctaagttaatgtttcctaacccttttcttttttctttttttttttttgagacagtcttgctctgttgcccaggctggaatgcagtggcgcgatcttggctcactgcaacctctgcctcccaggttcaagaaattctcccgctgcagccttccaagtagctgggattacaggcatgtaccaccacacctggctaatttttgtatttttagtagagacagggtttctccatgtttgccaggctggtattgaactcctgacctcaggtgatccacccgcctcagcctcccaagtgttgggattacaggtgtgagccactgcacccggccttcctaaccattttcatggcacatactcatacaaacgataggtcatatttgcagaacatgctgaaatacgcagacaatgctgcttcaagggccctacaagttgtctcagggaagagaggtacaactctaacctgttaatcacagaaaattctactaaggtattcctttatcaacgcaaacatctgaaaaatcagggcagacatctgaaaacaaggaggaaaaagcatcttctaaaaaaatcatacagcagcaacatacttcaatcttaaatggagataatcagaaaccctgttgatactaccttcaaatataagcatagatctagcttttaatactgtaatttctctgactaaaggccccatgttaaaaaatgtatatacagacacacatacacacacatcctagacacacactaaaactagataagccaaagtgaaaatcagcttctgcatgtgaaaggtcttttaaagttccacagataagttctaaaatcaaatgcagtctcttatgaatggagaaatttgtcatgttggaaaagatcaatcatttaaaaagagagacatgttggccgggcacagtggatcacccctgtaatcccagcactttgggagaccaaggtggatggatcacctgaggtcaggagaattgcttgaacccaggaggtggaggctgcagtgagccgagattgcgccactgcactccagcctgagcaacaaagcaagactccaactcaaaaaaaaaaaaaaaaacaaaaacaaaaacaaggagctcctaaaaattagtaaaagatgaacaatgccattgcaaaaaaaacaggaaattaaattcacagaaaagcaatacaaaggccaacaaacatatatgtttatatataaagtagggaaacacaaatataaaaactattttttatcaatttgtaaaatttattttatttttatttatttttttgaggcggaatctcactctgttgcccaggctggagtgcagtggcgcaatctctgctcattgcagcctccaccttctgggttcaagtgattctcctgtctcagtctcccaagtagctgggatcacaggcatgcgccactatgtctggctaattttgtgtttttagtggagatggggtttaatcatgttgcccaggctggtcttgaactcccaacctcaggtgatccacccacctcagcctcccaaagtgctgggattacagccatgagctactgtgcccagacagatttgtaaaattaaaaaggcaaaacatctagcacaagcatttgaagtattctactctcacagtgaagagtataaaccacagaagtacagcaatctaatagtatctattaactgtttaaagatttaacttcacatttcacacccagcactacacaaacacaggaatgtttctaataccaataaactgaaaattacctcagactcaaagccacagaactaaaattggaacaatttaaggcaggactggtttaaaaacaagacctcccaggaaagaatactgcccccagtacattagctgaaggtctaagtgaaagaatatttacccccagctacttaagaggctactcaggatttcctgaggccaggagttcgaggctgtagtgcatgactgcacctgtgaagagccactgaagtccacctgggcaacacagtgagatcacttcacacacacacgagtcattttccataatttaagaataaggtcagtgtcacctgtcaccaataccaatacaatttaatacttccaagtactatatgcgtagtataatatcgaaagtaaaccatactgcaggaaatagataagcattaaaaaaaaaagtaggccgggcgcagtggctcacgcctgtaatcccagcactttgggaggctgagacaggcagatcacctgaggtcaggagtttgagaccagcctggctaacatagtgaaaccctatttctactaaaaatacaaaaaattagccaagcgtggtggtgcgcgcctgtaatcccagcaatcccagctactcaagaggtggaggttgcagtgagccaagatagcgccattgcactccagcttgagcaacatgagcaaaactctgtctcaaaaaaaaaaaaaaaaagtaaaccaaacattaaaaaaaaaattttttttaattgttcatgggctgggcaccgtggctctcacctgcaaatcccaggactctggaaggctgagatgggaggactacttgagcccaggagtttaacaccagctctgggaaacataccaagaccccgtctgtacaaaaaaatttcaaaaattagctgagtgtcatggcatgcacctgtagacccagctacttgggagactgaggtgggaggatcacttgagcaaaggaggtcgaagctgcagtgtgccacgatcacacaactgcactccagccaaagcgacagaccgagaccttgtctaaaaaaaaaaaaggcatttaaaaaaagaatattgttaagtatgtaatttgatgatactttggtaacaaaaagtttatatggaaactaattgtaaaatcacatttctgctcaatgataaagttttttttgttgttgttttttaaagataacttcgccaggcggggtggctcacgcctgtaatcccagcactttgggaggctgaggcaggtgaattacctgaggtcaggagttcgagatcagcctgaccaacatggtgaaaccccatccctactaaaaatgcaaaaattagccagggttggtgctgcacgcctgtagtcccagctactcaggaggctgaggcaggagaatcgcttgaacccaggaggcagaggttatagtcagccaaaactgtgccattgcactccagcctgggtgacagcgagactctgtctcaaaaaaaaaaaaaaaaaagaaaagaaaaaactcttcatatatacaaaatagtagtaaaaacttttattaccacgaaagttcccaggctttaaacatttatttggtaagacagtctgggaacttgtattctataggcaaacatttacctttcacatgccagagaagacatagtgtattcataatttatcatgatatctaaaccatacaaattatttcagaagcctacaatttacttaatacaaattattctagtctagtacagaaattaggtttacctggttccaagctacttctctctggattcctgacttcccctggtcacccctaccaatcatcacagaatgcttcaaaaatcaaaaggcctagattctactctgttttgccttcctctactttggctactattccgttaaaaaattactacatgggcctaaccccaaaatcagtctctgaaagataccaggggacgttttaggatagaaaaaaagggatgactcataattgccagttatcttagctttctgtagtcacctactctatatctatcaatcatgaatttatataaacttctctacaactattttttctggtcgacattatttctgagggtggtaggttccctaggttcaccaaaaaaaaattgccttttattagcttcatgcatcattctgccacctggactttgaggatatatttgctttaaaatcaagcaattcatgactgttatggtgtaaattcttcaaagccgtatctttctataatctctcaactgcatttattccctatgtgaatatttcttttagaaagttagagtgtggccaggcacactggctcacgcctgtaatcctagcactatgggaggccgaagcaggtggataacctgaggtcaggaggttgagacccgcctggcccacatggcaaaatcccgtctctactaaaaatacaaaaattagccgggtgtgatggcatgtgcctgtaatcccagctactcgggaggctgaggcaggataatcgcttgaacctgggaggcagaggttgtagtgagctactgcacttcattcagcctgggcaacaagagtgaaactccgtctcaaaaattaaaatgttagagtgtaaaactatttctacattcaagttataaaatgggcttacagcctggccaggtgcggtagttcatgcctgtaatccctgcacttcgggagaccgaggtacgaagatcacttaggcccaggagtttgagaccagcctgggctaatccctgcactttgggagaccaaggtaggaagatcacttaagcccaggagtttgagaccagccttggcaatagtgagacctcatctctacaaaatctaaaaactagccgggtgtggtggcatgcacctgtagccccaactacttgggaggctgaagctggaagatcacttgatcccaggaattcaataccagcctggacaacacagttagacacctactctacaaaaaaaagtttttaaaaagtcatttttcctacttcatgtaactcaactctactagttttcatgtatttcattatcgtgttaataagaaaaaaatctcagtatattatactatcattcttttctcaggcactgtaagttattttgtgaccttatttatcattcaaatttctactttaaagtagaagatactttaatggatacactggcagtaacttctattcatataagtatgatgaacctgagactatttttggggggggggggtggcggggcacatggtctcactctgttggccaggctagagggcagtggtgcaatcttggctgactgcaacctctgtttcccacattcaagtgatcctcccccttcagcctcctaggtagctaggactgcaggtgtgagccaccatgctggctaatttttgtatatttagtagagatagggttttaccatgttggccaggctggtctcaaactcctgacctcaagtgattcaccagcttgtcttcagctgggattataggcatgagctaccacacccagccagttcactaatttttaaatatcatgacagttgtatcataattcctatggatcattttaaatcaactgacccatagaagtcaaccaaaaatgcaaaaccaacgaaacaatggtagttgtagaatccacatgttaaatattaaaatttatgtaaataattacaaaaagttggctattgtttaagatgtaatataaaattagaaccacaagcaagtgtccatgaaaaaacacaaacacttgacaaagcttgtttggctatctgaacaaaaacaataagtgtttgctctctattttggtactcgctaaaactcactaggcaacaagatatatccaccaaaaaataaatttcttaaaactctgtaccaactaagcagcagcaacaataatgatattagctaatgtattagctaatacagaatgcttattatgtatcagttctttacatacaatatcccttttaatcctcccaacaaccccctataagagaaattatcattttagagtgaggaatctatggaccataaaggttaagtaaaaatgtccaaggttacatggtattcagaatattcacaaatctcaccagggtttcatcacaccatcacatatgttaagatccgtgcattcatgggagaggcggttcctaagatgaggtgacagatttcaaccttgtggcagcctactctggcttcctggtatctggctctttcctctactctgataatctgtttctaattatacttttatttgtttatttttctaaggcatgaccggtctgggtctgttgcccaggttggagtgcagtggcatgatcatggctcactgcagccttgagccacgttcaagcaatcctcctgcctcagcttcctgattagctgggactacaggtgcacaccactgagtccagctaattttttattttctgtagagacgaagtctcactatcttgcccaggctggtgttgaactcctggcctcaagtgaccctcccacctcagcctccccaaagtgctaggattataggcgtaagccactacacctggcctaattatatttttacttacaataaaacaaaaactaaatttgggaaggaggataaaggggaagttactcacaattttactaatcctaacacatttttttgggtatcatcttctaatattagaggcacaataaataactatcagttcaaaatctacctccaccttttattagctgtatggcctggcctttcaccaaattgcttacctttcccatataccaattttcgtcacttattcatgcaataaacattactgagtgcctactatgtaccaggcactgttcaagatgcttgggctacctcagggaacaaaacacaaggatccatgatcataagagaagcctatcttctgctggaggcattcacagtaaattccatgatagtgggtgataagtgctggggaaagggaggcagactgcaattacatagtgaggtcacagtaggtctcaacgaagaggtaactgctgagacctggaaatcagtgagtctgacttgcagataactgagagaacaacattccaggcagaaagaacagccagtgaaaatcctttgtacaaggaatggtaaaaagatcatagacttgagtacaatgtaggggagcagggacaatgtgggtaacataatgccttgtaggttattaaaaggactttttgccttttactgagtgaagtgggaagccactgaaaggtcttgagcagaggaaaggcacaaaaggcacaatctaccttagattttttcttttggagacagggtctcactttgtcacccagagggagtgcagtggcacgatctctgctcactgcaacctctgcttcctgggttcaagcgattctcccacctcagcctcctgagtagctgggactacaggcacgtgccaccacgcctgactaatttttgtatttttttggtagagatggggtttcactgtgttggccaggcttaaatcttaaaaggattgttccaggctcactaactcatgcctctaaccccagcactttgagaggtcaaggtgggcggatgagcccaagagttcgagaccagtctgagcaacatggcaaaactcagtctctacaaaaaaatttaaaaactggccaggcgtggtggctcactatattaaaaataaatgacataggcagttagatatagaattatgaagttcagaagatgtctgggcagaagaactgtaaaataaagatattatttatctaattgagttgttactaaatggttcaatagtggccaggcgcagtggctcacgcctgtaatcccagcactttgggagaccaaggcaggcggatcaagaggtcaggagatcaagaccatcctggctaacatggtgaaaccctgtctctactaaaaatacgaaaaaattagccgggcgtggtggcgggcgcctgtagccccagcttctcggaaggctgaagcaggagaatggcatgaacccgggaggcggagcttgcagtgagccgagatcgcgccactgcactccagcctaggcgacacagtgagactccatctcaaaaacaaaacaaaacaaaacacaattgttcagtagtgtttgtaaagcacttagcattgcacctaacacagagtaaacgatactgttatagcttctatcccacagaagaacacccaccacaggagatgagagagggtggaaattcagctcatgcttcacttgctaggccatgtgtctagtatacagacagcataagcatgaaggatggggatccttctaattcacatgtagaagttttcctgctagctgagctacatctctgcagaggtacatctgttcaaaattgacctttttctatttagtaatggtgactttggggctgtggccctaatccttttccacatacccatgtacttttacacaattacactctcaatccaaatactgtatcacaatattctccttcaaatttaattttaaatgtttgataataaattatttaattttggcagggcacagtggctcacgcctgtaatctcagcagtttgggaggccaaggcagggggatcatgaggtcagtagttcgagaccagcctggcccatggtgaaaccctgtctctactaaaaatacagaaattagctggacacagtggcgcatgcctgtagtcccagctactcgggaggctgaggcaggtgaattgtttgaacccgggaggcagaggttgcagtgagccgagattgcaccgttgcactccagcctgggcaacaagggcaaaactccgtctcaaaaaaaaaaaaaaaaagagtaggcttgggtgaattgtcaaaataaacttattttctgaagcaatggatcactgtctgtttttttctgatcttttggggcagggagaagtaggtttaacctggaaaaggagggttgtgctactacttcatctttcttaagtgacaaagccttctaaaagtttagagaaggtaaagatacagattgataaaggcaaccaacaacagtgggtataatctttctaagaattccacattagtcagctttccatcagcaacttaaaagaaagagactattttctattttttatacccctttgacaaaaagtagaattcaacaacctagttcccgaagagctctctgaaactcttctgaaattcttgaaactctctaaaactcagtcccaggctgatccttttgtagtttataagcatgattgagttttcacactcatgtgtgagatgtgccttcttcaaaccttgtaatgacatggacacattacccatctgacgtgaagaggaaaaaacaaaaaaaagtagtcccaggcttatattcctggagaaggtaaattagaggatctcttgactggaggattccagacccagttgagagtatgaatactgttctgcaaactacacttactgaatccttgactgcagaaaccccttttccccagtggggcaaccaaactcaaagaaactaaaatctttagtttcccttaccttacaataaagctcaaagacaacaaatctcatccatgcacccaaagattccaatttgtttttaatcttatcttttaaaaaaataaagaggttgcaaaggaatatcaggctttttaggaaaccctcgaatatggatgataaagaccaaaacacacagagaaaaaaacccacaatggcctgtaatccagcactttgggagggtgaggcaggaggatcacttgaacccaggagttcaagaccagcctggacaacacagtaagaccctcatctctacaaaaaattataaaaattattccaacacagtggcgaacgcctgtactcccaggtataggctgaggtgggaggatcacttgagctcaggaggtcgaggctgccaagagctgtgattgtgttgtgccaccacactccagcttgggcaacagagggagaccctgtctggaaattaaaaaaaaaaaaaagaaaggaaaagaaaaaagaaaaaaatccacaatgaaagaacttgaactatcagattaaaatagcctatcgaatgcctaacacgttaaatatcacaataatggaggaccagattctataaacttttacagttaaaaaaaaaaaaaaaatacaggcccagcgcagtggctcacgcctgtaatcccagcactttgggaagccgaggcgggcggatcatgaggtcaagagttcaagaccagcctggccaacatggtgaaaccctgtctctactaaaaaatacaaaaattagctgggtgtggtggtgcgcacctgtaatctcagctacttgggaggctgaggcaggagaatcccttgaacccaggaggcagagattgcagtgagccaagattgtgccattgcactccagccagggcaacaagagtaaaaactctctcaaaaaaaaaaaaaaaaacaaaaaaaatcaggaatccgaatgacttcaaactcttcaacaacactagaagacataatggagcaaagcctcctagattctgaaggaaaactatctccaatttacaataatcagcaaaactatcagtgagggacagaactagagagatattttctgacattcatgattacaaaaatttgaacctccatgattcctttctctctttttttttttttgagatgagtcttgctctatcacccatgctggagtgcagtggcatgaccttgctcactgcagcctccgcctcccaggttcaagcgattctcctgcctcagcctcccgagtagctgggactacaagcacacactaccacgcctggctaatttttttttttttttttagtagagatggcgtttcgccatgttggccaggctggtctcaaactcctgatctcaggtgatccacccgcctcggcctcccaaaatgctgggattacgggcttgagccaccgcgcctggcccgtaattcctttctcaagggatttgttacaggaatatagcaagagaaagacttaggatataggaaacgggacatccagcataggaaagaagcgaaggaaatctccagaaggccaatggagggaaatccctgggtgacaactgtgcaccggatacaagaatccacaattatgtgaccccttctagcaatttccaactatcatctacataatggcctttttttcttgagagtgccagggagggaggaagggaggaaagtggttggaggaagagcagagagagggaaggagtaacagagaagggaaggaaatagcccatattttcaaagttagcccctttaagtatatcctctcccctttggaggaggtgaatggtaaaacctgtgctaggtcttcagatactccaggtagctgaacaacattaataaaatagtatagcaccacagtgtttcccaaagcaggggatatatactattcatggtttacaaaatgattataagagatatgtatacaagatataaactaaaactgatataaggaaaaagtctcagttaggtgctagtatatgtttaatacttctttaagactttctactagggcagccacgatggctcacacttgtaatcccagcactatgggaagccaaggtgggtgaattgcatgagctcatgagttcaagaccagcctgggcaatatgatgaaatcctgtctctgttaaaaatacaaaaattagctgggctgtgcacctgtaatcccagctactcaggaggctgacgcaggagaattgcttgaaaccgggaggcggaggttgcagtaaaccgggatcttgccactgtactccagcctgggtgacagagggagaccctgtctcaaaaaaaaaaaaaaaaaaaaaaaaaaaaaaaaaaaaggccaggggccatggctcacacctgcaatcccaacacttcaggaggccgaggtgggcggatcatgtaaggtcaggagttcgagaccagcctagccaacatggtgaaaccccacctctactaaaaatacaaaattagcccggtgtggtggaacacatctgtaatcccagctacttgggaggctgagacaggagaatcccttgaatctgggaagcagaggttgcagtgagccgagatcgtgccattgcactccagcctgggcaaaaagagtgaaactccagctccaaaaaaaaaaaaaaaaaaaaaaagagagagagagattactttataaatttattaggctgggcgcggtggctcacgcctgtaatcccagcactttgggaggccaaggtgggcggatcacaaggtcaggagattgagaccatcctggctaacacggtgaaaccccatctctactaaaaatacaaaaaattagccaggcgtggtggcaggcacctgtagtcccagctactcaggaggctgaggcaggagaatggcgtgaacccatgaggtagagcttgcagtgagccgagatcgcgccactgcactccagcctgggcgaaagtgcgagactccacctcaaaaaaaaaaacattaataatgttgtttttaggccaggcgtggtggctcatgtctgcaatcccagcactttgggaggccgaggtgagtggatcacttgaggtcaggggttccagaccagcctggccagtgtggtgaaaccccgtctctaccaaaaatacaaaaattagctgggcattgtggtgggcacctgtaatcccagctacttgggaagctgaggcaggagaatcccttgaacccgggaggcagaggttgcagtgagctgagactgcgacactgcactccagcctgggtgacagagcgagactccatttcaaaaaaacaaaaaaaaaaacagctgggtttggtggtacataccaccaagctacttgggaggctgagaaatgagaatcacttgaggccatggtggaagaatcgcttaagcccagtagttcaagaccagcctgggcaacataacaagactgtatatctttaaaaaaaaaaaaactgattgattacattaaaatgcagtaagcatggttgctcaaaaaaaaaaagggacatttgctacactggctaggtgtggtggctcatgcctgtaatcccagcactttggaaggctgagatgaggaagactacttgggtccagaagttcaagaccagcctgggcaacatggcgaaaccccttctctacaaaaaatacaaaaattagccaggcatggtggcttgcacctgtagtcccagctacctgggcggctgagaggggagaatcacttgagcctgggaggtggaggctgctgtgagctaagatcatgccactgcactccagcctgggtaacagagcaagaccttgtctcaaaaaaaaaagaaagaaagaaaaaatatttgctacatcaatgaacagcagcggcaacaacagtttcattacatactacataccctggagactatactgaacacttttggtttagtagataaaagaacaggtactgagtttgaaatccagcttcactacttgggcaactccatggatctagggtaaagataataatggtacaaacttcactgaattgcagtgaagaatgaataagatagtgtatataaagtacctaatttagagtccggcatataaaaaacattctaagttagcaaaaattgtgtacctccgctagtaaaacaaattcttcaagtgaaaagctgaactcgctcaatttttaagtgtattatactcactagtaaacctgggaactagattatcacctaggaactagggtatcgggttaacttcaatctttcaacttctgagaacttcagtgaattcacgaacttccagaaactgaatacagagtattgtatatatgcatatgtacatctttgtaggtcttgcttctattaacattttttttttgagacggagtttcgctcttttgcccagcctccccagtagcggggactacagcacatgccaccacacctggctaatttttgtattttcagtagagacagggtttcgacacgttgaccaggctgttctggaactcctgacctcaggtgatccacccgcctccatctctattaacatttgaaagcaatctgtcctctatggagcacagtcattgtgttcttaaaacacaaatggaggccgggcacagtggctcgcaggaggctgaggtggatggattacctgaggtcagggagttcgagaccagcctggccaatgtggtgaaaccctgtctctactaaagatacaaaaatcagccaggtgtagtggcacacacctgaaatcccagctactcggaaggctgaggcaggaaaagcgcttgaacccgagaggcagaggttgcagtgagccgaaattgcactactccactccagcctgggcgatagagcaagactgtctcaaaacaaaacaaaaaacacaaatttggacatattattaaataccctttatctattatttatttcactcaaattagcactcgaattctttaactgtgacctacaagacctttcatgatggcctggcccgttacccatcaaacaggacctcccctgaccaccctggttcaagtgtatcctacccttccccatcattcttctctttactcagctttttggttttcataataatttatcaccatttgaaataatattaggtatttgcctactcaatgattattgactgcctataccactaggtagtatgctctaagaagctaagttcagttcacccttataacccactgcctttaagtatctagcatttggcaggctcttaagagttatttactgaatgagtaacatatggcatctgggctatctggcaagtggtgagttctaacaaaagttatcagtgcagtcgtttatgaaccacattatgccaagagactatactcagaactagaacactgacaactgtggaaaaactgtagaatcagcatggagtaattgttgactggcagtcagctaaggagcagccaggataatgattggctggcagtcagtcatctaacagttcatcaaacaagtcccaaacagaccagctgataataatacccaattaaagctactatagaattctacgtcagaggtatttccaaagtttgattcactactattgtttggcattcccttcacagttgttttatattacaaataaaaccaaatacattcttgttcatctgttctgtcacagtaaacggtaaatattttctacctactcacacatccgatttgtcttaaatgtacactgctgaaaataaaggggacttttaaactacagggctcctgctcaagaaatgtaaaaatgggcatggtggctcatgcctgtaatcccaacactttgggaggctgagatgggcggatcacctgaagtcaggagttcgagaccaacctggccaacacggcctaaaaatacaaaaaaagaaatgtaaaaatgtgtttttaaacatacataaggtcatgtagaatgcaaaagaatgtacaggaacatgatggattacgtttattgatttgcatatgttgaaccagccttgcatcccagggatgaagccaacttgatcacggtggataagcttttgatgtgctgctggatcaagctgccttcatcctgggatgcaaggctggttcaacatacataatccatcatataaacagaaccaaaatcaaaactacgtgattatctcaatagatgcagaaaaggccttcaacaaaattcaacagcccttcatgctaaaaactctcaataaaccaggtattgatgggacgtatctcaaaataataagagctatttatgacaaacccacagccaatatcatactgaatgggcaaaaactggaagcattccctttgaaaactggcaccagatagggatgccctctctcaccactcctatttaacatagtgtcggaagttctggccagagcaatcaggcaagagaaagaaataaagggtattcaattaggaaaagaggaagtcaaattgtccctgtttgcagatgacatgattgtatatttagaaaacctcatcgtctcagcccaaaatctccttaagctgacaggcaacttcagcaaagtctcaggatacaaaatcaatgtgcaaaaatcccaagcattcctatacaccaataacagacaaacagagagccaaatcatgagtgaactctcattcacaattgcttcaaagagaataaaatacctaggaatccgacttacaagggatgtgaaggacctcttcaaggagaactacaaaccactgctcaacaaaataaaagaggacacaaatggaagaacattccatgctcatgggtaggaagaatcaatatcgtgaaaatggccatactgcccaaggtaatttatagattcagtgccatccccatcaagctaccaatgactttcttcacagaattggaaaaaactactttaaagttcatatggaaccaaaaaagagcctgcattgccaagacaatcctaagcaaaaagaacaaagctggaggcatcatgctacctgacttcaaactatactacaaggctacagtaaccaaaacagcatggtactggtaccaaaacagagatagagaccaatggaacagaacagagccgccagaaataataccacacatctacaactatctgatctttgacaaacctgagaaaaacaagaaatggggaaaggattccctatttaataaatggtgctgggaaaactggctagccatatgtagaaactgaaactggatcccttccttacatcttatacaaaaattaatttaagatggattaaagacttaaatgttagacctaaaaccataaaaaccctacaagaaaacctaggcaataccattcaggacataggcatgggcaaggacttcatgactaaaacaccgaaagcaagggcaacaaaagcccaaattgacaaatgggatctaattaaactaaagagcttctgcacagcaaaagaaactaccatcacagtgaacacgcaacctacagaatgggagaaaatttttgcaatctacccatctgacaaagggctaatatctagcatctacaaagaacttaaacaaatttacaagaaaaaaatcaaacaaccccatcaaaaagtgggcaaaggatatgaacagacacttctcaaaagacattcatgcagacaacagacacatgaaaaaatgctcatcactggccatcagagaaatgcaaatcaaaaccacaatgacataccatctcacaccagttagaatgacgatcattaaaaagtcaggaaacaacaggtgctggagaggatgtggagaaatagaacacttttacactgttggtgggactgtaaactagttcaaccattgtggaagtcagtgtggcgattcctcaaggatctagaactagaaataccatttgacccagccatctcattactgggcatatatccaaaggcttataaatcatgctgctataaagacacatgcacacatatgtttattgtggtactattcacaatagcaaagacctggaaccaacccaaatgtccatcaatgacagactggattaagaaaatgtggcacatatacaccacggaatactatgcagccataaaaaaggatgagttcgtgtcctttgtagggacatggataaacctggaaaccatcattctgagcaaactattgcaaggacagaaaaccaaacgccgcatattctcacacataggtgggaattgaacaatgagaacacttggacacagggtggggaacatcacacaccggggcctgtcatggggtggggggagggaggagggatagcattaggagatacacctaaagtgaacaatgagttaactagttaactggtgcagcacaccaacatggcacatgtatacatatgtaacaaacctgcacattgtgcacatgtactctagaacttaaagtattaaaaaaaaaagaatgtacagaaagatttcagatatggagaaaaaatagttccacttacaggaaatataacaatttccaaatatttggtggacatgtcccccccaaaaaaaaatgttttttggtttttttttttttttttttgaaacagggtctcgctctgtcacccaggctaaagtgtagtgccgcgatctcagctcattacaacctctgcctcccaggttcaagggatcctcccacctcagcctcccaagcagttgggaccacaggcatgtgccaccatatccggctaatttttgcttttttcatagagacagggtttcaccatgttgcacaagttggtcttgaactcctgagctcaagtgagctacctgctttggcctcccaaagtgctgggattacacatgtgaaccaccgtacccggccccaaaaatgctttcttaagtgtaactacgtaatgctagttgtagtttagattcctggatgttaacttaaaatagtcccataggaacccagtgtggtggctcacgcctgtaatcccagcctgaggcaggtggatcatctgaggtcaggagttcgagaccagctgggccaacatggtgaaaccctgtctctactaaaaacacaaaaaaattagctgggcatagtggcaggcacctgtaatttcagcttctcgggacgctgaggcagaagaattgcttgaacccaggaggcagtggttgcagtgagcccagatcgtgccattgcactccagcctgggcaacaagagcaaaactctgtctcaaaaaaatcaattaatttaggctgggcgcagtggctcatgcctgtaaatcccagcactttgagaggctgaagcgggtggatcatgaggtcaagagatcgagaccatcctggctaacacggtgaaaccccatttctactaaaaatacaaaaaaaaaaaaccccaaaaaacaaaaaaacaaaaacaaacaaacaaaccaaaaaaacacaacaactagccaggcgtagtggcaggcgcttgtaatcccagctagtcgggaggctgaggcaggaggagaatggagtgaacccaggaggcagagcttgcagtgagctgagatcgcgccacagcactccagcctgggcaacagagcgagactccatctcaggaaaaaaaaaattaattaattaaaaaaacagtaagataaataacacttctcccatttcagtaaaaggatgaagccagtttctcaatgaataaaaacaagagactgttgaatgtcaagttttatagacagtccagacaacacagggagacaccatctctacacacacacacacacacacacacacacacacacacacacacacacacaaaatagctgcgtatggtggcatgggcctgtagtcccagctattggggcagggccagggggtgggaggctgaggggagaggatgccttaacagggaggttgaggctgcagagagccatgatcacgtcactgtactccagcctgggtgatacagcaagactctgtctcagaaaaaaaaaaaagaaaaaagtcaagaatgcattcttgaggaattccaccaacaaaatgcaccaaatatagccaaagagttttctgctatatgccaagtggaaagctatgaagaaagagaagaacagaagcaggaggacattggttttcatctcctattctttcaagaagtaagatccattatcttttaaaaagtctaaacactggtaaggcaagacacaactcccacccataacactgcatctctgtcctcaggcaacaaatcaaatgtcagataaaagcacaatatctaccactcaacccccaggcttcagcacagaactcacaaacattctgctggctaaggcaaaaaggtgtactgtatttccagagagcttgcagagttctgagcactaatcccataatcctcatatctcaatctacacaaagcaccatcaggctaagaaacagattatatagcaggcacaacactcttgggtatgcaaacatgttaaggatcaaagtaagaaaagagtaactataggggccatactatatttgccaaaaagtgacttgtttaaaaattaaaaagaagccgggtgcagtggctcacacctgtaatcccagcactttgagaggctggggtgggtggatcacctgaggtcagtagttcaaaaccagcctggccaacatagtgaaaccccatctctactaaaaatacaaaattaggcgtggtggcaggcgcctgtaatcccagctactagggatgctgaggcaggagaatcgcttgaacccggaaggcagaggttgcagtgagccaaaatcgcaccactgcactccagcctgggcaacaagagcaaaactctgtctcaaaaaaaaaaaaataaaaataaaaacaaaaaagaaatccagtttacctccttgtgcaattcctaataaattgctgagaagtgatcttacataggaatcttgtataatttattctgatgctcataatccagaagaatatagggttgtgataaaggcattttcaactcaacagtcatttcagccttctcaccctgtggtccacctctagaaataacttcggtgaattgttgcattcagagaatttctaaaaataagttaagtagtaccagattaataaactataaattagacaacaaactttcaaaaaccctggaaaggttttgctggtttttttcagtttatcatatcctgtaaaaaataagaaagcacaactatgttcaaggtgcaagattattagggagcagcacacatacaaagtacaatgaagtagcttcgggacaagtcaaatctggagagactacaattattaaaaacttactacctgtacttagggtatcattttaagtgatttgaatcctaatattttaaggtacatctgtcacattaaagctaaatctgaggcataaatgtttcagtgaaaatgttattttatcaacgtctagagaagtaagccaaactagaacacccacttaagttttctcatggattgtactgccgccaactactctcccaaaaaatgagattagattcctttggacagtggtaagaattatcacaattctgactaatgcagcaagcttctcaggagttaagtgtacaagaactacaagtcctaaaacttctgtccaaaagagagtcaagaagcagctggacaaacttagggttaaggatgactttgttttgccctatcccttggctctatccttttgcttagcaagggctagcagtcaaatcttcctattgccctttctgagtagggaaacacccacatgcaataaacaatgtaaatacttcaggcatggacatttttaagttttcttcaaaaacgccttagcaaatcaatcattataatcaggcactttgaaaaacctcatttttgagtttttcctcaaatactatatttcactcaaaaatattaaggcggccaggcgtggtggctcatggctataatcccagcactttgggaggcagagatgggtggatcacaaggtcaagagagccagaccatcctggccaacatgatgaaacctcgtctctactaaagatacaaaatattagctgggcatggtggcacgtgcctgtaatcccagctactcgggaggctgaggcagaagaactgcttgaaccagagagttggaggttgcagtgagccaagagcgcatcactgcactccagcctggtgacagagcgagactcagtctcaaaaaaaaaaaaaaaaaaaaaaaataaggtggcaggacaaaaatatctaaggtagccagccttttggtattaaggttttaagagattcttagatctacctaaaacctaacttctgagaacccagcaatgctttttgtgtagttccgactcaaaaaagtttacttagtcaagagaactcagaatttaacacagctttacaatttattcagctcatctttccattatctcacagaactgttagaattaagcaggctaaagcaggtattattcatactatccctttttttgatgaagaaaaaaagtaaaattcaaaaggtttagtgacaatttaagagaagcaaaattaaaaattcagatactcagactttacatctctttccattataatacactgatttgaatggtacaatgggatttgaaatttttattgtttaatgatgttactattacctttaaaatttttgtttgtttttcacagttgatctgtactttgaaacctaggacttaatttttggaatacagtaatgtagtggttaagagttttaggcactgaactcagaaaaacccaggctggaagtttaagagctatctagaagagttcctaattattgtactgtactgtatttatttaatcttttttttgtagaggtggggtggggtgaggggggtgtctcactatgttgcccaggctagtctcgaactcctggcctcaagcagcgtctcagctcagcctcccaaagagctgggattacaaggcatgagccactgtgcctggcttattacattacttttaaataaatattgtttgtaaataatgcatcagacctctgtgtggaggaaagaaaaagactgtatataccatgtcttatatatcacaagcaattaaaatttttcttcatatttaagagatttttacttcacttctaaacaacaaaggatttagcttaaattcattagagcagtcatattcttaatgcttttttataacttatcctttctttttactcattaaataatatactaatagatggtgtatcaaaaatctaatctttgttttttagagacggagtctccctttgtcacctaggctggaagtgcagtagcttcatcatagctcactgtagcctcaaactcctgggctcaagcaatcctcccacctcagcctcctgagtagctggaaaaatataatctttcattcatgcagctaacattataatctacagcaaatggataaagaattaagacaggcagaaatataataacgatattaccggtttcttttaagtcttttttttgaggtggagtcttcctctgtcacccacgctggagtgcagtggcacgatctcagctcactgcaacctctgcctccaggttcaagtaattctcctacctcatcctcctgagtggctgggactacaggtgcgcaccaccaacgccctgctaatttttgtatttgtcttttttttttttttgagacagagtctcacactattgccaggccggagtgcaatggcacaatatcggctcattgcaacctccacctcccgggttcacatgattctcctgcctcagcctcccgagtagctgggattataggcacacaccaccacacccggctaattttttgtatatttagtagagacgggttttactatgttggccagacttgtctcaaactcctgacctcaggagccacctgcctcagcctcccaaaacgctgggattacaggtgtgagccaccacgcccagcctaatttttgtgattttagtagagaaagggtttcaatgtgttggccaggctggtctcaaactcctgacctcaaatgatccacccaccttggcctcccaaagtgctaggattacaggagtgagccactgtgcctggtttttaaagtcattattaaaatcttcattaccggccaggcgtggtggctcacgcctgtaatcccagcactttgggaggccgaggcgggcagatcacgaggtcaggagatcgagaccatcctggctaacatggtgaaaccccgtctctactaaaaatacaaaaaattagcctggtgtggtggcgggcacctgcagtcccagctactcggaaggctgaggcaggagaatggcgggaacccaggaggcgaaggctgcagtgagctgagatcgcgccactgcactccagcctgggcgacagagcgagactccatctcaaaaaaaaaaaaaaagaaattcaggccaggcatggtggctcacccctgtaatctcagcactttgagaggttgaggcaagcagactgcttgagcctagaagcttgagaccagcctggacaacatggagaaaccccatctctacaaaaaatcagccatgcacggtgtagcacatgtgtagtcccagctattcaagaggctgaagtgggaggatcacctgagcccagggaggtccaggttgcagtgagccatgattgtgccactgcattccagcctgggcaacagagtgagaccctgtctcaaacaaacaaacaaacaaacaaaacaaataaataaattttaagtggtcacaacactggaaaaaaaataactttcacacataaaaagtttctgctgagcaaatatgctcaaatgttagtttcctaaccagtccaaaagggcactctcatgcactgcaaggtgatgtgtacgtgtcaatatttttcgtttcctcactcctctttctcaatttctgaccacaaactggtaacttcatcagatgacagcccagaataaacacacatgaagaaataagccactctactcttctaaaagttagcaggggctgtacaagtttacaaaacagactcctacattttaaaagtgtaactttaaaaatacaagttaaaaacgagctagttcaaaaacaattatgctaaaacaaatcagttccacaaatgatacctggagccaactttatttttaactctcaccacaaataagcttaaattattttcattttaaatcacattgtctggactcttttttaacccgagtttttcttttcaccttcaaatcagtcattgttttcttcatctagtcagcaactgctgatttttaaaataaacagatgtgtattcaaagtacaccattaacacaagtaccaaaacacacaatgtacaaataaaatatggtttaggaatgattattcagatagccaagtaacagcgaagttaaaaaaaaaaaaaaaaaagctacataatgaagtaggaaggaagggggaaaaaaatcacctggaaacactaacaatttccacactaatttctctttcatactaaaggcattaattttcacagtaaatcttgcatattcaacaagtggttaaaaaaaattagccctcctcaaagataaggacacagaatataagtgaatcattcattctacacactggcatcactcatttggcagaggagatgtgtcctcaagagaagaggtattcccccaagtttacatcttaccaaagcagtttcaagaagtaaccatctatattagccggatgtggtggtgcacacctgtattccctactcagatggctgaggcacgagaatcatgtgaacccaggaagcagaggtggctgtgagccgagatcgcaccactgtcctccagcctgagtgacagagtgagattctgcttcaaaaaaaaaaaagtaaccatctgattcagccagctcccctacacttccttctggagtcaatggctttcaaatagaaaaattcccatcggccggatgcggtggctcacgcctgtaatcccagcactttaggaggccgacgtgggcggatcacctgaggtcgggagttcaagaccagcctgaccaacatggagaaacccagtctctactaaaaatacaaaattacccaggcgtggtggcacatgcctgtaatgccagctacttgggaggctgaggcaggagaattgctggaacacaggaggcagaggttgcagtgagccaagatcacgccattgcactccagcctgggtaacaagagcaaaactcagtctcagaaaaaaagaaagaaagaaaagaaaaagaaaaattccctagtctttagtggtgcgctcaatagtaaactttaacaacttctaagagttacagtaagacacctgtaaaactgataatatcatttgttcttcagaaattacttttaaccaacttttcaataataattttctcaaaagaaagacatgtttaaaatttttccctggccaggcatggtggttcatgcctgtaatctcagtaatttgggaaatcaaagcagtagaatggcttgagccaaggagttcaagaccaccctggtcaacagagtgacacctcatctttataaaaataaaacaaaattagctgggcatggtgacacatgcctctagtctcagctactaaggaggctgaggcgggaggatcacttgagcacaggagtttgaggctgcagtgagctatgatcgtgccactgcactccagcatgggggccagagactgtcacacacacacacacacacacacacacacacagttttcactgttagttacaccattaattcattaaagctctaaattataccctgctattttgccagaggataaaatagtaaatgaaacacaaaaatataacctagggtcaggctcacacctgtaatctcaacactttgggaggccgaggtgggaggagtgcttgagcccaggaattccagatcagcctgggcaactgagggggaacatcaactctacaaaaaaattgtttttaattagctgggcagccaggcacagtggctcatgcctgtaatcccagcactttgggaggccgaggcaggcagatcaccaggtcaggagttcgcgaccagtctggccaacatagtgaaaccccatctctactaaaaatacaaaaaattagccaggtgtggtgatgggcgcctgtaatcccagctactcgggaggctgaggcaggagaactgcatgaacccaggaggcggaggtcgcattgagccaagatcacgccattgcactccagcccgggagacagtgcgagactccatctcaaaaaaaaaaaaaaaaaaaaaaaaaaaaatttaatcaggcatggtagtcatgcctacagtcccagctactcaggaggctaagatagaaggattgtctgagcccaggaggtcgaggctggagtgagccgtgactgcatcactgcactctagcctgggtgacaaaatgaaaccccatctcaaaaaagaaaatataacctacataattatataccaaagcattgaagaactacatgtatttcctataatcttgttataatccatcatccagtataggacattgcacaaaattaggtactcaaatatctgctgaatatcaatggagaaaagttaacaattacaatattttcctaaccctttttcatgaataccgaatcactatcacataaatctaaagaaccagaatgcctctctatagactgtaacccagcatggaatgaaaggaaaaaaagaataaagagcaccattcattcaacaatttctaagaatctactttcaactgttagctgctttgaggaatataaagttcagggagacatggtccttgcatttcagaaccccttaaagtagaagtaaaaaccaccaccgtttaacaaaaattgaatatgtgctaggcactgggctaagagctttcaggaagacaagtaggcctacaacaaaatatgaaattaaaggtagggaggattcttaagaaacatactataagaatctgaaatgtggtaaggtcacttctagcttgagtggaagaagaggtagacaaggatatttcattgtgtatttgagcttaaaggggcaatatttcaacagactaacgcagaggtaaaacaaaagctaaagtgtgcccagggaataagcacagacaagcaggtaaagaaatgagcctgatgaaggatacagcctttcttattacataactttgtttccttttattttaaatattcacaattaatgtctttacaaaggcactcattataaatagcaagcctttttacttctaaaatgtttaccctgctttttttctatagcacttaaacattacatgtattagaggggatcttttaaccccttctttgttttatctttcctttccttctcccaataaccaattattcttcagtgtttccctacatgcttataatctcataccaatatatatagattttttgcaataatttcttttcccaataattttttaagatacacaaattgggctgggtgtggtggctcatgccagtaatcccagcactttgggaggccgaggagggtggatcacctgaggtccagagttcgagaccagcctggccaacatggtgaaacactgtctctactaatacaaaaaaaattagccaggcgtggtggctcatgcccatagtcccagctactcgggaggctgaggcacgagaatcgctggaacccgggaggcgggggttgcagtgagctgagatcggttgccgtgagccgagatcgcaccactgcaccctagcctgggcaatagagcgagacttggtctcaaaaaaaaaaaaagatacacgaattgatcacagaatacatgttcaaagagggagggaaacaaattaaaaatatgagctgggcacgatggctcatgcctgtaatctcagcattttgggaggccaaggcgggcaaatcacttgaggtcaggaggttgagaccagcctggccaacatggtgaaaacccgtctctactaaaaatacaaaattagccaggtgtggtggcgcatgcctgtggtctcagctactcgggaggctgagtcaggagaactgcttgaacccaggaggtggaggttgtggtgagccgagatcgcgccactgcactctagcctgggcaacaagagcgaaactccatctctaaaataaataaataaataaataaataaataaataaataaataaatgatataaaaaattagctgggcagggtgatgagtacctgtaatcccagctactcgggaggctgaggcaggagaatcgcttgaacccaggaggcagagtctgcagtaagccaacatcatgccactgcactccaacctgggagacagagcaagactccatctcaaaaaaacaataataaataaaaataggccaggcgtagtgactcacacctgtaatcccagaactttgggaggccgagatgggcggatcataaggtcaggagtttgagaccagcctggccaacacagtgaagccccgtctctactaaaaatacaaaaattaactgggcatggtggccggtgcctgtaatcccagctactcgggaggctgaggcaagagaatcacttgaacccaggaggcaggggctgcagtgagccaagttcgcaccactgcactccagcctgggcgacaaagctagactcggtctcaaagaaaaaaaaaatcaaaacttatgcatatacttacagaccatacataacaccatttgcacagacacacattcacacttgagagaaatgtaaacaaatgttaagatgcagtatattaaataactgcagcatattaaataactgaagccaggtgcagtggctcacatctgtaatcccagcacttggggaggcagaggcgggtggatcacttgaggtcaggaggttgagaccagcctgtccaacatggtgaaaccctgtctctactaaaaatacaaaaaattagccaggtgttatacagctactcaggagactgaggcaggagaatcacttgaacctgggagacagaggttgcagtgagtacagtgagccaagattaagccactgcactccagcctgggcaagacagtgagactccatctcaaaaaaaaaaaatttttttaattaaataaataaataactgcataaaattaaatgatgttggctgggtgcggtagctcatgcctataagcccagcactttgggaggatgatgcgggtagatcgcttgaggccaggagtttgagaccaccctgggcaacagggtgaaaccccatctctactaaaaatacaaaaattagctgggcatagtggcacaggcctgtaatcctagctacttgggagactgaggcaggagaatcgcttgaacctgagaggcagaggttgcagtgagctgagatcttgctactgcactccagcctgggtgacagagtgagactttgcctcaaaagaaaacaaacctgttgtacaaactatattactacagtaatttcatagccacctcttctttctattgcagtgaactcaagtgttacaagttgcatgtgtccacttaaaaggccttgtgtccctctgagcagttggtctctccagtacatttcctattgcagtaaaaagtgatatctcttggctgggcacattggctcattcctgtcatcttagcactttgggaggccgagctggtggattacttgaggtcaggagttcgagaccagcctggccaacatgatgaaaccctgtctctactaaaaatataaacattagccggttgtggtagcgagtgcctgcaatcccagctactagggaggctgaggcaggagaatcacttgaacccaggaggcagaggagagctgagatcatgccattgcactccagcctgggcgacagagcaagactatgtctcaaaaaaaaaaaagtcatctctcatgggtcttctgtatttttcatcatgtacagtacaataccataaactttgaataacagcatgggtcccatatgaagtaccactagtgatgctggaagcgctcccaagaagcaaagaaaagccatgacattataataaaaagttgaactacttgacttatacagtagatgcaggtcaggtcagcagctgcgactgccggccatttcagacagactattcatcttttctttttcttttttttttttttcaagagacagcatcttgttctgttgcccaggctagagcaccatggcacaatcatagcttattgcagcctccaattcctggactcaaacaatcctctctcctcagcctaccaagtagctgggactacaggcgcataccacatgcctgactagtttttttggttttagagatggggtctcactatgatgcccaggctggttttgaactcctggcctcaagcaatcctccctccttggcctcccaaagtgctgggattataggcatgagccacagaggctggccctaaatacattatagaataaaaaagtatgagaggccaggcacagtggctcatgcctataatcccagcattttgggaggccaaggcgggagaatcacttgagctcagcacttcgacatcagcctgggcaacatggcaaaaccccatctctacaaaaaatacaaaaattagctgagtgtggtggcacacacctgtagtcccagctactcagcaggttcaggagggaagatggcttgtgcctgggaggtcaaggctacggtgagtggagatcgcaccactgcactccagcctgggcaatggagtgagactgtgtcactcacaacacaaaaaaagggtatgagtataaagtaactacaactgtgtgtatcaacttatagaaaaactttattcatttttttttttgcttatttttcttcttacacctcacaaggatgaaagaaagtgttctttttaaaaagatgtcattaattgtgtacataatgtatccctttgaacaacattatacacaagtttaagagggaggaaaaaacccatcagatccaaatatagccaaattcaaaggttctggtttgcccattacatctaagtagcaataagaagaaaaggagggctgggcgcagtggctcaagcctgtaatcccagtactttaggaggctaaaatgggaggatcaatggaggccaggagttcgagaccaacctggtaaacatagtgagaccccccccccgccatctctaaaatagtaaaaataataattttttaaaatgcaaaaagcctacaaccacttcacagtcattagggttgttattttatttatttattttttgagacgaagtctcactcttgtggagtgcaatggcgcaatctcagctcactgcaacctctgcctcccgagttcaagcgattctcctgcctcaacctcccaagtagctgggattacaggcatgcgccaacaagcccagcgaattttttttgtacttttagtagagacggggtttcaccatgttggccaggctggtctcgaactcctgacctcaggtgatccgcccgcctcggcctcccaaagtgctgggattacaggcatgagccaccgtgcccagcccaagattgttactttaaaaattaaaaaagaaaaaataacaagtgttggaaaagatgtggcaaaactggaacccttgtgctttgctggtgggaaatgtaaaatggtgcagtcactgtgcaaaacagtttggcagttcctcaaaaagtaaacacagaattaccatatgatccagtaattctactcctgtgcattaccctaaggcactgaaagcaggggctccaacagatatttgtacaccaatgttcactgcagcattatttacaacaaccaaaaggtggaaataatccaagtgtccatcactgatgaggagataaacaaaatgatatattcatacaatgaaatattattcagccataaaaaggaataaaatacagatacatgccaccaccacatggataaacctcaaaaatgtgctaagtaaaataagccagacaaaaaaggccagatagtgtatgactccccttacatgaggtacctggaataggcaaattcatagagagaaagtagaataggggttacgaggaactgggcatagggaggaatgaggagttcttgcttaatgagtactgtttctgtttgaggtaacaaaaaggttctggaaacgagtagtggcgatggttttaagacattgtgaatgttgttaaatgtcactggattgtagatacacacacacacaccccacccccaatccgcccccttccaacttacataagacagcctaggggtccattttgcattgtcaggcaatactagataatactagccagggaaatcacaatctctcctctcaaaatcacactataatgctggaccagactaaggtcaaaaatggtagaagattatcatttatccccccattctctctgggtataactttcttccatatctaaaacctatgaatgcaaaaggaaatagccagcatggtaacagctgcttgagctgaagagtcagtgtcctgctaaagcaggcaaatgtcatcaaggagctagcaggcagaacctagagcactctacatataatgcccaatagagggagaagcttaagcaacttacctcctccaacagacaggtcctaagttacaaagttctaagtttgaatttagtaagtgtagcctctttactgtaagcattttggagagatggcagtagagtgaaactaaatccataagtgattaacctctgattaatgtttgctgtgtaagacaaggttttgagaactggagatatataaaaaaggataagacatgccccactggaaatatataggcaagagtaagacatgcctcatttttaaactgagacataagacatctatacaagaaattcaacttggccactgcggtggctcacacctgtaatcccagcattctgggaggctgagacaggtggatcatctgcagtcaggagttcaagaccagtctggccaacatcatgaaaccccatctctactaaaaatacaaaatttagccgggcgtggtggcagatgcctgtaatccctgctacttgggaagctgagacaggagaatcacttgaacccgggagacagaggttgcagtgaaccaacatcacgccactgtacgccagcctttgtgataagagtgaaactccatctcggggaaaaaaaaaaaaaagaggaatagataaaagtaaggaaatgtcagcctctctcaattagataaggtccttgaaggtaggaacttgccttatgctgcaccaagtgcactggcctgcacctacaggggcctaaaaatactggcttttgatttccactaaacatactattactatgagaaagccatgtgagcaagacacagaagcaagaattgtatatacttagtctggtagccagggagagcctggaagatttgagcaagaaagtaaggccagcacatctacccttaaatatttttgtgtcgtcacaaaataggatacataagaattcacatttccctctgtgaaaggaagctgggtagctagagaacaaaggagaacgtagaataactatgcacaacataactttctatatcctttaaattttgtgacatctgacattattacttactcaaagaaaataatatttaattcttaagaatttccaggcaggggccaggcgcagtggctcacacctgtaaatcccagcactttgggaggccgaggtgggcagattacctgaggtcgggagttcgagaccagtctcactatcatggagaaaccccatctctactaaaaatacaaaattagtcgggcatggtggtgcatgcctgtaaccccagctactcaggaggctgaggcaggagaatcgcttgaacccaaggcagaggttgcggtgagctgagattgtgcaccactgcactccagcctgggcaacaagagcaaaacatctcaaaaaaaaaaaagtacacaataaaatggcttttattatattcacagttgtggatccatctccataattgtagaacacttttatcacccaaaaaaaaaacaaaacaaaacaaaacaaaacaaaaaaaaaccctatcacagtcactgaccattccctacatccctcagcccctgatctactttctgtcactaaggattttcctattctggacattacatataaatggaataattcaatatgtggtctttcctgcatggtttcttttacttaatatgtttccaatgttgtagtatacaccagtacatcctttctttttattactgagtaacattccatcacatagtagtgcttccatatccacttggaatatgttccaagactaccaatgaatgcctgaaagcaagaacagtatactatactgtatacactatgttttttcctgtacatacatacccatgatcaagtttaacatataaattaggcacagtgagagattaattataattaataatggaacaattataagaacataatatcataaaagttatgtgagggctgggcgtggtggctcacgcctgtaatcccagcactttgggaggctgaggcaggcagatcacctgagttagggagttcaagaccagcatgaccaacacagtgaaaccctgtctctactaaaaatacaaaattagccaggtgtggtggcgcatgcctgtaatcccagctactcaggaggctgaggcaggagaatcgcttgaacccaggaggcagaggctgtggtgaggaaagatcatgccactgcactccagcctgggcaacaagaacgaaactccgtctcaaaaaaaacaaaaaaagaaacaaacaaaattgactgccactgcctgctgcttcccatttattaacaaaaaatgtaaacaacctctaaatcataaagattttaaaaccgtaaactagctttaggattgttaagccccacccagtaaaaccccttagaatctggtctaaaaataaaaccgtgtgtcaagtgttcctcaaaaaatgctatgtacactgattggaatgtgatgccaattaacatactttgtgagtaatttgccaaactttagatagtctaggccaaaaccactaacaaagaaacaacacccacttgacattttccttagttaagctgagattctaggggtcattttagaagaaaggcaaacagatgtgaaattaactaaaatcatttagagctacgcaagtcattctgggagaaaagaagtaacaaaatgactcaaacattgtaaaattaaagatcaaaccttaatgtgtaattaaggaatttttacttacaactctaaggcaagaaaaaaatagccattactatcatgagaattacaaggcaagatgcctgagcgagcctgtaatgccagcactttgggaagccgaggcaggtggatcacttgaggtcaggagttcaagaccagcctggccaacatggtgaaacctcgtctctactaaaaatacaaaaattagccaggcaaggtggccggcgcctgtaatcccagctactcgggaggctgaggcatgagaatcccttgaacctgggagacggaggttgtagtgagccaagatcacaccactgcactccagcctgggcaacagcaccagatttcatctcaaaaaaaaaaaaaaaaaattacacgcaagataagttagccctataccaaaagtaccaactgaattgcaacacaaatatctagtattacattttgaacccagtcagatgagcaattaggaattctaccctcccatacacataccaaacaacctcatcctaaataaacccagtgttctctgattttccaattaatttattcaaggtaagtaattttccacctcatagtcatttgttttgaagaaatgactcccaagatctgaacaacttaaaaacaaaaactaagtcaaaaagctcaattttatggtttcataaaccccctcactgtcacattatccactgcctttcaaaggcaatatttaaaattgtcttctgcaagtcaacattaaggcatgctgtttggctaacaagctcctcccaagctcaagattattatgtatggcctattatgatcctaacatgcaaacaaaagtactccctcatgtaacatttttttaggcagtaggttactaacaaagatttacctgaaatttaaatgtagaatcatacatttactagtaatagactacctgaaatagtagtttaaagttatcaattatattttttatttcgtaaataatccagtgcttctggaaaagtcaaatttaacttccaagaagtatgaacttgcttaatcttcagagcaaacaaatgacatgttataaactaaaagctactagtctaagagcaactgtaatataatacttgatgtttaacattcttcacttcatcttttagatactttttgtcagaaattaccagcttaatctgcttctcactgtttttttcagctaaaccaaatcccataaaatacgttcaagccttctattgaaggcacactttttttttttgagacagggtctcactccatcaccaacactggagtacagtggcatgaacatggctcactgcagcctcaatctccctgggctcaggtgagcctttcacctcagcctcccaagcagctgggactacaggcatactacaccataccctgctgatttttttctttttgtgtgtgtgtattttttgtagggacaggttttcaccatgttgcccaggctggtctcaaactcctgagctctagcaattcaccagcctcggcctcccaaagtgctgggcttacaggcctgagccaccacaactggctgatgtttttacaactactgacaagactttaacaaaactaaggaactccactacaatttataatcacaaaacaccacatatcagccaggcacagtggctcacgcctgtaatcccagcactttgcaaggccaaggcgggtagatcacaaggtcaggagttcaagaccagcctggctaatatggtgaaatcccgtctctactaaaaacataaaagttggctaggcgtggtggcaggcgcctgtagtcccagctactcaggaggctgaggcaggagaatgcttaaacccaggaggcagaggtcgcagtgagccaagatcgcaccactgcgctaaaaaaacaccacatatctttaaaagataagcctttagtacagaaacagtaacaggtttatttttccaagtatcccagcattcaactgggtcaaatgtttatgttgcattttaaacagcttagcccttgagtgataagggtaaaaacaagccaaaataatcctgaatgttcttcagtggtatataatcatcacaaccaaagcaagatttagaaactgcaactgaagtctgttaattccataatagtcactttagcataaacattaatcacaatattatagctattttaggaaaattatgtttatggggataaagattttataacaggttgttatccgagaagtcaatacaaataaatagtttataaaatacacttattaaactaaaaatactcacattctacactttttttgatgtttgttttctatagtcgtccaatttctgtaagactggggagtacattacttatatttaaaatttaggccaggcacagtggctcatgcctgtaatcccagcgaggccgtgggaggccgaggtgggcagatctcttgcggtcaggagttcgagaccagcctggccaacacgacaaaaccccatctctactaaaaatacaaaaatcagccgggcgtggtggagtgtgcctacccagctactcaggagggtgaggcaggagaactgcttgaaccaaggaggcagaggttgcagtgagccgagatcgcatcattgcacgccagcctgggcaacagagtgagactccgtcgcaaaaaaataaaaaacaatagaataataaaataaaaattagtaggagagtgttctacatttataaagttaacatttttgtgagcaagtataactttaagagaattttttgcaagaatccccaggaatatatgagttcaattcattcaccactgtgtaagtcaaaacatttgatataaaacacttatcaaaaatgttctgctagccaggcacagtggatcacacctgtaatttcagcactttaagaggctgaagctggaggatcacttgagcccaagagttcaagaccagcctggccaacatagtgtgaccccctctctattatttaaaaaaaaaaaaagttctgcctggccagtggctcacccctgtaatcccagcaagcacgttgggagggagaggtggaagcaggaggatcgcctgagcccaggagtttgagaccagcctaggcaacactgccagactccatctctactattttttttttaattagccatgtgtggtggcacctgtctgtagtcccagctactcaggaggcaaaggcaggagaactgcttaagcccaggagttagaggctgcaaccgagctatgatcatgccactgcactctagcctgggcgacagagtgagatcctgttcctttaaaaaaaaaaaaaaaaaaaaaaaaaaaaaaaaaagtttgcattgttctgaaaaaataaaaaaaaatttaaaagtcattaactaagttaaactaaatatgttcaatcactatcagcttcaacatcaacaaagggagaaaattatcagcaagaatgaagactcggcaacccatgtacaataatccaaattcaactagttcactatctacaacaaagacagccccctcacaattctagcaacttttattttactctcatctctcaccatttccttcctgcaccccaggcaatttgctgctccccaaactcatcccaactcccacatggctctaagcctttgtaccagctgttccctgagctcctcctcacccgatgagcacttactcacaggtgtttcaaaactcgactcagaagtctcctcgagtgtagaagcttcctcaactcctccccaagcaaaactaactgttctaaatccccataacacttgataagccaattcttatcacactgcattgttttcacgccttaggagcgcagggagggcagagtctctccactcagcccacagaggaccaggcaagcagaaacgctcaatgaacgtgccttgaattcattttccacttagattaagtgaccccctagaacccgttcacatctcaaggatacactaagttccattccttcttcccaccacagaatgaataccaggggcacacccagagccctagaacgagaacaatgaatgaacacggccgcctcgcctctcacgacgtccaaacccctctctcttgggcatcgactcgctcgcagagcctcagcagctgcagagctgaagcgtcccggcggctctcgcgtcacacaaaagacagccctggctcttcattccaaagcgtcctgaggccaatcctctataagtatcccaaacctttcattaataacccagagtcctgatacccaaggctagtcctgatacccaagaagaggcccctgtgcctttgtggtagggcactggccagtttcctcctctcttacccgattcctcacgtcgtctctaaaagggtgtcacttgactgaagtaccctgagaaagggtgcaagcccgggtcccacattcggcggcccaagagaaaaggaattggcccatccaagtgacaacagatatggggcagctctgggcggattttcccactgccaaatatgaggaatgcgcatggcataagggtggcgttggcacgtttccgccaaacacaaggaaatttgagtgggatgtgggaactcggctcgccggccatgacaccggactccggggcccccgcccaacgctaccccagggtgacaacggcctggcccaagccctctgcccggcagccgcggggccgctccatcagcgccacccaggcccggtcgccctggaagccgatccctcagccccgccgcccggctcccccggcatccacgacccggtcctgccacctacctgagggagccaggccgccccaacgtcctgtcgttcggcggcagcttctcgcccgctcctcctccccgcggcgggtgagggagcgggaggcggtcacattcggcgcgtccccagcccaggggacggagccccgagcagcccccgcatcgtagcaaacgcgctccgcgcctcagggcacgcgccccaaagcccggccagctgacccttttcggggcccaaaaaaggcagcagaaagccgttcccgcctcacaatcgttttcctcttactcccgccatctaagatggcggcccaagcgcccgcgattaagactctcgggcggcccagacgagcgagccctcgactcggtgctcgtcctcccgacctgcgacgccaccggctctccgattctgcgcgagccctactggcagtcgacttctaacttggctcgggcatccatcgctctggcctgaactcaggccccgcccccggggcgtggcctagcgatctggtggccgccatttcgaagctgaagaggttaggcgacgctgacttgctttcaggagaggcactcggtaatcgagaagaaccggctttcggccagccaggagtggccagaggcctagaaggggagaggaaggcctgcctgcccagcattgcaaggcccagcgatcaccagacgtgcctcaggacacagggcacagtgtccaactttgacgcgtcctctccgggcactttaataccaaatcacggctccgccacttgacagctatgtggacagtccctgaaccttaaacggtcttttccttgtgtgtaaattccgagttcatttttcccccatcacattagcaacaagttaaaaaaactgataatatccggtttggtccaaggtatattgaaacctgttgtgtgccctcgcagcgctatcacagtggaacttggacatgttaaaagtatatatccttcctcccggcagtttcacttctagacactaattctagagaaataagtatacacatacacaaaaagctatgtgtgaagatatttaatgccatattatttgcattctggagaaacactggggatgaaatgaagattaataggaaactggttaagagaacgctgctacacatccaatctgggttgtcatccatccaagaatgaactagatagttactgaatttaaaaaacaacaaaaaaagggcccggcgctttttttgggattactcctgtaatcccagcactttggaaggccgaggcaggcggatcacctgaggtcgggagttcgagaccagcctgaccaacatggagaaaccccgtctctactaaaaatacaaaaattagccgggcgtggtggcgggcgcctgtaatcccagctactcaggaggctgagacaggagaatcgcttgaacccgggaggcagaggttgcagtgagcccagatcgcaccattacactccagcctgggcgacagagcgagactccgtctcgaaaaaataaataaatataaaaaaataaaaataccaaattagctgggcatggtggtgcatgcctgtcatcccatctactcgggaggctaaggcaggagaattgcttgtacccaggaggcggagattgcggtgagccgaaatcgcgtcattgcactccagcctgggcaacaagagcgaaactcttgtctcaaaaaaaaaaaaaaaaaagacatggctgggcgtggtggctcacgcctgtaatcccagcactttgggaggccgaggcgggcagatcacttgaggtcatgagtttgagaccagcctggccaacatggtgaaacctgtctctgctaaaaaatacaaaacaaataggccgggtgcggtggctcacacatgtaatcccagcactttgggaggccgaggcgggcagatcacgaagtcaggagatcgagaccatcctggctaacacagtaaaaccccgtctctactaaaaatacaaaagattagccgggtgtggtggcgggcccctgtagtcccagctactcaggaggctgaggcaggagaatggcatgaacccgggaggcggagcttgcagtgagctgagatcgcgccactgcactccagcctggacaacagagtgagactccgcctaaaaaaaaaaaaaaaaaaattggccaggtgtggtggtgcgcgtctgtaatcccagctactcaggaggctgaggcaggagaatcacttgaacccagtaggcagaggttgcagtgagccgagatagcgccactgcactccagcctaggtgacagagccagactctgtcgcaaaaaaaggaaaaaaaaagccattaagttaaaaaagcagaacataatgtatgatcttatttacgcaaacacaggaacacaagatacctacctaatactacagaatgccatgtgcactattacttttcgatattgagagcctattaggtaccacacattattttggatattggaaaattaacagtaatcaaaatccctgccatctagtaatgggagattaaaagaaaatataaataataaaattcaggttggatgtggtggccaaagcctctaatcccagcactttgagaggccaaggaaggggggtcacttcagcccagatgttgaagaccagcctgagcaacatgagaccccatctctaccaaaaaaaaaaaagaaaagaaaattagtgtgcatggtgacatgctcctgtaatccagctagggaggaggctgaggctggaggatcacttggagttggggatggcataagctatgattgcctcactgcactccagcctggacaacatagcaagcccccgtctcttaaaaaagaagaagaaaggaaaagtgaagcaaagtgagaatgacaggagtatgtggaccaacgtaaaaataaatgtaggagaaagactggccaggcgcggtcgctcacgcttgtaatcccagccctttgggaggccgaggcaggcagatcacaaggtcaagaaatagagaccctcctggctaacacggtgaaacccggtctctactaaaaataaaaaaaataaaaaaatttttaaaaaagccgggcgcggtggctcacgcctgtaatcccagcactttgggaggccaaggcaggcggatcacgaggtcaggagatcgagaccatcctggctaacacggtgaaatcccatctctactaaaaatacaaaaaattagccgggtgtggtggcgggtgcctgtagtcccggctactcggaaggctgaggcaggagaatggcgtgaacccaggaggcagagcttacagtgagccaagatggcgccactgcactccgtctgcctgggcgacagagcgaaactccgtctcaaaaaaaaaaaaaaaaaaaagaaagactagaaggtgtggaatgtggatagcatgagggggatttttaaaatgggaataataggccaggcacggtggctcatgcctgtaatcccagcactttgggaagctgaggcaggcagatcacctgaggttgggagttcgagaccagcctgaccaacatggagaaaccccatgtctactaaaaatacaaaattagccgggcatggtggcctgtaatctcagctactcgggaggctgaggcaggagaactgcttgaacctgggaggcagaagttgcagcgagcggagattgtgccattgcactttggcttgggcaacaagggtgaaactccgtctcaataaataaataaataaataataaataaaataaaatgggaataataacactttccttgcaggattaaatgagataaaacctggagagcacttagtgcagagcctggtggttgagacttcagtgcctagagtctgacttgcctgggttcaaatttggactctgccatttccttatctgtgacttggagaactcatttaaacttctcaattcttccattccctcatctataatggaaatgtgatgatactacctcttagagttgtaaggatttagtaagttttagacgtaaagtacttggaacagtgccttcctcatattaagcattgtagaagtgttagctgtaattactagagctatctccctctttttctaaaataacactggtttacaaggaaaccaaagaagtcaatattataactatctctaattatcattatcattattacttgaggcagagtttcgaagccacacttgctgaccttctgattattccttccttcagcatccccagctgatatttgcccagcactttacatcttagaaatttaaggtggctcacgcctgtaatcccagcactttgggaggccgaggcgggcggatcacgaggtcaggagatcgagaccatcccggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagaaatttaaggagcctgtgcctcattcaaacttttcagctcacctggaagaatggctacttcattttttaaaaaatttattgaggtgaaatgaaccattttaaactgaacatttagtggcatttagtacattcagtcttttacagccaccacccctagttccaaaacatttccattactccaaagtaaaaccccttacccatcaagcagtttcttccccatcccctgaacgtctggcaatcaccaatatgcattctgtcactatggatttttctattctggatattacataaaaatggactcacacaatatgtggccttttgtgactgacttctttcacctggcataatgttttcaaggttcatccacatggtagcatgtgtcagtactttattcattttcatggctgaataatatcccattgtaagtttatgccacattttgtttatccattcatctgttggtggacatttgggctgtttccattttttgggcatcgtgtgtgctaaaacatgtgtgttacatgctgggttgcatatcccctactttagatacctctggtttggtggtaggagaggtcaagtgtgctaaagttattaggaaaggtctcagaagagtaataggaggaaggaatgagtctgaaatggtttgaaggaagaatagacatgcccatgatgtcagatcagaggaggaaaataggccgggcgcagtggctcacgcttgtaatcccaacactttgggaggctgaggcaggcagatcatctgaggtcaggagtttaagaccagcctggccaacatgacaaaatcccatctctactaaaaatacaaaaattagctgggcatggtggcgcatgcttgtagtcccagctactctgtaggctgaggcacaagaattgcttgaaccggggagttggaggttgcagtgagccaagattgtgccactgcactccagcctgggcgacagagggagaccctgtctcaaaaaaaaaaaaaaaaaaaaaagatgtaccgttggccaggcatggtggctcacgcctgtaatcccagcactttgggaggccgaggcgggtggatcatgaggtcaggagatcgagaccatcctggctaacacagtgaaaccccgtctctactaaacaaaatacaaaaaattagctgggcgtggtggcggatgcctgtagtcccagctactccggaggctgaggcaggagaatggcgtgaacccaggaggcggggcttgcagtgagccaagatcacaccactgtactccagcctgggctacagagcgagactccatctcaaaaaacaaaaaagaaaagaaaaagtaaagatgtacagtaaggtctttatgcttggcaaaaagggtacatttttcagatgaaggaaagaaaaaataacggccatttatggaatgtcttcacgtatcaggcatttttacagtttccaatacacaacccatgagaggcctcatcttcacatgaggagagggtaagtaatttgtcctaagacacaaatctggtggtaagtagtggagcaaggatttggatctattttgtttgttcattcctcattcagttaataaaaatttcttggtggactggtggctcacacctgtaatcccagcaattcaggaggccaaagtgagagaaccacttgagaccaggagtttgagaccagcctggactacatcgtgagactccatttctatcaaaaatttttaaaattagccaggggtggtggcacattcctgtagttctagcttcctgggaggctgaggcaggaggatcagctgagcccaggaattagaggctgcagtcagctatgatcatgccactgcactccagcttgtctgaaaaaagctaaaattggccgcttgcagtggctcatgcctgtaatcccaggactttgggaggccgaggcgggtggatcacctgagttcgggagttcgagactagcctgaccaacatggagaaaccccatctctgctaaaagtacaaaattatccagatatggaggcacatgcctgtaatcccagctactagggaggctgaggcaggagaatcgcttgaacccgggaggcagaggttgcggtgagtcgagatcgtgccattgcactccagcctgggcaacaagagcgaaactccgttcacaaaaaaaaaaaaaaagctaaaattaaatttttttaatacttaatatatgccaggccctgtgttagagctgggcctatagcagtaaacaaggcaaagtccctgtatgtactcaaggactttaagctctagcaggggagacaagcagcaaacaagtaaatgaataatatgataattagggttgtggcaaatcaatgaagggaattgctggagaatgacagaatgggaagagggtgtgcctttagattcagtagtcaaggaaggcctgtctcaggaggtgatagttaagctgggcacgaaaggatgaaaaagagccagaggaagagcattctaagcagttggaacagcatgtataagggccatgaagtgagacaggagtgcaggccagtgtggttagagcacagaaaactgggggagcagatgaggctgaggacagagggtggagtcatattcagtctgactcccaaacctgtgacctttccatgccatcctgccctgcagggactttgaagtgtggggctggcctgggctgggtgctgggagagacagagccatgtaaacaaacagttgccccagcaggtgacgcaaatgtgctctcatggataactgtgcgaggggcaccaagaggagggaggcagtgaccagagacaacatataagctatcttaaaggatgagtggaattgtaaccataataggtcctttatccggtgcacgtggcaagtcaattcaccacattgcagcagtgaaagaggtttatttctagggatgctgaaccaggagatgggaggaaacctcaaatccgtctccacagagtttggggctagggttttcaggggtttgggaatcagccaaagtgtggagatccttgattgctcaaagggcacagggcaaagtcatggaacagggagatgaagaaactgtattctcatgctgattccattcctctgtaggggtcagtgggtcttcagactatttgaggtcagctgtcttgctggaattcaggatctaaaaaacatcttaagaaattcttaaacaaaaaccttatgattctaatgtcagagattctacctatcttaaataaaaggcttattattctagcatcagaaagctgatctataggccaggtgtggtggcggctcacacttgtaatcctagcactttgggaggctgaggtgggaggacctcttagcccaagagttcaagaccattctgggcaacatagggagacccctgtctctacaaaaaaatttaaaaattagcgaggtgtggtagcctacacctgtagactgggctactcaggaagttgaggcgggaggattgcttgagtgtgggaggtcaagactgcagtgagccatgattgtaccactgcactccagcctgggtgacagagtgagaccttgtcaaaaaaaaaaaaaaaaacctatctgtaggaacaatggggatgcaaatggtcagtatctagtgccctgtaattttcagttccaagaaagtgggtcaaagtgcagcctaagtaatgcttaattataactattaatatatttttgtccaaaattcttgttaatcctgtgaggacaacttcagaatgttccagactgagaagggaaggagtgcagggcaagaggtgggaacagtatgggcaaaggcatagaggtgtgattagcataagtttgggaaacagcaagcaggtctctgaggttggagatcgccttcctggggcagacggcatggagagaatgatgaaggggaatcctagaggggcaaaagatacctggcccagtgtcaatccccctcatgccataatgggcagcccatgatggagggtgagggcctggttgctggggtggcaaccacaatatatgctatggtgtcatttgcaggaaagcctagtacagccatcttggaaaacaattaaaaattaagacctgggctctctcataaattactggggtgcatatacattggaacaatcggccaggcatggtggctcacgcctgtaatcccagcaccttgggaggccgaggtgggtggatcacctgaggtctggaattcaagaccagcctggccaacatggtgaaatcccatctctacaaaaataccaaaaaaaaaaaaaagccaggcatgatggcaggtgcctgtaatcccagttactcgggaggctgaggcggaagaatcgcttgatcccgggaggcggagattgcagtgagctgagattgtgctattgcactccagcctgggtgacagagcgagactccgtctcaaaaaaaaaaaaattggaacaatctctatggaaggtaatttggcaatatcaaaattataaatgcatgtatattttgtgctagaaattcttctcctgggaatttatcctacagatatacttgtaaaggtgtgaaattatgtccaaacaggttattccttgccacattgcaattgcttgtaatctttttttttttttttttgagacggagtctcgctctgtcgctagtctggagtgcaatggcgccatctcggctcactgcaacctccgactccctggttcaagcgattttcctgcctcaccctcccgagtagctgggattacaggcacatgccaccacacccagctaatttttttttttttttggatttttcgtagacacggggtttcatcatgttggcaaggatggtctcaaactcctgacctcgtgatccaccggcctcggcctcccaaagtgctgggattacatgcatgagccgggcacggtggcccaccacctcccccaccacctccatggctcacctctagaggaaggttgcccacagcattccctcacaattcacatgtgagtctcgcactaatagtccactcctgctgcagccacagctgcctgcaccggacccagtgctgccatccccaagcgctctaagtgcaacaagaaggtgtacttggctgggtgaggtggctcatgcctgtaatcccagcactttgggaggccaaggcgggtgaatcacctgaggtcaggagttcaagagcaccctggccaacatggcgaaaccctgtctctactaaaaatgcaaaaattagccgggcatagtggcacacacctgtagtcccagctactcgggaggctgaagcaggagaattgcttgaacccgggagacggaggttgcagtgagctgagatcacgccactgcactccagccttggggacagagcaaggctgtgtctcaaaaaaataaataaataaaatggtctttgctgaacaggtgacctcccagggcaaggactggcattgaccttgcctcaagtgtggaagtgtggaaagacaccgacctccaagggccacccggagcatgaaggcaagccctattgcaaccacctctgctatttcgctgtgttcaggcccaaaagctttgggcgaggtgaagctgagagtcacatttcaagtaaacccaaatggtggagacctcatctgggccactgtccaggctgatgtcaggctatatcccagacactcaaggcttccttgtagctcctcatggcctcaataaacctgaacacttgggggtgggagggggaagactcacttgctctgagccctggaaacacctcagggctgaagacccaccttcaataggagccctattatgccatattcctactttagcagtgtggggaaaagaaagagagatcagactgttactgtgtctatgtacaaagaagtagacataagag

SEQ ID NO: 549 - DNA, 76294 bp, Homo sapiens
gaattgcttgaccccaggagtccgaggttgcagtgagccgagatcgcaccactgcagtccagcctggtgacagaccgagattccgtctcaaaaaaaaaaaaaaaaaaaaaaaaaagaacttcaagctcacaggcctttggactccaggacttaaaccagagactcgccaggtcttgaggctgtcacttccctggttctcaatgtaaaaatgtttaaacttcttcaataaatgaaggggtttttttgtatgtctgtatttatgaaaggtaaaatttctcaagatctcaggttttgggacgactgtatatgcagtggtgacccattgtgtgtgtgtgtgtgtttgaagcagggtctcactctgtcatccagactggagtgcagtggcaaaatcatggctcactgtagcctcaacctcctgggcttaagcaatcctcctgtgtcagcctccccagtagctgggactataggcacaaatcatcatgaccagctaatttttctattttttgtagagacgaggtctccttatgttgccacactggtctctaactcctaggctcaagtgatccagctgcctcagcttctcaaagtgctggaattactgatgtaattctgcactcagcagtgtaaaactgcactcagctcattgtagtttttgattgatttcatcaactcttggagttgtctgccactatatttcatatgactgcgattataatgctgggtacaataaccaaccacagtaatatgcatttatacattttgctttttgacctacttataaatatggtttgtctgctcttaactgttacatccatgtgactgttattatatccgtgtttgttaaatacaaatgtatcattgcctattttattatgtaaattggcctatgaagtattgtctttttttttttttttctttttgagacagggtctcagtctgtcgcccaggctggtgtgcagtggtgtgacgatgtgatcatagctcactgcagtttctatttcctgggctcaagtgatcctctcgcctcagccacctgagtggctgggactacagggatgcaccacactatggtttagtagacacaggtcttattgttgcccaggctgtcgtgttttcctgtttctcaaataaatcttttattatttttttttttgagatggagtctcgctctgtcgcccaggctggagtgcaatggcaagatctcggctcactgcaacctctgcctcccgagtcaagcgattctcctgcctcagcctcctgagtagccaggactacaggaatgtgccactatgcccggctaattttgtatttttagtagagatggggtttcgccaagttggccaggctggtctcaaactcctgacctcaggtgatccgcccgcctcagcctcccaaggtgctgggattttaggcgtgcgccaccgcgcctggccctaaatctccttttaaaaatttaaatagggccaggtgcggtggctcacgcctgtaatcccagcacgttgggaggccgaggcgggcggatcacgaggtcaagagattgagagcatcctggccaacatggtgaaaccccgtctctactaaaaatacaaaaattagccgggggtgatggcacgtgctccgggaggctgaggcaggaaaactgcttgaacccgggaggtggaggttgcagtgagccgagatcacaatactgcactccagcctgggtgaaagagccaagctccgtctcgaggaaaaaaaaaaaaaagtaaatgccttttaaagaatttacatttttttccccaaaattataactttggaacttttgtctttcagaatttcaatatttggggttgtcttttgggattatgatcagctcccaagaagcacaaatctggtcccttcattccactgcttactacccttctttgcattccgtttactttcagaataaaatccaaacacttaagcacggtccacaggcttccatgatctatccggctgtgcatctcaagccactgtgtcactccttttcctctagtcttaatgaactccttccagtttccacacctcaggctctttcttcccttagagaattcacacgttctattttctctgaccaagcctcttgtctcccacacacctttctcccgctcccccatgatttttcaagttttatcttcaatgcaacttcctcaggaaagcctgaccagccaggcaaggttaagtcttccttggataccatctcactgctccttgctcttctgaggacaagtatggttgaaaaattctttggtaattctgtttagtgttttgtcaagttccagaattaaagttcattgcgggtggaggcagtattttctaactctttgtcctctaccgggctgtgcatatgggaagtactcaatacatttctttagtaaatactcaatgggtattcagtgggtatttgacaagtccactttttatatggtaggtgttccaaataagggtggcagccatttactgaatgagtcatcttgctggagggcaaaggggtttactaattgatcactgaagattagctggttattgggattgaagcactaatgggcataaaaaccaaatttctattggtatttttgtttcagcccaagaggtcagaatgtaccctattgcttgtgagcagggtaggcctaggtaggtgattaagatgacagggctagttttgtaattcccagtccagaatttataatcattcagggatggctgcagcagttaccactcctcataccctaagctttctttactatggtcccttcccttgaggtcagatataccaatggacacctaatcgctaattgttggtaggagaagtaaataaccttcactggtaatgtgcattattgattttttttttttttggagacggagtttcactctttgttgcccaggctggggtgcagtggtgttagctcaccgcaacttctacctcccgagttcaagcgattttcctgcctcagcctcccgagcagctgggattacaggtggccaccaccatgcccggctaatttttttttttttttttttttttttttagtagagatggggtttcatcatgttggccaggctggtctcaaactcctggcctcaggtgatctgcctgcctcggcctcccaaagtgctgggattacaaggtgtgagccaccgtgcgtggctgcattatttactttttaaaaatatttagttcctactttaaaggaaattgcagctattgtgttatccatctttattaaaaaaatggattttttacataatcatgtttcacaatgaacgaaaatgccattccttggtatcatctaatgcccaatacttaatcaaattttcctgtatacaaaagtcttttgtgtatttggtttgctaaaatcacctatgctgcatttgatttttgtacttcttacatttcttttaatctagaataatagagtctcattccattgcccaggctggtgtagtggtgcgatcaagcatcatagctcattgtagctttgatctcctggactttagcaatcctcccgcctcagcctcctgagtagctgggactacacacacgagccaccacacccaacctcctcccttttcttcttcatgccattgaggtgttgactaacgtatggtctctattagacaaacttacttatatccactaacttcgaggaatgactaatgggtggggatttcaggacaatcagaagtcagcaagaatgggaagacaaggctgggcatagtggctcatgcctgtaatcccagcactttgggaggctgaggcgggcagatcgcttgacatcaggagtttgagaccagcctggccaacatggtgaaaccccatctctactaaaaatgtaaaaattagctgggcatggtggcgcaggcctatattctcagctacttgggaggctgaggcaagagaattgcttgaactggggaggcagaggctgcagtgagctgagattgtgcccctgcactccagcctggacaacagagcaagacaccatctcaaaaaaaaaaaaaaaaaatggaaagacaaaaaaacattttgcatcaggaagttaccatgacaagtccttttcacttaagcataaagatggtcctaattttcagaagcgccataaaaaccgagacactggatgttagccattgaatctcattgaattgatgctagtatctcagaaccactaccctcactcctaatgtgcaatcactgtgtgacaaatgaaggaatatgactgtagcttatttaagattggactaattcctgtgatgtccacacaaaattggctactccaagtatgtgtttgctcatgcagattagccatttctttatttttcacctaaaaaagccccctccattaaaaacgtgtaagaaagtaatctcaagattagaataagatggcacacactcatttacaaaatacacacgttcctcattaatttatcatttaatataaatgctgacagaaagcagataaagaccttgtagacattttcatatatttacaatccaaaaggtgaatcacctccttctacttgttaaaataaatcattttatctgcaactcatgggagccttaaacactaattaggagcaacatgaggctgagtcagtttccaaggtaataaaggaaatagcattttaacaaaatgggcatctttgatataaacatgcacacaaataatacaaaattgagaaagatggccctagtactctcaaaaatcggcaacaagtgggaacatgtacttatttagacccagagttctgctgccctaaacatcttcctactactatttctttttttccaccacacttgttttgaaagctgcttaaaaatcagaaatattaaacagattaaaaacaagagaaaaacggtctatttcaaatagggttctttttcctactccaaaagaactctcaggagataaggtcttcaaataagacttcacggtttgccagatcctaaggaattattcacagcctgtgaaattccaatccatttgtcttcaccattccaacctatttgtcttcacttctctttttaaagttggaaacacttggaaaaagtaaaatttcacaaaattcagcaattaaaaaatcagctgtcactttaaggctcaatttttttttttcctgaacaggggggtggaggcaggcaagaaagaatagggagctgtggcaataaaaaaacaaaaaaatgcaagaaaactttaaaaaatggtaagtctaccactgatttataagagcaggagtataaattctatccaaaagtgtaagtgatttcacttacaacctgactcaaatctcatgggctcctttattaaccaagattatttttgtcttgttaaatatacctctgcagggcacaatcacttacaatcaatacgattggtaaattacacaagctctatcccaagcaaatatgcaccaatgttaaaaagttatttttttaaaaaaaacaaaataaaacaaaataaaatccacccaaaaaggtgataatgactgcagaatgtctcggggagactgatatgagcctaaagaccaaattaccatagtcagagaaaaagggcagaaggggtaacaaggggaagacaccacaaacacgaagaggaatctcaaaactggaaaatgtttaagtgggtgaaaggttttgttcattaccttaattcactttttccattgttcttgtaccaaaaagtcatagattaatcataaagaaagataatgagacctgtggactaattaatttttttaaaaaagttccttttattcccaggaagcagggaagaggaaaaaggatgaacaggggagaagtgtgaaaatttaggccaacgatccatctggaaaaaataactctcaagacagtgtcttagttgaatagaggatgtaaaaacgataagcaaaagctaaatgcctttaagtcagagaattattttatggggtagttcagatattataagaatgacagccaatcaatggagaaagattacacaaataaatggtgattaaaaaaaggcaaataataataataataataatagagcaaccaattattcacccaatagtttgtttccaatctttttcttgactctttcatacactcactggggtgggggaccacctgacagtttccagttataagatgactctgagtgtacaacctaaaatggatgccaaagacttgtgagctctgtctgcttagagttagaacagaaacaaaaacaaatctgaaacagtaagacctcaatacaagaaaacaagtcaccttatctagtataaaataaacattaggataacaaactccacaggattttatttttctaaatacacatttttggacacgatattatgttgaggtttaagttcttcccccttattgtgccttattttcttgtgaaaataaagttcgttctctagggatgtttcagggataaagtttaggagaaattcagtgtttggctgaaaatccagaggctctgaaaacaaggattccagtggtgaggtaagtccctttattacaataagatttcaaagggctctttacccactttgttcagtgcagtattgaaaacatacctattaggaatagatttattattaaaaggtgttacttattcctggtggtgatagtcttactctttattaacactatagctagtattacttatcaattataatctattacttgtggaaagatctttagtgaacacagaaataaaatcttaaaaattcaaatcttaagatttacttgctacaattaatagtaccttttgacaaaaacagctttcttcttgaagtggctcagaaaagctaaattgagaaaatgtttaatagtaactataatcaacctacaactcccaataagtcatttcagcaggaaaatttcataaacctgagctgaagcaacaaataaatataaaaatcatagctgtccaaggtagaaaggtatgaatgtggatcagcaaaatgggcactcaggtaaaatgatgacagtagtagactgcttgcttgtttaggtgctaatgatgaaagtaaaatttgctttagtttagtaggtctaatttttcttaaaaggataggcagatttttcaggggaagagatcaccttgcaacactgtaaccatatcatcagttaaaaatttaacacacttagactcttattagggggaaaaaatctaagtaaacactgcagttaatttccaggtaggttattaatctctcctaaaaagtaactgggccattcctttcaatgacatataaatcgttacaggtgctttttacagatagattttacaaataaaacctttactcaattatttaaaacgagcaaaaagagagtagaaaaatggtgagactgctacccaccaccatttgtatgtaagtgacagcaactgaatacttctttactgagacgaatccttttttttagtgaaagtattttgtcttgaattttaacaatctgtacatgtactgactatagttagttatttctcaccagtcacatactcaagaattcttttactcagacccatgacttgaccacagtgatagcagaagctggggtgggcacaaatgcttatacacaatattacaaaagacgacattcactggcttagagaaactgatgaattttcattacttttacattttataaggctagctaactttaacagttaactttagataaatctacttacacagtacaatcaactcacaaatactaaaaggtttcatgatcaaaatggctactacttcccccaaaaccaaaacagagtaaagcacaagtctttggctctcctttaaagaaaacagcaggttaccattcttaaccagacctttgtttgcctaccagtagggcaaataccacatttgtgcatcactgagtaataacaccattagaaaaggcaacttcacagaagttattggctaagcgaattcatttgaatgctctgttttgaggcagcaaactgtcactgttgcagattggggagggcagtgggtaagtcaaggggaaattacagggtggaaaaaggtcaagaaaaaaaaagacatatatggaaaaatgtaaactttgagctccatccctgaagaactctggaaagtctgatggagttatatactcaaagtagcaaatgagaatcataccaatattcttttaggcaaaagaaatacatgggaaagaatagaagggaagggaaataagatgggagaaaggaatcaccaacattaatgctgtaccaaacaattttttaaatacattctgagtagttgaatatttgtagttggcattaggaataatgtcttatcaatatctagaatactactactagaaatctagctaactcttcttttaattagaaaagtaataaggaatggatctttggtcacttcagcctctgtacgttatctaagacaggacagttactggacttatcttatgacaaaattatatataaattaggcaaaagagctacatataaaccagaaatggaatctagatgtcttattctcagttcttctaccctttcctagcgactccttgaaaaaagagtaagtcaaaatacttttatatttctcgctataaataaaattccctcacctatgtatgagtgaacacaatgcttattactcctaccttaacccattcaaaattgttcatctcagatatctgatttttgctttggaatttagtgaaatacaaataaagtaatatttagaagaaactaatattttagtaagtagaaaacataaaaactgtatttcctatctggtttcatctttgtctctaaaaaaaaaaattaaaaagccagaagcaattaataccttttcaattttgattttaaaaaagtagttacagagtcaagcagttatgcccaaatatgccatttgtccttacaggctcatgatatcacagagaaaaggaaaaggaaaaaaagcaaaaaacaaaaaacaaattttgggggtgttagtgaattcctaaaaccgctgatgagcactaggaaagctgcaagaatttccattaggtaaggtggaatgaccaatttaaaatacattataggcacaatgggacaatataccatccttctgcctttctgcccaaccagattagctctagagtgtaggaccatggaggggtacagcttgaattcaggttacaattaaagagattttttttcccccaaatgaaaatacatgaaaagagaaagatactattttaagtcaagtttatacagtgacttttctggttttgttcagaacaggaatactgtataaattaatccctgctcctgcctacttcacagaatcaaaatggcaaaagccaagaacaagtgtatttaaaggaaatgagaacaagaataacagaaactgagttactaaggggtttcaactgatatccaaaatgaatctttacttttattttaaacttaaacaaaaattaatacccacaaattatcttctaatacaagaatcattctgaattccaaagtgaatcaactgcttctaaaatttaggatgatctgacatacccaaaggagaagatcagtccaaatctgcttataagaaggttgtagtacaaaaattagctggacgtggtggcgcgtgcctgtagtcccagctactcaggaggctgaggcaggagaatcgcttgaacccgggaggtggaggttgtagcgagccgagatcaacccactgcactccagcctgggcaacagaagcagactccctctccaaaaaaaaaaaaaaaaaaaaaaaaagaaggttggaggccaataatgttgccttttactgttatgcagagaaatgaaaaatcttgggactctgtcagacatacaaaagtttctttccttctcccaataaacaataggcatttaaagtggaaatgtaaaagggttttaagtaaaagtcaaaaagcaaacaaaagccaaaaaaaaaagaaaaagcatacatatatatatatatatatatatatatatatatttttttttttttttttaaaaaaagaagacaaatgtataagaaaactggaaaaaaaaaaagcctcaccttcattcagtgcttctaccacctcccaatcggtcaatttatcgcaacagctgcgctcatgcgaaaaaatccttaaaacatacccaatatatatacagatatagctatgtatatatgtatatatataatatatatataaatttttatttaaataaaaaagaaagctcgaatcccaagccaatatgtgtatatcaaatccttgaccagccaggtctgtagggcataatcaaattcaatgtgaaatagtatataaacacggtgccttgactgggcaaattaaataattgctactcaaaagagtgttctgtttggactctcctactggtaggcaatggcaggactgtattacccttcccacccccaccacccatttgtttaagttaacagtatgatggacacagagcttagactgaggttgttatgacctcagcaggagttaagggttaagaaaataagaaacaagaaaaatataaactcttgtttttactcaaccaaagcaatgtagtaacttattacataaccagtgctttctaatttagtagtaaaatacagaaagggaaactgaaaaaaatcaggcaaatagaggaatggagagggcaactatatcaaacagtccccactaaacacgttttatagggtcttagttaattaagcacagacacatggcatcagaatatgtgcagcagaattaaaaaaaaaaaaaaccttactcttttcaatattttcatgaagaaacatttgcaacattggacagttaagtctatgaaaaatgacttcaaactatttcctacctacttatactaatgattctgagcaacaagtgatcaattcataaactatccttaagactcaatcagttcacaagtaaaacaaaacatccattaaaataatgtggctctattcattttaagttcaaatcaaatgttgcagttttaaaacatagttgattgtccttgttttttagcatcctatgatgtcagcaaaagtttaatttgaaaagcactgcttcaaatttccaaccatgagctgaacgcaggcgaaacaccaaacatgtattttcagtgctagtaagttacagttaattcttgatcaacatttaaatctaattaaacactgaatcagctttctgattatattaagagaatgcaaatgatccttaatatgaaaatgaggacttcaaaattggtaattctatttgaaaagttgaaaataaaaacaagaaataaaaccctcccaaacaaacaaaaagcttcaatgtcaagaaaaatatacgtatccaatgaagctagtgatctagaaagggataaagaattccaaataacagctctgggaaaagttggtttgctgcacattttctaataactcagtctagtactgtctgtttctcaagcaccacagaattctctgaaagctgacatttttggtctgttttaagtttatggggtggtgagaattgataaggattgggggtgaggaattatacaaattatacactgggtatgtaataccaaaatacaagaaaacctacttcattaagatcatacaattaatcaaacagagtgtatatataatatcttttttttttaaagccctggatccaaggcgtccaaagttattaaaataaagttcattcacagaacaaaaacaaatttaatctgaattgcttgcagatactgctaattttctttttctttaaattaaaaaaatgcattaatgtgaactatgtgcagggtttgtttttagtagtggtgtttgtgcacattgcctctggtgaatttcctggatttctctgaccgctcttaagagaaaaagtttagaagttatgcgttctcctacccctatgcccgacaaactgattaggagcagaagataaaagtaggactcctcatattttaaggagcagaactgggagtaactcctgatctctgggagtcattattatcccctcctccctcagggtcctctgacaggttcagagagctggtcttgtttgataggaggctgatattctcttgtgtcaaggctgatccatttggtacatcactgctgacattttaaaattttgaaaaaggagagagagaaaaatgattactacaataaaatcaacaggggatataatttagcatgattgaaaatatataaatggcttccacattttaatctacagccccttatccatgttttagcacacagttggcaaactaaagctagccaggtgcgtattttttttttcaggtgcatatttttgtaactaaagttttattggaatatagcctggtcatttgtttaacgtattatccactgctttcaaaccacagagcagagttgagaattgcgacaaaaactgtaaggcccgtatcttaaaatacttactacctggcctttaagaagagtacttatccctgatttagcaggtttgctactacaagaaataattttgagctcatgcctataatcccagcactttcggaggccaaggcaggtggatcacttgagctcaggagttggagatcagcctggccaacatggtgaaaccctgtctctactaaaaatacaaaaattagcctggtggtgtgtgcctgtaaaaacctactagggaggcagaggcacaagaatcacttgaacctgagaggcagaggtttcactgagccaagatcgcaccactacactccagcctgggtgacagaatgagattttatcaaaaaaaaaaaaaaaaaaaaaaaaaaagccaggcatggtggctcatgcctgtaatcccagcactttgggaggccgaggcgggtggatcatgaggtcaggagtttgaaaccagcctggctaagacactgaaaccccgtctctattaaaaatgcaaaaactagccgggtgtggtggcacgcgcctgtagtcccagctactcgggaggctgaggcaggagaatcacttaaatccaggaggcggaagttgcagtgagccgagatcatgccattgcactccagcctgggtgacggagtgagactccatctcaaaaaaaaaataaaaaagaatccaagatagtgcatgaattaaaaaaacagtcaaaatccaagtctgaaagcattagaaatttttgttatatatcatcaggggggcaacttaggactatgcattcaaaagcctcaaaatagccttagaaaataatttaagatatgcaaacaaagcattaattgtaatactgtttattgtagggttgttcatggtagttgatatgtatctttccgtatctacagaataatactggatgatataggatagactgaattaaaaaccagggagatggagtgctgggtttgtaaaactagcaagaggctaaatgcccacacactttaaaaagactggaaagagccgggtgcggtggctcatacctgtaatcccagcactttgggaggccgaggcaggtggatcacctgaggtcgggagtttcagaccagcctgaccaacatggagaaaccctgtctctactaaaaatacaaaattagccaggcatggtggtgcatgcctataatcccagctactcgagaggctaaggcaggagaatcgcttgaacccaggaggcggaggttgccgtgagccgagatcgtgccattgcactccagcctgggcaacaagagtgaagctccgtctcaaaaaaaaaactggaaagataatataatacaccaaaatgttaacaagagttatctctgaatattggaattacaggcaattttaaaatttgcccttttctaaaattttccatttcctaaagctaattttttataatatatttaagatgggggagtgactttattttttgttttttctttttttttacattgagcatatagtatttttataatgtaaagatataaggctgtattcgaaataaatttaaaaacaaggggaagatggaaacataaccagaaattttcctttgttaggtattaacagataattcaaccttggatctaagttttgtaactccagatttatgcaaaaatattctttttttttttttgagaccgtgtctcactctgctgccaggctggagtacagtggcacgatcttggctcactgcaacctcctcctcccaggttcaagtgatcctcctgcctcagcctcccgagtagctgggactacaggcacatgccaccacaccaaactaatctttgtatttttagtagagacggggtttcaccatgctggccaggatggtctccatctcttgacctcgtgatctgcccacctcggcttcccaaaatgctggattacaggcgtgagccactgcgcccggccgcaaaaatattctttatgtacacagaataatgatattttaagaatcaaattatatttatgagggtatttctgatatgactggataatatattagtttctcttttgtgtgtaatttaatatggctacgacaatctccttttctttacctgaatgtcaatgtaaggtcctcagccggaaccttgttttgtggttctggttgtccattttctgcttgtttacttgtattcagtttgcttttcatgtccagagaacactggttttcctttgaaagagaaggaaataaaatcagttatcatctatttaatggtgttaatgggagagaccaaattacagataatacaaagtgatgatccagaaatcatattcaattttgtaaaataaccaaagaaactggcagactaaaagagtgacatacataaaaacataacagaatacaatccacttgctcactaaccaagctggacaataagacagacaatgcctcaagctaacatgaaaaaaaatttctcagaaaaaaacaatgacctagaaaggcggccaggcatggcggctcacgcctgtaataccagcagtttagggggctgaggcaggtggactgctgaggtcagtttgagaccagcctggccaacatggcgaaaccccgtctctactaaaaatacaaaaatcagctgggcgtggtggcacacgcctgtaatcccagctactcaagaggctgagggggagaatcacttgaacccagaagacggaggttgcagtgagctgagattgcaccactgcactccccacctgggtgacagagtgagactccctctcaaaaaaaggaaaaaaaaaaaaaaaaggctaggcatggtggctcacaccagtaatcccagcactttgggaggctgaggtgggcgtatcacccgaggtcaggagtttgagatcagcctggccaacaaggcgaaaccccgtctctactaaaaatataaaaaaaattggctgggtgtggtggcaggtgcctgtaatcctggctacttgggaggctgaggcagaagaatcacttgaacccaggaggcagaggttgcagcgagctgagatcgtgccactgcacaccagcctgggcaatagtgcgagactccgcctcaaaaaaaaaaaactaaaaaaaaaataaaatacaaaacaaaaactaccctggtgtggtggcaggcacctgtaatcccagctactcgggagactgaggcaggagaatcactggaacatgggaggcggaggttgcagtgagctgaggttgggccactgccctccaccctgggtgacagagactcagtctcaaaaaaaaaaaaaaaaaaaaaagaaaagaaaaccaaagtacaataaatatctttaacatacttactgaaagcaaaaaaaacctgcatgctcaatttatttgcttagaaagattatgaaaactggctgggcgtggtggctcacacctgtaatcccagcactttgggaggctgaggcgggcggatcacgaggtcaggagatcgagaccatcctggctaacacggtgaaaccccgtctctactaaaaatacaaaaaattagccaggcgaggtggcaggcgcctagtcccagctacttgggaggctgaggtaggagaatggcgtgaacccgggaggcagagcttgcaatgagccgagatcgcaccactgcactccagcctgggcgacagagactccgcctcaaaaaaaaaaagaaagattatgaaaactaagcaacaaaaaaaatcatatcatgcaacctgaggaagcccctaagattcaaaatttactaaaatgaatgtctgtgcactatgaagcaaatcctaagcatattaatggatatagtttttcctaagcatacataatggatacaggaaacaatgtgcagattgcatatcactcatagcaaaaataggtcatcattataaaggctatgaaactagaatgttatttggtgaatacatctttatataacatgttgtcattgcaaaatagtaaacaccatcctatttgcttccctaatcagtatgctaaacagaaatttaagacttccattaagttcttaaattacagaagcattaaaaccttgttttccctaaaagttaacgaagaattataagacaaagaacacacccaaaccaagagaatgaggaagggaatgataaaatcggaaggtagcccacctgcatgagaattattttaaatattaaccactcatcagagtgccttgaagtgatgattctgtgcctctagataattctagagccacatgaaagatttcatttcaccttccctctctttccccaccataacactcaccatactcagttcccgtgttctcttcccgatttccctttccacctggtgcagttccaagctcaactgctcacttgagatcatcccaggccattttggaggtggcggtggtgggggctgtgactggcctgccagggtgtttgcctccctctgcaacaccagcctgttactaacagcctagtgcataaagccaagcacacagaaaactcaacacacttcacaccatgcacagaataaccaggctcaattccagaccacagccttgagtagcttatcacccagccatttgcaacaaaataatgcaactgtaaggtgctgttctctttgagtaccattcaaacaaaaaaataacaaaatagggacatttaaatttagtaaacagtaatttcatcttatgtataaattgctccttgtattttctgatttgaaagagaagttggctacgcatggtggcttgtgcctttaattctagcactttgggaagctgaggtgggaggatcacttgaggccaggaatttgagatccacctgggcaatatatcaagacctcgcctctacaaaaaataaaaaataaaaaaaccaaaaaattagcctgggatggtggtgtgggcccgtagtcctagctactagggaggatcacttgagcccaggagtttaagattacagcgagctgctatgatcatgccactgcactccatgcactccagcctgggcaacagagtgagactttgtctctcaaaaaaaaaaaaaaaaaaggaaatggaagaaaaacaagtcaactacagatgtgcatctttccccctctgtttttaatggtaattttctctgaagtaaatcctataacttatttcaatgaaacctcagtaatggcaaggacttttaactgtactgagttaaatatgtggcaagtttctaaataatactgatagtctttttggacagaaaatgctcctggaaactttaaaacaaaaaatcatgcatgtggtggggggaaagcggagggatagcattaggagatatacctaatgtaaatgacgagttaatgggtgcagcacaccaacatggcacatgtataccacatgtaacaaacctgcacgttgtgcacatgtaccctagaacttaaagtatataaaacaaacaaacaaacaaacaaaaaaccatgcatttgaagatatggagtaatgccttattgggttgaaggtctgaatctttaaaaagttaatgaacgaaagattgccataagcaaacatggcattctgtttctatgacaggaatcggcaagacgttctgaatcaatgtaaataagcaatggcgaaagcagacaaaatctaagtattacatagatttttaaaattcctaaatctaattgcgtacataggggcacaagccagctatatgttccaaaaacaatctcctactggtcttcctaaaaagaaagtctactaagaaagtctgtcttataactttttttcccccctaaagtgatggcttacttattattaaagattatggtagaaagacagactaatgttctaacagtaccattttttcctccagaaaggacaatatatttatcattagaatgtcttcagttttccatattcaaagaatatgttccaacgtaaaggatgatgtataaacaaaacctagtcttccttatgtggcacttaaaagattttaaaaattccttttttttttttttttgagacagagtctcactctgtcactcaggctggagtgcagtggcaccatcagggctcactgcagcctcaacctccctgggctcaggtgatcctcctgccttcagcctcctgagtagctgagactacaggcgtgcactaccatgcctggccaatttttgcactttttgtagtgaagggattttgccatgttgcccaggctggtctcaaactcctgagctcaagcaatccatctgctctggcctcccaaagtgctgggattacaagcatgaaccaccacgtccagccagattttaaaaattctttagttttgtttttctaagtgtcaggcagcatgatggaaagaacactgaatctggagtatgaagacttgggttcgtgtttcaacttctgagaaactcatatacttcaatcaaaaaaggaggacaataccacctgcctaaaatatcagggatattctaagggtcaaataagataagtggtagtgatttttaaatggtacagaactacgtaaatgaaaagtgttattattcttattacaccggaactatgttttactttttaagtcaaagttctgtttttttttttgagacggagtctcacactgtagcctgggctggagtgcaatggcgcaatcttggctcactgcaacctctgcttcctgggttcacacgattctcctgcctcagcctcctgattagctgggattacaggtgcacaccaccatgcccggctaattttttgtatttttagtagacacggggtttcactatgttggccagactgttctcaaactcctgatcttgtgatccacttgcctcggcctcccaaagtgctgggattacaggggtgaaaccctatctctactaaaaatacaaaaaattcgctgagtatggtggtgtacatctataaccccaaccactcaggaggctgaggcaggagaattgcatgaacccaggaggtggaggttgcagtgagttgagatcacgccacctcactccagcctgggcaacagagcaatactgtctcaaaaaaagaaaaccaaaacaaacaaacaaacaaacaaacaaaaaaaaccttaaatgtgccatcagggaatataagctcctgttgggaaattttacgtaatctgttttctatttttaggtagcagaaattttacgttttctgttgtcccagagctaaatccagtattgaattctttgaagaatagaaacctatactaactcctaagaaatagaccttaaagttttttgttcacagtgcctcaaaagttcctatttaaaatctctgagaacccttcaaaaattggaataaaatggctctctaggctggtacctctagtccacgtagctgggtctgctggctaatctgatggttcaattgctgcaattctagtcgtagctgttctctctcagcagatggaaggggttttccatgactggccacttctgacatagatattctctccctttggttagaaagaaagtgtgaatcaaattttaacatttcattttgttaacatattactgaccagaaaaacaaaaagaagttgcctaattttaaaggtttctacatgtttgttcaagtaaaaagaatgactcatacctctcactgaagtgtccctgagaaggtatgttttgatgaggtgaatatggagaagctccccagccaccgtgggttccatatggactataatctgtaagagaatgatttattatggtataattcacagatttgattcttcttttaaggtattcataatctgaaagacatcagcgtattgcatacacaggtatctggtatctaccctaaatgtccagatttttaaaattctttaactttgtttttctaaatatcaggcagcatgatgctgggtgctgatatatgtttgtttcttccccaatgaactttcagtctttgtagtttttcttccaaattactgtataatgagaatgttattcccccaaataacaattaagctatttggggtgggggtggagtggggaagaaacattaggaaagcttcacatatagacatttaatttcagtttatatacctaaaattctctgggttatattacctttcttacagggatgattccatggaaagtttgaaaattactgccttgcaagattactaaaaacactgatagtaaatggagagcaggggtaatgctgaaagtcaagattatgaaccctttaggtcagcttacctctgagattcttacctgaaatgttaatagattttgtaggagctccctgaggtgccatagcctgcattggaccagcaccctgatatatagttttggaagttcgtgagatggcaccaaaccgagacactgttggtcggtctccaaatgggatgaggtcatcatcactggtttctgctgctcttctctgaagatctaatcgctggtccctcattcctttactctccacattctgataaaaaagcaaaatgagaaattaccccacactcagatcgctctgtaacctaattttttctagatctgtaataaggttaaagaagagtacagcactcttactggtaagactaaaatcattagttacctttggttgtttttatgtaacactggtttttaaacctctgaggtgaggggcgacagggtctcacaccgtggcccaggctggaacgtaggggcactctcatggctcactgcatcctcaacctcctgggctccagtgatcctcccacctcagcctcctaggtagctgggactacaggcatgtaccagcacacccagctaattttttttgattatttatagagatgaggtctccctatgttgaccaggctggtctcaaactcctgggcttagcttgcctcaagctcagcctcccaaagtgctgggattacaggtataagccactgcacctggcctaagaaatatatttttaaaatttatgggaggccactgttttggactaagctcccgcactaagccccaagacaccagatcaaagcagaatgtaatcacttatgctagatgccacaaaatcaaactgaacttgaaaatgggccagttttccaaaaaacaggagattcacagcaatcaatcataagaggaccactcaatttgaactggtaagtcccttctgctttagtcctataaggaaaataactttgaaacaactaatctgagttttgttccttttctctgtttagctcattagagcatctttctatttcacagatgaaatgcttcctgattaatcaatcactaataaaagccaattcaatcttgaagaaatatatatatatatataatgacctagtatatatatatgcatacaaatatatatttatccctatataatgttacacatatatatagacacacaaatatatagtttgtatgcacattaacatttgagaaatactaggttagacttctttcacctatttgggaggttttcaattacctctagattggattgcaactttttgtttgtttgtttttgagacagggttctgctgtcaccaggttggactgcagtgatgtgtgagcctcaacctcctgggctcaagcgatcctcctgcctcagcttctcaagtagctgggaccggcgtgcaccaccacacctggctaattaaaaaaatttttgaagagatggggtcttgctatgttgcccaggctggtcttgaactcctgggctcaaacaatcctcccaccttggcctcccaaagtgctggggttacaggtttgagtcaccatgcctggcccaaactttttaattctttactgatttaagaaaatgagttttattttgctaatactcgtgttactttaatataataaccctttccttttgaaagccaagtacaaggcaaagattcctgcctaatttcccctcatttcgttccaataagagccttactacagcctaaaaacaatgcttctgtaattctactgcaaaaaaaaaaattttattttgctttttcttcctctaaaactctctatttttttgggggggggggtggggctggcatataattgtatttatgctattagatatcacttcactcatttacagtggttatcagcatccaaatctttttttattgcaaatattggtcttttcttaaccacctggaaaagtatttatctatgaaaatctatataataacctaggaaacctctgttagagttaataaggacaaatgggttaagaataatagtgaaggcatacctttcagcaataccatttctttttttttttttctgagatggagtctcactctgttgtctaggctggagtgcagtggcgcaatctcggttcactgcaacctctgcctcccaggttcaagcaattctcctgcctcaacctcccaagtacctgggattacaggctcctgctaccatgcccagctaatttttgtgtatttagtagagatgaggtttcgccatgttgcccaggctggtctcaaactcctgacctcaagtgatccgcctgccttggcctctgaaagtgctgggattataggtatgagccacagtacccagccagcaataccatttctaagtgtaactttcacacacgtgaagacatacataagaatgtttgaagaatgtttgttggagtaccatacctaacagtgaaagatcagaaatagcctaaatgtccaccaatacaaaaaataatcattgtatggtatcagttacacagaatatctcgtaaaagcagctaaaatcaataatcctgagctacagatataaatacagactgggcgtggtggctcacacctgtaatcccagcactttgggaggccgaggagggcagagcacctgaagtcaggagttcgagacgagcctgaccaatatggtgaaactccatctctactaaaaatacaaaaaaattagccgggcatggtggtatgtgcctgtagtcccagctcctcgggaggctgaggcaggagaatcacttgaacccagaatgcagaggttgtagtgagctgagatcatgccactgcactccagcctgggtacagagtggaactccgtctcaaaaaaaaagtacacatcttaaaagcaatgctaagtgaaaacatgaaaatgcaagctgaagtgtacaatttacataaggtctataaacatataaaacaatattgtttaggaatagtataaaattatccatggccaggcatactggcacacatctgtaactacagcactttcagaagcaggagaatcgcttgagcccaggagttcaggaccagcctgtcctacccaggcaacatagcaagacctcatctctaccaaaaaaaaaaaaaaaaaaaaagagctgagcatagtatcacacatctgtgtcccagctacttgggagggtgaggtgggaggatcacttgagtccaggagtgtgaggctgcagtgagctgtgattgtgacactgtactccagcatgagggagatcctgtcttaggggaaataaaattatccatgaaaatgataaatactaaactcaggatagagattacttagagggaatgaaacagggagaaaaatgagacttgggggatttatacagggggatataactacttcttgaaaattttatttctttaaaaaataaaaagggaattaagatactatccaggtagggtagctcatgcctgtaatcccagcattttgggagggagaggcgggaggatcacttgaggccaggagtttaagatcagtctggaaacatagcaagaccccatctctacaacatttttttaaaaaaattagctgggtgtggtagcaagcacctgtagtcttaggtactcaggaggatcacctgagttcaggagtttgaggttacagtgaaccataatcatgttactgcactacaccctgggtgacaaagatcgatcctatctctataaaaagagataagatgaagccaggcacggtggctcacgcctgtaatcccagcactttggaaggccgaggcgggtggatcacttgaggtcgggagttcaagaccagcctgaccaacatggagaaaccccatctctactaaaaaatataaaattagctggccgtggtggcgcatgcctctaatcccagctactcgggaggctgaggcaggagtatcacttgaacctgggaagtggaggttgtggtgagccgagatcgcgccattgaactccagcctgggcaacaagagtgaaactccatcccccccccaaaaaaagagataagattttgataatattttcaacttggttattagaaacactggtgttacatgatttttcactaaagaataaaataacccaagtattaaatttcagtatctcagcattcacttgaagctgagcagctataattctgactcaaatactacttttgttcactagattcaactttgttatttaaacttcagagctgtgaaaaaaaaattttttttttttgagacggagtctcgctttgtcacccaggctggagtgcagtggcacgatcttggctcactgcacgctctggcctcccgggttcatgccattctccgtgacaaagaattttaacttatttggtgaagaagtccaagatcttaattaattatgtaaaataatttaatctgggttataaacaattgttgagaaattgctatttgcacagaaatataataaatgctctgtctcggtaagtattaaaatatttttatttacacctaaatgaatcaaaaacctatactgtttaaagataactcaactgcagagtatagaatatggtctgaaactcttaagcaaagctgaattatttgtgcctaaatggtaatgggtaaaaatttatttggtttatcttaatttgtattaattattgcttagctattacacataccatcatttccacactccctgctgccacaacatctttgggttttgcatctttggttccaatgtaggagccgatggtgtcacatgaccagggagagtattggctataatcatttcctttgtatttcccagctaccttcaagtcttcatccaaaaactacagatggagaaagaaaaaaaacaaaaaaaaaaaaaagagaaagaaacaaaacaggaaatgggtctatgagtaacaagacagagaaagcagggaatttcttagaacatcgtgctgaagcaacataatgatgattatttgatttttaagtgccacaatagaagatttttgtaaactactatgaaaaatataaaataagtgaagagtgatttttagctttcaggttttttttttttgttttttttttttaccttagcagaaggtaaaaaaaaaaaaaaaaaaaaggtatttcaatatccttccaggaatcaaactaggattttatgggtttgctcatccttttcttcattagatcagtaaacatttaagcatatatgtaccaagccatagttttgctagaccctcctcaacgtttctttcaataaaatcaaggtaaacaagaacattaaaaattttgatttttatagtacatgatgatgtagtaactttttactgaaatctctttaatagcaataattcatatcttgaataaattctgttccttaggttgattcaatgagatgaaaaggatgtctaatttttatcttctcaaggtaagttctccagtctaataacagaatagctattctaaggctaatgtattttcactaaaattgcaacattcacatttataaaatgttttacattttcaaagtgttttcatgtatactacctaataagctcctaaatccatgatagacaacacagatgatatgaccaaggctataccagtatagggcagtgctaggactataactttaatgtttctttcattttatcacaagacatacatacactgatatctaggggtatcagtgttcatttgtattggttcatttaagtggatctatgcctcccgctatactaaaaacatctcttttctgagtcatcattattggccttctgcattgacatagggtctgctgctcactaatatcactcattgtcaatcactcttctgtctctattattcataacctcttcccttttctttgtcctactactatttaaaaaatttttatccttttttatttttcttctacttactaactttagatagaacagccaacttttaaaccacatgacctaccaattacagtgctccttttttttgagatggtgtctcgctctgtcacccaggctgaagtgcagtggcatgatctctgctcacgcaacctctgcctcccaggttcaagccattctcctgactcagcctcccaggtatctgggattacaggtgcatacctctacacccagctaattttgtatttttagtagagaaggggtttcaccatgttggccaggctggtctggaacacctgacctcaggtgatccacccacctcagcctcccaaagtgctgggattactggcgtgagctaccatgcctggccaagagtgctccttttttaaatctctgtagtgtattatatgtagctatttaaatgaatgagataaatttatatactgacatacaaagacggccaggagaatggattaggtaaaaacaaaaacaaaggcaagacagacataaaaccaagatgtatttactaaatgatcctattaaaaaataataatgaggctgggcaaggtggctcacgcctgcaatcccagcactttgggaggtcgaggcgggcagaccacctgaggtcgggagttcaagaccagcctggccaaggtggtgaaaccctatctctactaaaaatacaaaaattagctgggcgtgttggtgcatgactgtagtcccagctactcgagaggttgaggcaggaaaattgcttgaacctgggaggcggaggttgcagggagccaagttcatgccactgcactccagcctgggcaacagagtgagactccatctcaaataataataataataataatacagagatccaacaatcccactactgggcattcattcaaaggaaaagaaatcagtatatgaagggatatctgcactctcatgttttattcccaatagccaagatatggaatcaacctaggtatccagcaacagatgaattgataaagaaaatgtggtatatatacaatgaaatactattcagacataaaaaaataaatcctgtcatttgcagcaacatagatgagcctagaggacatcacattaagtgaaattggtcaggcacagaaagacaaatatttcatgttctcactcaatgtgggagctaaaaagttgagtcacagaagtagagagtggaactgtggttatgagagactagaaagggaatggggggagggaaggggagagagcttggttaacagatacaaaattatagctacacaggaggaattacttctagcattctatagcactgcagggtgagtacagttaataatttactatatattttctaaaaactagaagagaggattgtttttcctgatttgaaaaaattatgtttttttgaagaaaacttttaacatcataaactgatctttatatacaattttatccattatttctatagaccaattccatccaggtttatttacttatttacaaatgacataaaaaatttggacggggcatggtgggtggattgcttgagcccacgagtttgagaccaccagcctgggcaacacagcaagaccctgtctcttttttaagaaaacagaaacatttaaaattttctacttaggatcttgaaagtcaaaataaaatggaaagtatctaggatagattgacaaaagaaaggaatatcaacaaaatgattttcgatttgaggaagaaagaaaccacaatcttaggctgggtgtggtggctcacacctataatcccagcactttgggaggctgaggcgggcagatcacgaggtcaggagatcgagaccatcctggctaacacggtgaaaccctgttcctactaaaaatacaaaaaattagccaagcgtggtggcgggcgcctgtaatcccagctactcgggaggctgaggcgggagaatcgcttgaacctgggaggcggaggttgcagtgagccgagatcacgccattgcactccagcccagacgacagtgtgaaactctgtcacaaaaaaaaaaaaaaaaaaagagaaaccacaatcttcatacaacaacaacaacaacaacaacaacaacatcacgtttgcagtaagagatgttggcttttttttttttttttgagaaggagtcttgctctgtcacctaggttggagtgcagtggcgcgatctcggctcactgcaagctctgcctcccaggttcacgtcattctctcacctcagcctcccgaggagctgggaccgcagatgcccaccaccacgcccggctagttttgttttcgtatttttcgtagagacagggtttcactgttagccaggatggtcttgatctcctgacctcatgatctgcccactgtagcctcccaaagtgctgggattacaggtgtgagccaccgcgcccggccaatttataaaggaatcttgagataaacactatgtcaacaatgttgtagatacaaaaagcaaggacaacagtagatctacccagcatttttccttgaaataaaatctgaaaatcataaggagatatttatttagcccacaggaagaatgttattcctacaatgttacataatacaaaaatttacaattaaatgtaacactgctctcttcttcaaagaaaagttggatgactggccaggcgcagtggctcatgcctataatcgcaacactttgggaggccgaggtggctagatcatctgaggttaggagatcaagaccagcctggccaacatggtgaaaccctgcctctactaaaaatacaaaaattagcctggcatggtggtgcatgcctgtaatcccagctactcaggaggctgaagcaggagaatcacttgaacctgggaggtggaggttgcagtgagccgagatcgtgccactgcactctagcctgggcaacagagcaagagtctgtctcaaaaaaaaaaaaaaagaaaaaaaaaagaaaagaaaatttggatgactgttctgaatgacttaaatgctacctacctaccagtcaaagggtgacctgaaactctctggaagcatcctgcatttctgtaaccttgaccttccagcagtgagtatcacatacacaattgtccaaggaagagaggattttgaatgttcccaaaataaataaaagataaatgtttgagatgatatgctaattaccctgctttcatcattgcatattgtatatatgtattgaaatatcactttgggaggccaaggcaggcggatcacctgaggtcgggagtttgagaccagcctgatcaacatggagaaaccccatctctactaaaaatacaaaattagctgggcgtggtggtgcatgcctataatcccagctcctcgggtggctgaggcagaagaatcacttgaacccaggaggcggagtttgcggtgagccgagatcgcgccattgcactccagcccgggcaacaagagtgaaactccacctcaaaaaattaaaaaaaaaaaaaaaaaaagaaagaaagaaatatcactctgtatcccataaacttgtacaattataatgtgtctactaaaaagatgttagttcatgcacagaaagaaggtgaaatatatataagaagtttaaatacataataaatggttatagaaaatgagattttcgagaaacttctctttctatatcatgtatttctataatgtatgaatttagtacaactatacacaggttgttttatttatttatttttaaatttttgttgagaacgagtcttgttctgtcatccaggctggagtgcagtggtgcgatctcggctcactgcaacctccgcctgctgggttcaagcaattctcctgcctcagtctcccgagtagctgggattacaggcgcccaccatcatgcccggctaatttttgtattcaggttgtttataatcagaactgaggtttaaatatatgtctttgcatctcagtaactaaaatgattctagataatgttccttaatactcagacattattataatttttattaggagtaaaaataacaataataaatatgaattatttactgaatgcctgctacataccagatgccttatgtttcatcttcaccacaccactatgaggtaggctttattatgtttgatttataaatgaagaaacgtgcacctcaggattcagggaggctaagtaattttaaaaagatcacacagtgaaggacacaactgaacctcaaagtttagaatgtttgataccaaaaactgctcagtttttacaatgtcatattgttttccatatttcttataaaacaatatggcataacaaagttccagggtgtactctaataaagaatttttgaaaaaatatcacacctgttttcttccccccctctaatttttctgagacagggtctttgttacccaggctggagtgcagtagcacaatcatagctcactatagcacggacctcccaggttcaagcgatcctctcgatcttcccacctcagcctcccaagtagctgggactgtaggcgtgtcccaccacacctagctcatttttatttttaaatctgtagggatggggtctcactatgttgctcagactggtcttgaactcctgggctcaagcaatcttcccacctcagcctcccaaagtgtgggattacaggtgtgagctaatgcacacctggctgtttttactttacaaataaaactacattaatagaagatgttgtgactttactaataacctacatttttgtggaaaactcatccaaagtgtttagatgagaaaactagatattgtgaacaacttctatttagtagacttccttcatatacccaacaagatactatttactatgtgtgatgtacttctcaattttcatttattattcatgatttgtcagttagcaatgtttagaatcataattctatacataaaggatgcaagacaagttccttacatagtatcaactgtaatcctgagaaaccttacttgattattaaaaaaaaaaatacaaactataagctaaagcagtatgtacaatcaacaaaacaaatacgattactttaaagttggattttttgggcagggcacagtagctcacgcctgtaatcccagcactttggaaggccaagacgggcagatcatttgaggtcaggagtttgagaccagcctggccaacatggtgaaaccccatctttactaaaaatacaaaaaaattagctgggtgtggtggcacatgcctataataccagttactgggggaggctgaggcaggagaatcgcttgaacccagaaggcagaggttgcagtgagccgagatcgcaccactgcactccagcctgggcgacagagcaagactctgtctcacaaaacaaaaaaaaaaaagttggctttttgaaagacaaataaaattgataaatccctagcaggactgacaaaaaaaaattaccaatatagaaatagaaaaacgaacatcactgtagaccatctagacattaagataataagacaacacttattcactataactactagcattgtcatacagaaatacaaagaagttgactccccaaattatggttattgccctgtgatacattaaccagttttttttttgagcaatcttatttgactgttttttttttctgattttcactatctatatttacctgttttttcctattcattaaaccaacttttctggctggtttcctcattactgagttaaataaatctttgatattctttcttatttaaaataaatctgaaactaggattagagaaaaccttcataaatatgataaagattttctaccaagaagcctacagcaaacatgataatggtaaattattattaaaagctccatttactcaaagattagaaaggagtcaagaatatgtgttatcatcacttctattcagtattatgctggagtccaaaataataagacaaagacaaaacaaaaggattaaaaaggggaaaaagattattcagaggacataattgtgtgcacagaaaattcaaaagaatctactaacattattatgattaataaagaaatttagcaagcctgctgaatagaagggtcaatacataaaaatctatttaatttctctatattaataatagaaaataaaaatttccaaacaattctatttaaaatagtttcaaaaaacattggttatcgaggaataaaattcaatgtaagacgcgcaagacactgaagtatgaagtataaagaaaatccaaataaatgaaggggtatatcatgttcatagagacttgatattagaaagatgtcacttctcagccaggcgcggtggctcatgcctgtaatcccagcactttgggaggccaagacgggcagatcacctgaggtcaagagatcaagaccatcttggccaacatggtgaaaccccgtctctactaaaatacaaaaaattagccgggcatggtggctcatgcctgtagtcccagctacttgggaggctgagataggagaatcacttgaacccaggaggcggtggttgcagtgagctgagatcgcaccactgcactccagcctggcgaaagagcaacactctgtctcagaaaaaagaaagctgtcacttctcatcatattgatctaagacaacactgtctaggcccggcgtggtgtctcatgcctgtaatcccaacactttgggaagctgaggtgggaggatcacctgaggttagcagtttgagaccagcctggccaacatggtgaaaccgtgtctctactaaaaatacaaaaattatagtcgggcgtggtggtgcgtgcctgtaatctcagttactcaggaggctggggcaggagaatcatttgaacccaggaggtggaggttgcagtgagttgagattgcaccactgtactctggcctgggcaacagaatgagactccgactcaaaaaaaaaaaaaaaaaaaaaaagatacaaaaattagctaggaatggtggtgtgcacctgcagtcccagctacttgggaggctgaggcatgagaattgcttgaacctgggaagcagaggctgcagtgaaccaaaaatgcgccattgcactccagcctgggtgacagagtgagactctgtctcaaaaaaataaataaataaaaataaagcaacactgtctaatagaaatatgtgatccacatataaaattaaaacattttggtggccacattaacaacaaaaacaggtgaaattaattttaataattttatttaatccaatgtatcaaaaatattaatgaattttacatttttggtatgaaatccttgaattcagtgtgtatttgatgactatagtacatctgaacttaaactggccacatattacatgttcaacagccacatgtggctagtggctaccatactggacagcacagatttacagatctgatgtaatcctaatcaaaattgaagcagatatttttgtggaaatcaacgtgctgattcttgaaaaataacaatactagaaaatataaccaccacatattgagacttattataaaactatacgaagagaatgtggcatcggttcaaggatagaaatagactgacggaaaagaatagggtcaggaaacacatgtgtggtcacctgattatgataaagcaggacaccagggaaagcatgctgatttcattaaattgtgccgagtcagtgccttacaggaacaaaaaaaaagatcttgactcctaatgcattacattacatacatacaaaaatcagttctagatggattgtagagttaaatgataaaaaacctttcagaggaaaacaggaaaaaaaatcttcacaccattgggaataggcaaagatgacttaaaccggacacacacaaaaaaacacggataaatgagactaaaaatgatttgcttacttcttccggatgaaaggtaggaggcaaggttggtgaaggtgcaaaaggaggtggagagataacctttctttcctctagctgggccattatttcctttcgtcggcgatgtagttcatctagactaggatgaggctggggaggaggaggaagccggctataaggaggttcctaaaaatagaaagattagttaaaattgaaagagaatttcaggacagattaattcatttaatatactcagcgtatattttaagttatgaaacagcttgtatacccttcttaacatttggaaacaccaacacttaacagaacaaagtaaaacaaaaccccccaaactctcaagatcttccaaatagctaaatttaggtttcttttatttggtcataattaccaagtagatctagaattgttaattaaaccatctaaagttcagaaactaagaaaggttaattgtggggaggaggcagatttttttctcattatatagtttaaaaaaaaaaaatacccaaattatgaaaagatttaaaaaaaaaagaagctctcttataaaaaagaattcatcaaagggttattgtcattgcataaaaagtaaggaatcacagcaagcaacagtcaaattaagtctatgtaataaaaaaaaatacagcatactctgaggtacgaaggtctgatctgagttggatgaggagccactggatagtaactctcgatctgttggtatctttctctggattctggtacatacgatggtactgctgcaggtggaatctcaatgggtatagggctttctcggaatatctcttctcttgtgtaagacggagcagggtacactcgacggccatcatagtgagatgggtatataggtgggtactgctgtggctgtgtgccatactgagagtttacaacacgttcttggaggtagggtggataatgatccaagtagggaggagcaggttcaggagcagatggtggaggtcggacaaagcgggacacacattgtggtggtggagtataatacatacctgcacaatacaaaagaggacccaaaagcaaataatgagccaatttagttttctatgtaagattttaccttttaaaatactgaaacactaaagtattgataatctacttatttctttacgagttttccatctgcttatataatcaggttagctttttaaaaaataagcaaaaattatctgtaaaagtcattgaaaaaactaccctacttataatctataatagtagattggctctcattgtttgaccctctttctggtgtgtcttaatgcaatgaagacactggaaaacaaaaaaactacatttcccagatatccttgaagtcaggttccacaaatcaatcacttgcatgagttttgaatttgaaactgaaataactgggaggagacatggaacacaaaaggccaattttgctggcgcagattagtagctactgcttggctctacagttcttgagacaacagttgtggcaatagtttctcagttttccaacttttgcctcaaatgacgtgatcttggaattaagcagttaggacagaagtttctacttctactgcttcttcattgtaacaagttctcttggcagctaactctggagcactgtttgcttctttagtacctccaccaatatggcaggcacctaactcctgcactaaatctctttctgcttaatatagctaaaataatttacctaaaattgaaaacaggctacaaaaagagttgcattttttcctataatggatggtcaaaggaagatacaaatcacgttttatcatattttgcatgaattagtaatgccatatcaattaaaaaacattctcatgaatgaatgtagagaagacaacatgattcaaaattaaatgacagactcggaaaaagaagacagcacttttaatctattcccattttaaaaattatagtactatactgcttctgacagagagatccaacacttaaaatcattcagtgtttattttacatataaactatatatgtaaaacgttagtttattttctttccttcattctccatacctggtattatcattaaagctggctaattttcaaatttgtctatttttgaaatcccttcttctcctttcccaccacactaattcgtcagtactcacaccaggattaacagcctcctaactcaactctcatttttccaatccattcataacttttttttttctattccaaatacctctagggcatttcttccattaagtctttttgattcctcaagttctcaatgatctcccttgagtctttcagtcaatctctatcaagctaatattaaccacaacagatcacttaatttttaacacatacataaacaccacacacatgcatctactactcatgcatatagttttctattctttaccattatttattctattctgtaaactctctaaaggtgtgtatgctgcattttttcatatatattacagggcccagaaaaataataattaaaagaagaaaaatgtactgtgggtgtttaatttacacacactataatattaattcttttttcatgcttgaagaaaattttggtcaggagaatatatgctgccttactcagcaaatttccattgcctacttgtgtaacttgttatttccataaatattatatatgaacacatgtattatgcaactgcttttagtagatatggcggtttgatttttattactttgtttcatttatttcatagtatttagttaatcataaaatctcaatttttccaaagtattaaaaaatgcatttatacatttacttatcttaaagaggctactgtgtaaatgatcactctgacctgaagaacagttctgataattcctaagaaaagttagcaatataaatttaaaatcgttaccctgctgataaggtgctggttcaaatggcggagctgctcctcgaggatcctgataataaacatccgtctgttgtgctggatataactgagaacctcgaggtaccatctgaagtggtttggtaacaggcattggaggcagatctgctggcccccttggaggtatagaatgtggattcacaggtaaggcagaaatactcttaggaacagattctagcctaagggaataatattatggaagttgtttaaaaaatacttctcatgtgcataaattgttacaagtaaaaaagattgctacaatttgggaaactcacttattctaatagtcctcccttctacaaaatttgcaatttttaaatcttatttcccctatgttaattgtttcttttcttttttttttgagacagagtctcgctctgttgctctgtcgctctgtcacccaggctggagtgcagtggtgcaatctcggcttactgcaacctccgcctcctgggttcaagcgattctcatgcttcagcctcccaagtagctgggattacaggcatgtgccaccatgcctggctaatttttgtatttttagtagaaatgggtttcatcatgttggccaggctggtctcgaacttctggcctcaagtgacccgtccacctcagcctcccaaagtgctgggattataggcatgtgccaccatgcctggctatgctaattgtttcttaaaaaacactagcatgggaaataaaaaagcaacaaaataaaggccaaaaaaaataatcagggttttttttttttaaatcccaaacattaattattctatcttccttcgactttatgaagaagaaattttgaaataagagttagaaaaatgacgtacaggtcaggaggggatccaggagcactactgctcagatgatctatttttcctggtttcagactagaatcatagctggggtctgtccctcgcggaataagctgtgttactgtattccctgttgatacaattccatttggcagagcaggaggttttctgctagggagatccactgcaccttcatctggaaggatagctgctgaaggcaggcccacctcattaagttgacccaaagaggcactcaagggtcttctcggaaccaggcgcttattcattttacgaaatctatataaaaagcataggcacatatcaaaaagcaaatataaaagcaaaaccaagaactaaaatgtacttaatattattttctagaaatattctctcttgaaacattaactctatcagtgtgtatattttgcataaaatctctagcagcaagacatattaagtataaaattcctcataaaaatgtgtaacataggccgggtgctgtggctcatgcctgtaatcccagcactttgggaggccgaggcaggcggatcacgaggttaagatcgagaccagtctggccaacatggtgaagctccgtctctaataaaaatacaaaaattagctgggtgtggtggcgtgtgcctgtggtcccaactactagggagactaaggcaggagaatcacttgagcctgggagacagcggttgcagtgagccgagatcacaccactgaactccagcctggcgacagagcgagattctgtctcaaaaaaaagagtaacatttgtcatattataaattatgctattaatatttttgctataatatatttctgtggacatttgtatttctaaaacttattggagaagctagtagaaaaatctttagaagatagtttctgaaatattttacttcagctctccctcaaatgccttgggatacaatgagccaatgttaaaaaattaggaataaaagaaaaacaaagccagtatgcactgtgaaacatttgtcatttactctgttaaaaaatttaagcagccaggcactgtggctcacaccagtaatcccagcactctgggaggctgaagcgggcgaatcacttgagctcaggagtttgagactagcctgagcaacatggtgaaaccttgtctttaccaaaaatataaaaacttaaccgggtgtggtggtgcatgcctgtggtcccagctactcgggaggttgaggcgggaggatcacttgagcctgaggcagaggttgcagtgagccaagattgcaccactgtactccagcctgggcaacacagtgagaccctgtttcaaaaaaaaatttaagcaattaaggatagtgacttttattagaactgcttcagagatgctgatgttatgtatgccaatacaaaattaaagttattttaaaagtaggttaatggaaccaatacagaataattgcctgggtttaaagagatgctgtggtacaacaagcacatcgattctgaaatctaaccaaaggaaaaaatataagccatcagactccaggatctttgttcctcaacaatgaaagcaagtccatttacaactgctaatgcatttttattttgaaaaataaaacctcggcttggcgcggtggctcatacctgtaatcccagcactttgggaggccgaggcgggcagatcacctgaggtcaggagtcaagaccagcctgaccaatatggtgaaaccccatctctactaaaaatacaaaaattagctgggtgtggtggcaggcacctgtagtcccagctactcaggaggctgagacaggagaattgcttgagcccgggaggcggaggttgcagtgagccgagattgtgccactgcactccagcctgggcgacagagcgagaccctgtctcaaaaaacaaaaaaaaaaagtaaataaaaaaataaataaaaccccatcagagtaataatgctatttttccacgtttcccaaaactgacaaatttctgaggttggggagaaaactacccctcaggggtaattattgttgaaagtctagtgtatcattatatggaattgttcctttatacattagctttatattcatataagattattatttgcagcagttgagtcatatattactgctaatttttccctccacttaataatcttagacatccctttatgtcagttcattttaggctggttgggttttttttggctattaaaataatgtgctgggcacaatggctcacgcctgtaatcccagcactttgggaggctgaggtgggtggattcacttgagctcaggtattcaagaacagcctgggaaacatgggaaaactgtctctaccaaaaatacaaaaattagctgggcatggtggcatgcacctgtggtcccagcttctcgggaggctgaggtgagaggatcattggagcctggaagtcgaggctgcagtgggccatgattgcatcactgcactccagcctgggagacagagtaagaccctgtctcaaaaaaaaagtaacagataattatgaacatgtacttgcaccctgtgtgaataaccaaataagcaaaggcagaatgaggtcaaagagcacgcaaattagaaatttttatgtcatactgctctctaaaactattttaagtcctactgatcatgaagaaaaacgtctttcaaaacctcatcaaatactgggtagcactggtcttgttaatttggtagtccaaaaatactaagttgctttaatttgcatttctttaacaactagtgagattgaacatagtttcacaggataattggccattagtatttcttccgtaaactatgtttatgatccataaatctattggttcctctccttcctacagacttgtaagagctcattttatgttaggatatcagccctctgtgtgtcatttcctcaccaagctttttataaaaaactgtatttgtaccatatcttagttttataatttttatgtaatcaaatttatcaatcttttcctttatggatgctgggttgcagttcttaaaaaaatcttttccttctttccttatttaacaactaaaaacaaacaaacaaaaatcctcttaactactctgtggtttcttgccttcctaaatatttaaatctcttatacatctagagttcattttagtataaagattgtggtaagaatccagctctatttttcaaataggtgacagttattttccatcattcatttggtcactgatgtgaaatgccacctttagcacatatgctaagctcctatatgcatctcaaactcctcctagattctctattgcatttcattaatctatctattcctacgcaaaagactaaagtcttttattcactgtagtccataatacaggtaaatagttattagtctagttcctgtctaaaacttccagaattttcagaattttccttgctatttgtacctatttattctttacaaatgaatttttgataggatcttaacatcatcatggtgagatttaaattcggatttcttggaatttgttgtttatgggaaaatgaaacttttatagcatcaaaccttatccaagaacacagtatatttactcaatatttctcttatgttcctaggtaatttattggttcaatttatatacaccctggaagagatccttaattttaacttatttttaaactggttatgtttctctttttagtttacacgagggcaattcatgtttgtgatttttaaaatttgccatcttactaaattctcatttcttttgtttctagtactaaagtttttcccaataattttatggctatgttattctttcttacatacattagctactacttccacaatgttaaataacagtggtagaaaattttactactaattactagcagaaaattttgctttatccttgactttaatgagagtgaatcgaatattttactaattaagcatcatactattatgttggcttctgatttataatataatttattaccatgctgagaaagtatggcatttctgttgtattaaggaattttgatttttttttttttttttttggagacagagtctcgcactgtcgttcaggctggagtgctacggtgcaatctcggctcactgcaacctccacctcccgggttcaagcgattctcctgcctcagcctcccgagtagcttggtctacaggcgcatgccaccacacccagctaatttttgtgtttttagtagagacggggtttcacaatgttggccaggatggtctcaatctcttgaccttgtgatccgcccgcttcagcctcccaaagtgctgggagccaccggcgcctggctggaatttgatttttaattgacattcaattttattcaaaggcctttggcattttttggatattatcatgttattttctaagttgtgataattatattgtactacttttgcagagtcatggcatctattttcttttctttaaaaaaaaattatattatttatattaaaaaaaaaaacctacagcacccaatattcccaggtagtctcccatccaagtactaactgggcctgaccatgcttagcttccgagatcagatgagctcaggtggattcagggtgttatgcccttagacatggcatctattgtaatgtattactgaattatatttaaatttttgagatttttaatattaatacttgcagtagatttgcagttttaattgtgttatctttgtcaaatttaatgaaagtgttacattggatttataaataaattaagaggcggtgggtgtggtggctcctgcctgtaatcctagcactttgggaggccaaggcaggaggctcccttaagcccaggagtttgagaccagcctgggcaacatagggagaccctgtctctatttttaaaaaataaaataaaataaaataaaaataaaaaaaattaagaggtttttcctttctttcttcaatgagctgaaaaatttaacatccctgaaattatcttgtccttgaagtttaaaagaatctgttaaactgagccaagggcaaaattttccactggaaatacatcatgcaattagttaaattaagttaaaattgattaaaattattataattttaattttttttgtagtgaaaatgacccacttttagatttagctaatcataaaatagtttcctatctataggcatgatgcaataaaagctgaagaaactgcttttcatttttaaaaattatgtacaggttgaatatctcttacccgaaatgcttgagaccagaagtgtttcaagatttggatttgtcttggattttggaatatttgcatatacataaggagatgtcttggggataagacccaaatatataacatgaaattcatttatatttcatatacatcttttacacatagtctgaaagtaattttatacattattttaaataattttgtgcatgaagttttgactgctatccatcacaaggtcaagtgtggaattttcaacttgtggtgtcaagttggctttcaagcatttttggattttgaagcatttcagattttcagaataggaatgttcaagctgtgttacattctaaaaatgtcctattcatttaagataaagcagctactctttctgtatttctgtatgtcagcgaattattccacttacaccttattccaaagtctcctgactttcacacttacttttccagttcctcctgtgagtgtgcaaatgtacagctggccccacgagggcatcctcctctctgcttcatatctcgacacatgtatgttttgtatttgctatgctgtggaggctaaaaccaaaatcaaaacattagatgtgtaataaccccccacaaaaaaacataaattttgtgttgtcattttaggatcttgataatctagataagtaattcacatatttatttagattaccaagagcaaaagtgctggaaagtcattctgtctgaagtttcaaagtccaaatataaataaagcaaaaacaaagaaggtagtcctaatttttctgatatgttgatattaattctcaaacaagtagcataatataaattcttgaataaatctcatgggcattcttatacttgtattatatggaaaaagaaaaagctcatggggacactatgatctcatttccactttttttttttttttttttgagaaggagtcttactctgttgcccgggctggagggcagcggcgcaatcttggctcactgcaacttccacctccccggctcaagcgattctcctgcctcagcctcctgagtagctgggattacaggtgtccaccaccgcacctggctaatttttgtatttttagtagagacagggtttcatcatgttagccaggctggtctcaaactcctgacctcaaatgatccgcctgcctcagcctcccaaagtgcttgggattacaggtgtgagccactgtgcccagcccatttccacattttataatgaaaaaacaaaccactgtagtttaagactttcaaatatataaattatcttctaatatttgttttgtacaatgttcaatatagctatatgtatgtttccatacaacataccacaaaaactacaaaaggccctataatcaaagaatattctgtaactaattcttcttgacatgcagaataatatatgaagaacttaaaatagttccaaaagtacaaatgacacttattatttataactcaaggataaggcaggaggatggatttgaaagttaatgaaatatgagacacaacactaaactggacaaaatttagtgtattttatcactatatggcagactttaaaggttagtctcattactcttgttattttcttcaagatgtctaatgaaacagagagttaaaaactgtaggttctcctttcttttatgcctattcataaataaagctttgacctgtgttagataggttaggaaaatcatatccagattattttacttagcaggataatttttatatttcttgcctcttaagcaaaaaggaatactgagtaacctatttatatttacctgaaccaggtaaattaagagttttacgttcacaggcttactactgcaaaataaaagatctaatgaacctaatataaatcctgagagcaaaataaaattactgggaataaaatttaaaactctagctataagaagttattatattctaccatcgtattttcatctaaaaactttgagggagatttggcccaatggcataagacattatgaatgaaaaaaatcttaaaatattaataagaaaatctatagaaatttgaacagtattggaaagacacagtattagcactaaaaagtgatacttattgtcaaaccaaaatgttaaacaaactaaagagaataataatcttatataaatggaataaacttcagcactgaatccattttctccatcaaatgctgccatatccaatgtgaagactgaccccagcatgacatcagatcaataaggattatttaatgtcaatattgtcagataaagttatcagcctaatgcagtaaactgttaaccatgccaaggtaatttacagtttctatactcagagtctcaaaatgttcatgttatctttttggctttgtatctgtaggtatacccacagtggtttacctatagttttaaggcatatccacagtgggttaactctaagttttaaacagcttccttacctgctgctgatctgctccttttttgctgtggttctggatataatcaaccagcccatgtaccactgtacgcacagcaaccagcccattttccagctgttcccaagtaggaggaggagcatctatacaaccaatgataatgttttaaactctaatgttactcaaaattttccctaatatcaaattaataaaagagttacttgaaaacatttcagtgaaatcaagcttcacaccttagctttttagataatagcttattcacctaaccatcattttaaaggaatggacatattctttcaaagctggggttgcaaactgaaataaccataggaacaagaaaggtaacatgaaagaggtaaataggccacacaatagtggtaactgtcattagactctcagtgttgaggagacaacaacgagtgacagggactgctgaactggggagcatgtccctcatctaagagtatggttataactcagctttagatgattgttgttatgtgatgatgcaaggctggcactgccagatacattcactgtttcccagggaaacctgaaacttgagatttttaagtaaaaatttcccagttttaaaatattggcatctaagaaatttagaccattgctcagaccaacactgtgtggattaaacaaaactgaggactgtctacagttagtcaatttgcatgtttattttgaacttttatataaataaagttttggtaaacaaaaagcttaaaaagtttaataagccgggcacagtggctcaggcctgtaatctcagcactttcgcaggccgaggtgggcagatcacaagatcaagagatggagaccatcctggccagcattgtgaaaccccgtctccactaaaaatacaaaaattacccaggcatggtggcacgcgcctatagtcccagcaacttaggaggctgaggcaggagaatcgcttgaacccgggaggcggaggttgcagtgagccgagattgcaccactgcactccatcctggtgacagagagaaactccatctcaaaaaaaaaaaaaaaaagtttaatagaagaactatcatataaagtaactctgctacatgttttcttcatttagtaggtatttgcccagtgccagcactatgatttataaaagaaaaattaactataaggctaaatatattctttaaaagaaatatgtaaaatgaaacaagaagagagatgtagagataacttcttgctcagacaccctgaaagaattctaggggatggcatttgaactgggctttgaaggacacatggaatctgaaaaggaaaaaaggtgaagaaaacaagtattcaaaaaagtagtttttggaacacttgctaaatctgagttattgttctagttgttgggtaagcaatagtgattaaaacaaaaatccccattatattcaaggagaagagccagataataaccaagacaaataagcaaaatatacagtagtatttagataatgttgaattcaaaaaatagagctaagaagagaagtggggccaatgtgtaaaattttagacagaggcaatccacccatcttggccttccaaagtgctgggattacaggcatgagccactgcgctctactaaaaatacaaaaaaattagctgggcatggtggcacacgcctgtagtcccagctactccggaagccaaggtaggagaatcacttcaacctgggaggcggaggttgcagtgagctgagattgcaccactgcactccagcctggtcaatagagggagactgtctcaaaaaaaaaaaaaaaaaaaaaaaaaaaaatttagacagaggccagaaaagtcctccttgagaaggttacatttgattaaagacctgaaagaagggtttaagtgtgcctactggagactttcaaatatataaattatcttctaatatttgttttgtacaatgttcaatacagctatatgtatgtttccatacaacacaccacaaaaactacaaaaggccctataatcaaagaatattctgtaactaattcttcttgacatgcagaataatataccaagggaaaaacatccaagttagagggaagaataagtgcaaagtccttgatgtaagaagtgtgcctggcatgttgcatggaggtggaatcagagaggagggaattaagtggaaaaaaagggtaggaaatgaggtttgagagaggtagtagaagaccagatcacatgaggccctatagatcatgggaaggatactgggttttactctgagttgatagaaagccacaggagaatttatgagcagagggtgacagggtcgctccggctcttttgttaaaatcagacagacaacaggaggctattccataatcccctgagagatggggatggtagcagtgaaggtaaatggattctggatggattttaaaggtagggcctacagaatttgctaatggatcagatatacattatgagagaaagaagaggtttttggactaagcaactggaatgacagagttgccacaaacaggatggcaggggagagctcatttttagatagattcagtttgaaatgcttatcagatataagatgatagatgctgagaaagcagttttgttttgtttttttgatggagtctcgctctgtcatcaggctggagtgcagtggcatgatctctgctcactgcaacctccatcttccgggttcaagcaattctcctgtctcagcctcccaagtagctgggactacaggtgcctgccaccacgcccagctagtttttgtatttttagtagagacggggtttcaccatgttggccaggatggtcttgatctcttgaccttgtgatccgcccgccttggcctcccaaagtgctgggattacaggcgtgagccactgcacccggccgagaaagcagttttatatacaagttcaggaaaaaggcatgggctggatatatatttcaaattctaaaagactatcaattgtaatacgtactactttatgtgccaacaaagaaaaaaaaggttgttaattataatatgtcttcatacaaatgcattccaatttcagaaatgctaagatctgaaataattatgaacctcagaactgataaaaatacagtaaatttggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaatacagtaaatttgtgagttacataaattatatttgaagctatgggatagataagattatctaggaaacagatataggattaaactctgagaacactccaaagagtacaggatatgaagatgagaaagcagaggatgctgaggagagtccaataaagaagagaattagtagcctagaagccaagaaaaaagcatttcaaggaagagagagtacagaacaatggccaggcatggtggctcatgcctgtaatcctagcactttgggaggctgaggcaggcgggtcacctgagttcaggagtttgagaacagcctggccaagatggtgaaaccctgtttctactaaagatactaaaaataaataataagaataataagaataataaattagctggatgtggtggtacaagcctgtaatcctagctactcgggacaagaattgcttgaaccaggcagaggttgcagtgaaccgagatcttgccattgcctccagcctgggggacagagtgaaactgtatctccaaaaaaaaaaaaaaagttaaatgctgctaaatcaagtacagtaagaactgagaactgacttttggaattagctacatggaagtaatttatgaccttgacaaaataagtttggatagagcagtggagataaatgcctgactggagttgagttcaagagtgtgccaaaaaaagaaatgaagtggtaggtagatgagaaatggggtcaaaaatggtttaggaacttgtgaaagttctcttttgactgctcaggatgatcaaaggacagcagtcagggaaaaaaatcactatatattctagtaacattgatctggtttactaagcaattttgggagcaaatctataaaagtaggctgataaaaaactaagagggctctgaatgccatagtcaagagtgtcaaaccttattccgtaagcaattctacaaacaatgaaagtttatgagtgtggaaggaagatcagggatgtgatttctttttttttttttttttgagacggagtctcgctctgttgcccaggctggagtgcagtggtgcagtctcggctcactgcaaactctgccgcccgggttcacaccactctcctgcctcagcctcccgagtagctgggactacaggcgcccgccaccatgcccagctaattttttttgtatttttagtagagacggggtttcatcgtgctggccaggatggtctcgatctcctgacctcgtgatccgcccgcctcggcctcccaaagtgctgggattacaggcgtaagccactgtgtcaggccagggatgtgatttcttttacagcagtaagtagactggattggaggaactcatagtagaggaacttggaagacattcagtctcaggaaaaaggaggctctcaaaggaattaattataagcaggggatataggggtattgtgaaagaagaacagataaatcccattgtatgaaacagtatgtagaacaagtgaaaggaaaagatgagacaagacaaaacattaaggttttaaacttacatacctcagagaatgaggtcattatcagaaagaggaaacattaaaggaagagcaagtatcaagaaatgatgagcttgctttgaagcactcagaggacacgatggggaatctcagcaagcactgggagatgtatctggagtgatgcagagataatagtgatagagatatttgggagtctgtattctacactaaggtaatacctgatgctaagaatgaataaccaccatcagagcatgtagagaaaacaaaattccaagagcataacctgcctactctttagtgggcaggaggggaaggcatggtacaaataagacagaagtagcactcaggtcagaagagaactatgagatcacagaaagatatcaaaaaagtgctcaacaacattatcgaaatgctgaaaacaaatgggagtgatttaaagactaagacaaagcttttggaatcagagactgggaatctactagtgaatattaagagagcttcagatcagtagtaggaataaacacagagaagctaaaataacttagatgtaagtgcaagttgaaaaatgaaggttgggtatattttcaggttacggagaaggagcagaaaaagcctaagtaaagatatacaagacaggatacttgaaggaacaagatatcatggagagggcaaaaacaggatcaaggaaatgcaactaaggatacataatacagaaaaaaatgagaaaaacgagatttggaagaggtaagaatggtaaaatacaacacaattttgtgacgggagaaagaagaaacataaagaagcccagagaaatctattttcctgatgaaatgagcaacagtataaaaagtattaaataaatattaaagtgaactaacctgagataaagagggaaaagatttaaaatggaaacttaaaatactgtaaaaaagatctggagtaactactttgggaaaccctagaggaacaacaaaagataattaaagaatcattgagcagcacgaaaggcacatataagatagtccattaatttcccgtgggtttacctggactagggtcaatgtttgctaacagctccaaatggggtcttagtcggttcaagtttgctgggtctccagttcgctggagagcaattgttagttcctgaacactctgtgcaaaagaggctggagtctgcaacttaaaaaagataaatgttaactttcccaaaggtcagataatcctttaaatataaagattatttatatcacaatcatttttgcgatttattaaatttaatttttatcttcccatataccctacactttggccagagtagattacttgctacccaaataaattctgtacttctctgcatccagagcttggcacattgtgtactgtattgcctctgctgtcacattcttcaaatgtgagacctctctcaattcagcctaccatcaattagatatactgatgagtcttctttgtgaattgttaattcctgtttctctccccattaatttactagaattagtgctttcctcatcgcttttaataaattctcttttctattatccaatatggtgaccttggcaatatgtggctatttaaatttaagttaattaaatgaaataaaaatttcagttcatccgttgcaaaagtcacatttcaaatgcttaatggccgtgtgtgactagtgatcaccatattggacagtgcatacacagaacattttcatgattacagaaagttctattgctctataaaatatcacacacactgcaaagtttaccagtttgttgtgcaaaggtctctggatattaaatttaaagcactgcgtgtgatatgagaaaattactgtaggatatacacctagttacacagttcagttcagacaagattaaccaccttgtagaatctttataaaagacaagccaagccaggccaggcacagtggctcacgcctgtaatcctagcactttgggaggctgtggtgggcagatgacgatgtcaggagttcgaaaccagcctggccaacatggtgaaaccccgtctctactaaagatacaaaaaatttgggcgtggtacagggtgtggtagtgcgtgcctgtaatcccagctacttgggaggctgaggcaggagaatcgcttgaacctgggagacagagattgcagtgagccgagatagtgccattgcactccagcctgggtgacagggtgagactctgtctcaaacaaacaaacaaacaaaaaaagccaagtttctcttcagaggtagaaaggtactcctctaatagatcattactaagcgttaagcgtttccgtaaattataaatgagttgcaaaacttccgatacaagctcctgtccaaacctaagagttgcaggtaaagtctggttaaaggtatccagggaagacttatagagcagagcaaacaacctacattgtaactgaaaattatgtaccgcctttttatcccccctaaagagacagggtctcactctgttgccgaggtgctaacatagctcactgcaccctcaaactcctgagctcaagggattctcccaccatagcctcccaggtagctgagactataggcgcctaccaccacacctggctatttttttttttttttggtagagatgagtgtcccaatgtttcccaggctgtgactgaactcctggcctcaagcaatccccccaccttggcctctcaaagtgctgagattacaggcatcagccactgtgcccaccctacaccaagcatttaaaaaacatatttcccaattctcactgtattacccattcaaggaattctatctttagaaataggaaaaaaaaaaaaaaaaaaaaggtgggggggaatagtctggtaaaaggttagtgtactctacactgagaatggtcaagttcaaatccacttctgtcatttattatctatgtgatgctggaaaaacatattaacttccctttgtctttgtctaaaatggataatacagggctgttgagaggattaaatgaattatttaaaaccactagatacatattaagattttagtaaatgttcattattttttttttaggttactcttactatttgactctatttctctaaattaaatgtagagtggtctctagagttggccttcatctctgtgattctagtaaaaatacaataaaatataaaataagtaaaataaaaaatataaactaatcaaatctttaaatgaacaaagtggtattataacgtgattggttatgacatgacactggctataaatacaatttacaaaagctatacagtattcactttaatatacatttgttaaatgaattaccaaaatgccaagattagtctaagaagtaaggaacaaaaaaggtcctaccttgtcaataatggactgcatatgagatttgtgagactggtctccataaagcaaagaggaccactggtccggtgcaattcgtaagcctgcttccatagcaatctgcactatctgggagtcatgttctcgccgcagagcttcataggttctaaattcttctttcagctgcatcaaagaagagtcttcatcacgtttggtgacctaataagacacaaataatctcataatgaagtcaaaaaaatgagtttatgctttatatgaacatataatttttaatgtaacaaatttagcatcaacagcaagattaaatgaatataccatttgcctgcaaaatattttctccttaacttgttgaggtaggtatattgctatcatcccattctgagtcaagttggatttaggccaacattttctggataggtctttcagaaagaataaatacaggctgagaatctcttacccaaaatgcttgggccagaagtgttatcagatttcagattttttcaaattttagaatatctgcattaaaccacttgagcatccttactctgaaaatctgaaatgccccaatgagcatgtgagcatcatgttggtgttcaaaaagttttggattttggatttttgtatagtcaatctgtatgtgctggaatgaaatccaaagatttgacatactttaacatatacattcagtttaaggtgtatgtgtgtgtatatgtatttttgaaaagaaaaaaatactaatacaattctatattctgaaaaacaatatgtttcttctccataaatgtggattatgactcttgggattgcctgacaatgagctaggtgggactgatgactgtagagcttcagatgctggtgtaattctaaaaatgatttaatttgtacttggcttaattcttcatggagttttgtgggatgggctactaccagaaagtgtaaagtgtgagatgctagactagaataatcataatgattatgattagaaggctggaggcaggagaattgcttgacccagaaggcagaggatgcagtgagccaagactacaccactgcactccagcctgggcgacagagcaagactgcatctcaaaaaaaaaagtcagaaaaataatactggatgtacaataaatgatacatagtgagtagcaatgtttgaggcggtgcttattcaatttgggataagagactatgtccagcattaccatataaactgaaatggcaaatggaacttcattattgtatatgtggaattacactaggagaaaatctctgaataaaatttatttggctgggcgcggtggctcacgcttgtaatcccagcactttgggaggctgaggcgggcagatcacctgaggtcaggagttcgagaccagcctggccaacatggcgaaaccccgtctctaccaaaaatacaaaaagtagccaggtgcagtggccctgcctataatcccagctactcgggaggctgagacaggagaatcgcttgaacgcaggaggtggaggttgcagtgagccgagatcatgcactgcactccagcctgggcgacagcaagactttgtctcaaaaaaataaaaataaataaataaaatttatttgtgcttcaataactctctcttcagaccaattctgcacagtcttggtaagaaattgatatagtttcttagtctcttcaaatacaaaaatctataaaccttgacttgatctatgttgttcaatattgaacatacaaaaattcaatataatagtatttaactataataagaccccatctacattctttaaaagaataaagaaaaattgctgagattttctgaaaagatacaggcaactttattaaactcaaagttttactacttaactttggggaaagaacaatatttcctttcaagctgagctttaatgtaggttcataccttgaaacaggaggctctataaaggagctgaacaacatgcccaatgctagttttagaggcttgaggaaaccgtggctccaatctttgcaccacaaacagaaccaatacttttcttgacaaagcagaaccatcttctaaggccagcagaaccaactttaaagcttcctcctgcattgctagggaaagttgggcaaaaccaaaatttatcaagtacatagataagataaatccatttattagaaggggaatatttaatcatttctgcagctattcaattaactggcaatacagttaagattaaccagcaacacacttttacaccatttttgtgagcaattttgtattacattctatatattttataaagaaaacagataaagtgattaataaatttaagaaaaacttctatcaaaatgaatgaacttcctgctacaggtgtgaaaaaaaggaaaaatcaaaaaattaaaaaaagaaacaacttttggcattaagagaaaagttttaagttcactaagttcacctagtaagtccactaagttacatggaattgcccaagccatgaacatcaaacaagatattagttggtaacaataaaatactgcaaagaactaggctttgtacatcacttataattcctacatcatacttttagaattaccagcagaataaatacctaaagttaattatgtacctggtccaaggaactggcatcccctagcccttactgctgcccaaagattggaagagagttgctgaggattctggtgctggagaatgagctctgtaactgttcgttcacctaaagatcgagctgccctcatggcacgaatcctgccttcttcttctactagttgacagtggactagagtcacaagcttcctctgcattgggcgactcagaacactctgagtagtgctgttcagacccactcctttaaaagagtaaagaagttattcctaggttcacaatgcaattttacagtccaggagcaattcttctgttgggttaacttgtgggtatgtgactagttctgggactactagagtatttaaaataagcaacaaataaaaccacacatgtaaagcttacttaagtatacatttttaaagtatacaaatgtatacatgagttatctcatgtgcacttagcattcattatgacattaaatataccattactcattttaatcatagaggaagaaagaaaaaaggactagacaacattgataattagtttataatgtaaatcttgaagtcctaagagttctggtatattatttgacagtggttaaccttattttcctaattaaatagcaagccctttctgtgcagtaatggcaacttccgtattcattataccgcctatagcatagcatataaaactggatagaaggcaaaccattcagaattgtcaaatgatggaaagcactgctgaagtaagtagttatatttgctattatcatcattcgaataatgtttccatcatcacataaactaaaaattcactattttatttgatgtggtttgtgtcatgatatttagcacaaaatgagtttagtttacaatagataaatttcattaacatttgcttaatagctcacaatttttatggtaacaagtctctttagtagacatttacttagtatggataattgcatcaaatttacctctagttaggttttttgggaattcctcaggacttatataggattatgtactgagtatttaaaaaagcagttttactctttaaataagaaacaaaaacaaacttacctctagcactgctgagcggttttaagtacaatgctaattcttctacacatttcttggcttcctcataatgctttgtgtcttcaaccccactacacaaagtaataggctgctgctcagggacctggaggccaaaagaaaagatctgtatgagtgctcaattcattaattgttttatttagtatagtttatgcactcataatgctgacactggtaacatcaaaacgcccactaaatttactgaattctttcaaaagatctttcctattaacatgtatctttgcattcctttgttttgtttctctaacagcctaattaagatataatcgacataccatacaactgactggtttaaagtacatacaattccctggttttcagtatattcacagttgtccaaacataaccacaatcaactttagaaccttttcattaccccaaaaagaaacacagtacccttttaacaattaccccttatttcttcccaaccatccaccaacctttggaaagacgaatctattttctatggatttgcctattctggacatttcatataagcaaaatcaatacaataaatagtcttttctgacttacttctttcacttaacaatgtgttcaagggtcttccaggttgtatcagtacttcattcattttcatcactgaataaaattccattgtataaatatatcacactttatttacacaatcatcattgacagacatataggttgtttctatttttgactactacgaataatgctgctatgaacatctgtgtacaagtttttgtgtagacaaaagtttttgtttctctttggtatatacctaggagtctgtatttaaccttttgaaaaactgccaaactattttccaaaagcagagtagcattttatatatctaccaggagtgtataagggttccaattcttctacattttatgtagaaagataattcttctactcattatctttttttattatagctatcctgttgggtgaaaagtagtaattcattgtggtttgtctaaattttattttaaattaataataattgcatatacttatggggtacaatgtgacgatgtgagatgactaaatcaggttaattaacaaatccatcacctcactttttttttgtagattttaaataaaatctactcttttagcaattttgaaacatacaatgtattactatttatagtcactgttctgtgcaatagatcactaaaggcattcctccagtctaactgaagctttgtattctttgataattatctcttcttcccatctaccttcctcccacttccctgtggttttgatttgtatttccctgatagctaatgatgttgaccatcctttcatatgcttattatccatttgtatatcttctctggaagaatatctattcagatcctttgcccattttgcctagtaaactttattttgtagaacagttttagatttacagaaaaatggcaaagatagtacacagaattctcattatcctgtattcagtttcccctattattattattattatttttgagacggagtctccctctgtcacccaggctggagtgcagtggcaccatctcggctcactgcaacctccgcctcctgggttccagcgattcttctgcctcagcctcccaagtagctgggactacaggagcaagccaccacactcgactaacaatttcccctattattaacatcttacactggtatggtacatttgttaaaattaatgagccaatatcaacatattcataattaacaactaaaatccatgttaatcagatattagttttcacctaatgttctttctcagtttcaggatcccatccaggataccatattacacttagtcttcagagaaagagtctcgctctgtcactcaggctggagtgccgtggcagcatctgggctcacgccaccacacccagctaattttgtattttattgtagagatggaggtcccactacattgcccagactggcctcgaattcctgggctcaagccatccacccaccttggcctccctctctccctccatgtctctccctcttttttttttcaaagttgagacaaagtctcactctgtcgcccagattggagtacagtggcacaatctcggctcactgcaacttccacctcccaggttcaagagattctcatgcctcagcctcctgagtagctgggattacaggcatgcgccaccacgcctggctgattctgtgtatttttagtagagacaggatttcactgtgttggccaggctggtctccaactcctggcctcaagtgatctgcctgccttggcctctcaaagcgctgggattacaggtgtgagccactgcgctagcccttcaatatctctttaagctcctcttggcttggacactttctcagactttccttgttttaatgaccttgacagttttgaggagcactggtctggtatgttgtagaatgcccctaaactgggatctaggatctgtcatttttctcatgagtatattggggttatggatttttggaagatcataggggaaaagtgccattttttatcacatcatatcaaagctacacaccaccaacacaacttattattgctgatgttaaatttgaacagctggtttagtcagtgtttaccaggtttctccactataaagttacataatctccacaaactgtactttttggaaggagtcactatgcgtagcccacacacattctacatccttgagagcagaatatctatgtaattaatttggaattctgcacgggagatttgtttctttcttccatctatttattcaatcatttaattgtatcgtgtagactcaaggatatttatcttatacctgggttatgatccaattccatttattttgttgttcaaactgttttagctttggccattgagagctctttcagttggctcctgtgtgcctttgatatagcccccattactctgtgtatgtgtctgtgtgtgttttgaatacttctctatactttccagtgctacaagctactccagactcatttcgtgtatttcctgtcccagtcttagaattagccatttctccaaggaactctggttccttttattggagaatggtattagaaaccaagatatgaatgctatgtatgcacattactattggggtgttgttccttctaggccatcttagatgacagaccaaggaaatatgtcactgtaataacccgagatatacattgtaataacccgagatacacacgagatatctcgtatatctatttctgtatataaccatctgtatccatatcaagctaaaaatgagttcatactgatgcctccaactccaatccattatcacatgaatcactctaacctcttcctccttgtttatctgttaactggctccaatcatttcccattcacttacttaactgttcaattctaatatgtattatacatacagcagtatcagaattaattcgtacccccatgggaaaagactagagtacactgcttatagataatatctttctctatctttaatcttacacaatctacctttctcctacacccctttagtgaaattgtttcatatacttcagattgtcttccataatctttgtaaagttctacagtttttgacaaattcagagtgtcatatagccacaattacagaatcataaagaactgttttactgccctaagaaatactgtttcaccaattctatcctccctccctactcctgaatccatggcaaccactgatacttttattgttgctatggttttaccttttacagatatcacataattggaatcatacagtatgtggccttttcatactggtatctttcacttagcaatggtatacattgagatatatctatgtctttttgtgacttgacagctatgtcttttcattatttcattttatacaatgtgccattgtatggatataccactgtttatccattcacctattaaaagatatctcaactgcttccattttttggcaatcatgaataaagctgttataaatagtcatgtgagggtttctgtgtagacataaattttcaagttaactgggtaaatacctactatgttaagcttataaagaaactgccaaactgtcttccaaagtagctataccatttttcatttccaaaaagatgagagtttttgttgctccatatcctcaccagcatttggtgttgctaatgttttggattttggccattttaatttgtgtgtagtggtatctcacttgttttaatttgcaattacttaaagacaaactgctgagctacttttcattttgccaattttccaactgtataatctacttgacgaggtgattgttcagctctttgtccattttaaaaactgggttgtctttttatcactgagttgtaagagttccttatatattctacatataagtctttatcagaaataggattttacaattgttttctcacattctgtaggttgttctttttgctttcttgttggtatctttgttttttgttgttgctattgtttttgagatagggtctcattctgttgcccaagctacagcgtagtgctgcgatcgaggctcactgcagcctccatcaggtgatcaggctcagatgatgctgccacctcagcctcacagataggtgggaatacaggcatgtgccatcacacccagcaattttttgttgttgttgttattttctgtagagatggggttttgccatgttgcttaggctggtctcaaatgatccatccatcttggcctcctgggctcaggtgatgctcccacctcagcctcacagacaggtgggactacaagcatgtgccaccacacccagcaaaaaatttttttttgtattttctgtagagatggggttttgccatgttgcctaggctggtctcaaatgatccatccatcttggcctcccacagtgctgggattacagacgtgagccactgtgaacagccaattgttcgtatctttgaaatatagtttttaattttgatgttcaacttatctttttcttttgttccttgtgctttttggtgtcacatcttgaaaaaaacccactgcctactccatggtcagaaagacttatgtctatattttcttctaagagttttgtagttttagttcttatatttagcctttgatccattttgagttaatagagtaaatgtttattcaagtttttttttttttttttttttttttttgagacggagtctcgctctgtcgcccaggccggattgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggcctattcaagttttaagctacttttaaacaacgatttgtagtcttcaaaatatagttttacattttttttttttttgacagagtcgctctgtcacccaggttggagtgcagtggtgtgattttagctcactgcaacctccctctcctgggttcaagcgagtctcatgcctcagccccgagtagctgggattacaggtgggcaccttcacacctggctaatttttctatttttttggtagagacggggtttcaccatgttggccaggctggtcttggaactcctggcctcaagagatctgctagcctcggcctcccaaactattgggattataggcatgagccactgcacccggtctaattttacatttcttttgttaaatatattcttaattttttttatgctcttgtagatgaaattgatctattttcagattgtccattgccagcgtatagaaatacaacatatatattacttatttaacagtctttattaagggcctatgtaccagacagtctttcttacgtgtgtaagaaaagtattattattattatttattttttttttttgagacagagtgtcactctgttgcccaggctggagtgcagtggtgcgatctcggctcactgcaagctccgcctcccgggttcacaccattctcctgcctcggcctcccaagtagctgggactcctgcctcggcctcccaagtagctgggactacaggcgcctgcaaccacgcccagctaactttttgtatttttagtagagacagggtttcactgtgttagccgggatggtcttgatctcctgacctcgtgatccacccgcctcggcctcccaaagtgctgggattacaggcgtgaaccactgtgcctggcctaagaaaactgttattaacatactgtggatgaaagtatgcaacactagctgggtacggtggctcatgcctgtattcccagtactctgggaggtcgagacaggtggatcacttgaggtcaggagcttgagaccagcatagccaacatggcgaaaccctgtctcgactaaaaatacaaaaattagctgggtatggtagtgcacacctgtaatcccagctacttgggaggctaaggcatgagaatcacttgaacttgagaggcagagattgcagtgagccaagatcacaccactgtactccagcctgggtgacagagcaagaaaaaaagaaagaaagaaattatgaaacactgtaaacacatttttacaccttagaaagacttttgctttttcagacaactgatacttatatactcatcttatatcctgcaactctgcctagttttttgtttctaatagcttttcctttgcagattccttaacattttctatatataagaccatgtcatctgtgaatgagattgtttttattttttacttcttatctgaatgtcaccggtttcatttacttgcctaattgccctagctagaaggtcctgtatgatgttgaacagaaatagttaagagtggagatccttgacttgttcctgatcttacagaaaaagcatctagtctttcaccattcagtatgttagctgtgggtttttcatccatgtcctttgggttgaagaagtttttctcctagttgtttcagtgcttttattatgaaaaggtattggattttgccaaatgctttttctgtgtctattgagatgatcatatgtgtgcaattttgcaacttttactgatatagtgaattacattaattgatttgcagatgttaagtcaaacttacattcctaggagaaattggtgattatatattttaaagtctaatttattttttctttttccttttagatgaaaggaaaatttgggaaaattttattttttttattgtgataatatatacataacacaaaatttaccatcccaaccatttttaggtttataaagcattaagtgtgttctaatggttcccaaatgttgtgctatagtttttgtcacctttctcatctttcatttcagttaatgtctactgagtaaaactgcctgaagcagctgcaccttctctactgagtaaagtgcagtggttttatgaacaatagttttctcaatgttaaaaaaggtccttatgacttacctcttaggtttcttttctttttttgagacagggtctcactctgtcacccaggctggagtgcagcacgatctcggctcactgcaacctctgcctcctaggttcaagcaattctcgtgtctcagcctcccaagtagctgggattacaggcacacaccaccacacccagctcatttttttgtatttgtagtagagacaggatttcaccatgttggccaggccggtctcaaacacctgacctcaaatgatccacccgccttggccctcccaaagtgctgggattacaggcatgagccaccacacccggccttaggtttctctagcgatctgcatagctaggtttattgaatatctgacaagattaaatggatgttactgtactatgactaaaaagcactggactaccacaataaatctaacatgctgaaataaaggatttacagtaccaaacagaattatacctatttaaatagaaggcaatgttacccaattttaattcaacaggtttctctcaggagaaaaacacgcacaacacacacacacacacacacacacacacacagagagagagagagagagagggagaaatttaaaagtattaagtcacccatcctacctgagcacccacgagctgcagcaatgctgagttcacagggaggagctcaatgtctgtattgatagtggtctggtcaaatgggcaagccttgcggtggagtttattcaggcacatcttgcagacagtatggccacaacccaaactgatgggctttcgaattgtttcgtcgaaagtctgagtgcaaattgggcaggagaggaaatccgtccattgtggagcttgtacaggcattgcttctggagttacaattcacgaacacaaacacacacacaaatctaaagcaaagattccactggaatcaaaatctttgaaaaaaagtttatcttttttttttttaaatatcttctgtagatacagtcagcacatagtgtgaaatataacctgaaaataaagaaaaaggaaaaaaattgagtgtctttcttttcaattaaactgttgaaaaagaaccacaagtccagtcttattccacaactttttataccacatttgtatcactgtaatccatctttttacacttttacagaattagagccatgatagaacatctatttccattccctcattttagagatgggaagtagtcccctgcctaagaggaaacttgaagttaataataaagttccatccaggaccctagtctcttaagtttatctaagtcttttttttttttttgagacggaatttcgctcctgttgcccaggctggagtgcaatggtgcaacctccgtctcctgggttcaagcgattgtcctgcctcagcttcccaagtagctgagattacaggcatgcaccaccacacctgactaattttgtatttttagtagagacgggatttctccatgttggtcaggctggtcttgaactcctgacctcagatgatcctcccgccttggcatcccaaagtgctgggattacaggtgtgagccaccatgcccagctaaatctctaatttttaaaaaataaatatatctaaaaaataatcttggctgggtatggtggctcacgcctgtaatcccagcaatttgggaggccaaggcaggcagattccttgaggtcaggagttcgagaccagcctggccaacatggtgaaaccccatgtccactaaaaatacaaaaattagccaggcgtggtggcaggcgcctgtaaccccagctactcaggaggctgaggcgggagaatcgcttaaacccgggaggcggaggttgtggtgagccaagatcgcgccattgcactccactctggggaacaagagtgaaactccatctcagaaaaaaaaaaaaaaaaaaaaaagctttgttggggaagggggtagagggagggaagaattactgaacaagacataaataacttttgacagccaggcgcggtgtctcaggtttgtaatcccagcgctttgggaggctgaggcgggtgggtcacttgaggttgggagttcaagaccagactggccaacatggtgaaaccccgtctctaccaaaaatataaaaaattagccaggtgtggtggtgcatggctgtaatcccaggaactcgggaagctgagtaaggagaattgcttgaacccaggaggtggaggttgcggtgagccgagatccgccactgtactcctgcctgggcgacacagtgagactccatctcaaaacaaacaaacaaacaaaacttttgacaacataagaatattttaaaagtagaaacaatttatataaacatatgtttcctctgtatttataccacaatcttgacagactcatacaaatttttcaggctgggtgtgatggctcatgcctataattccagcactttcagaggctgagatgggaagactgcttgagcccaggagtttgagaccagcctaggtaacatagggagaccctgtctctacaaaaattagccaggcgtggtggcatgcacctgtggtcccagcaacccaggaagctaagggctaaggtaggaggatcgcttgagcccaggagtttgaggctgcagtgagctacgaacatgtgactgcactccagcctgggtgacagagcaagaccccatctcaaaaaaaaaaaaaaaaaagaaaaaagaaaccttattccattcccaggaaaaatttaatttagttaaatgacaaaaaaatgttttattggtctttactatgtgttcagtactaacgataaaaaaaagataagtcattctaagtccacatggagcttgcactgtttctttcactaaacatataaacagcaatcacataactaaatatataattgcaagttatggtaagtgatatgtaggtaaagtacagggagatacaagcatatataacagaggcaacctgaccaaattagggtggagctgatgtacaggtaagtgatatttatggtaagattttaaagatgactgctgaacgaaagttaagggaagaataatgtttaatatgtgtggtatagattctaggtaaagaaacagcataaccatagattctgagactagatagaatatagtagagatgaggccaggcatggtggcccacacctgtaatcccagcactttgggaggacgagacaggtggatcacctgaggtcaggagtttgagaccagcctgaccaacatggagaaaccccgtctctactaaaaacacaaaattagccaggcatgggggcacaatgcatgtaatctcagctacttgggaggctgaggcaggagaatggtgtgaacctgggaggcagaacttgaagtgagccaagattgtgccactgcattccagcctgggtgacagagcaagactccatctcaaaaaaaaaaaaaaagaaaaagaaaaaaagaattagcaaggaccaaagaacacaggatcttctaacttatatgatggtatttggttactatatgaagagtagtgtaaagccactgaaggggcaggaggtgactcactttattgttttcaatgttctcctgtgatattattctcaccaatcacacacagtccactatgatctccttcaaggctcaactaggaagagtaacaactatatgtcttttctcactcttgggccctaaagcactcatatgctgctacaccagcatgatgcttactttaagaaaacctgatatgtaaaaatatggaaaacagattgattacagtgattgtccatattacagaaagataataaactttaccaaggtatttataataagatttaaaagaccagaaatcgatgcaattgaaaaaattgggctgggtgtggcggctcacgcctgtaatcccagcactttgggaggtcgagttgggcaaatcacctgaggtcaggagtttgagaccagcctggccaacatggtgaaaccctatctctactaaaattacaaaaattagccaggtgtggtgatgggcgcctgtaatcccagctactcgggaggctgaggcagttggactgcttgaacccgggagggggaggttgcagtgagccgaaatcacgccgttgcactctagataaacagagacataccagtgctatgaaaatgtatggaaagagactcaaaatacattaagtaaaaaaaaaagccttgaagaccaatatatatgacatcatttgtgctgagggaaaagaacccttacatattagtctacgtattaatatatgtaaatgaatggaagaaaaaggtctgaaaagacactcaacaagctgtaagcagacagcaaggtcttcatggactataggaattaatcaacttgaacaatcagcctgttttatagcctcctgccttgcagcctatttttgcctaaaccctgtgtagaatgcagtcacctagacagctggaaccagttcctcacagaccctggccactcacagataaacctgagtgaactttcctcgttaccatgctaaagtctccatcctgggagaagctatagcttcactaccatagcatgtgacctacgtccgggcataaagactcactatatgtgcaccactgggacccctcctctacatgcagtgacataccctctcttccctctccatcgccccataaaaccctcctctcactttccctcagagacccactgctttggagaatactcccagtgctctccttacttgtgacaagtaataaaacttccattgatcaaaatctgtgttcttgtggagtcattttttacttgaaaggcaaaggaattctgttttttttttgggtaacaaaacttaacggcactgccaggcatggtggttcacgcctgtaaccccagcactctgggaggtggagacaggtggatctcttgagcccaggagtttgagaccagcctgagcaatcaagtgagaccccgtctctacagaaatataaaaaatttagctggacatgggcacctgtagtcccagctatatgggaggctgaggcaagaggattgcctgagcccaggaggtcggagctgtagtgagtcatgtttgctccactgcactccagcctgggcaacggagcgagacctgtctaaaacaaaacaagacaaaaaaacttaatggcagttacacagttgggcaacttacaaaagtatgtaatcatgaattacttatataagtacaaataaattgaaagagtaacacaaagctagagtacacttagagtacaatttaagcttcttaagataatcactctaaaacgattcaaaacatttgtcctaatattattaatcttcttttacacatttagatagccaaatatcaaaacttattagttcttttcaaaatttaagaaccttaaaatagtttgtaacttatcccttcaaagaattagcattcctttattaattttgtttatcacctccatctctattaactttgtaaagtaaggtatgtagttgttaatctcttaaattttctagtaaaatagttctttgacacaactataaacaacttgatagaataaaaatacaaaaatcagcaatcagttcttcattaaaaataaaagcattattttgaccataaatacaggtttgagagaccaaggggaaaataatattaaaccttgactttttctgggaaatttgatgattaataacagaaagtcactcttagatgaccctatttcaggacttaaaaaatcacaaggcaaagatttttttgagactcaaagtgtcagttaattgtagatcatagatctaagaagaatttccatttcctcattctttaagtatctttctctaaacgcattcttccaaacattctccaagcttctcaaagacagtttatatactcttcaaccacaacatgtatctaaaccacaaaagacatgatttactaaatacaataagcattctttcagtcaaaagtaaacatatgaaataaaattattaatataccaacatccagattttttgaacttcctcagaaaaaggtatgtcagcaaactaaaaaagggccacaaaacaaaaacagctgtaaataattctactaatcaaagcacatgcattcaaggcctgcagataaactgttgggggtcaggccaaatctagttcattaggagtatttctattggaaccttccaattgaaacagaagacaaatgatgagccctctttatttccaaaaagattcaaaagagtgacactgctgctcaagtatgaaagcaatgattagtttccccaccagtttaaataaggacacctctcctacaaaaatgacgagattttactgttgataattgctaatacagaatatacatgataattaaatagcaatcagttcaagggtctgacctaagacccaagttcaaaaataccatataatttccccaattatatatacacatttttacaccactaaagagtgctcacagaaaacactgaaaagactgctttattcagttatatgccttgttcatggcattgactgaagctacagtacagaatatcacatctgacatttcactattaatttatcccaatgtctaaattctggttaagaaccaccactttcttaaatctctaaacttttatcactaatattaccatttgactttactcaggttttttttcttaacaaagaaataaagatcttattatcaaaataaaaaaattatttcagctaggtgctgtggttcacgcctgcaatctcagcacttttgggtggctgaggtgggaggatcacttgagaccaggagtttgagatcaacctggccaaaaaggcaagaccttgtctctataagcaaaataaaaaatgagcagagtgtggtggcacgtacttgtagtcccagctactcaggaggctgaggtgggaggtatgcttgatcccaggagttcaaggtttcagtgagctatgaccacaccactgcactgcagcctgggcaacacagagaaaccccatctctaaaaaaaaaaactgttgggcgtggtggctcacacctgtaatcccaggactttgggaggctgaggttggcagatcacctgaggtcaggagtttgagaccagcttgaccaacatagagaaaccctgtctctactaaaaatacaaaaattagcaggcacatgcctgtaatcccagctactcgcgaggccaaggcaggagaatcacttgaacctgggaggcagaggttgcggtgagccgagatcgtgccattgcactccagcctgggcaatgagagcaaaactccaccaaaaaaaaaaaaaagagagagagagaaagaaagatatgaattataaacaacaaggctacttgcttgggtccaccagctaagtaactagtttgtagataccaaactccaagtcttacagctcccttagctgttaaattcaaatgtatgcctctgcaaaataacaaataactacatattgtgagcatcgatgtttaagtatgattaaaacattgtcaatgagcaactacagacaaaattgtgatgacatgatgcatctggaaagacgtagaacagctttgttttctgaaaatcaatcatgtgtcagtcactgtgctaggtgttttcagatgtttctcttatttaaatatccacaatgtggactaccaccaataaccaacatttgtgaagcaaaaactaggatattatactttcagtgctctatatacagtatctaattaatgttcacagtaacactgtaatgtagttattatgcccattttaaagataaggaaaccaaagtacccaagtcacaaagctagaaagtggcacgactaagactcaaactcaggacagccaaactcccaggctggtactttgaaactctataatttgtgccaccacacgaataaaagtttatagtaattatggcaagggagctcttgggagtgacagaaatgccttaaaattgtatggtagtaatggttgcacaactctgtaaatttactaaaaatcatttgtgtatttaaaataagtgaattctatggtatgtaaattatacttcaataaagctgttaaaatagtcattaagggctttttaatagtcttagttttcaaaaatgttaagtaataatgtagaaacatagaaactattcgaatctgttctatgagcacagcaatagccctattaaatagctaaattacattgctgtgaagatttcatttaaacatatgacacatttattaccatctcctttattataggttcattttatatgttcctgatttagagagagaaaaatggaaattaaaattcaactatctactctgagccaggcactcctctgaggcattactatgcccattttacagaagataacttgaggtttggcggcattaagtaacggccccaaatcaataaactgttgagctgggattaacaccaggtcttacatatctgaaatataagttggcctgtgaaaaatgtttttatcaaacaaaaccacactgtctgtaagaagaaaatcttggctctcttcccactatgcccgatgagatgagattttaactcattattcttgaccttaacttaatttttcatttctctggaacatttccatagcaaccagcatgtagggccacatcagagaagagaaaatgtttcactgccttgaaaaatgaagctagaagcaggagataaaaacacaaagaagaaaactaatgaaggcctattataacacttaattttttaatcctcagcagagcatcaactaatttacagtggaaatagagtctaaaatttgaggctcaaggtttttccagcaataatatcttgtgaacaaagacccagttttgattgtaaaaatacatcttcccaaaatgtatggactgaattgtaaccctatatatacaaaatcctggatgtaaataatttaatatgattatgttagtacaaatggataaatacttgggacaggcataaagagaagggcttctgagttagagggaaaaaatagcttgaaaaatagaacttgataaagaaaggtggaggaaagttcaaggggttaattcaggttgcttactttttcagcgttcagaggcaaaaagaaaaatttctatctccaacctaataccagattgaggagaagtagtaagaaaggacaaaatcattcatggagaagccgcctgacctgagtttgaaacagagtgcctgagaaagtaagacagtctttaactttacgtatgtagtttgaatctccaggttcaagttatgcattatatacaaatgtgctacactaaagagggcattagccctcattaattatcaaagaggtggcagaatgatgtgaccagactcaaaggcatcatctttttttgtttttgtgtttttgacacagattctcattctgttgcccaggctggagtacagtggcacgattttggctcactgcaacctccacctcctaggttcaagccattctcatgcagagtagctgggattacagatgtgcaacaccatgcctggctaatttttgcatttttagtagagatggggtttcaccacgtaggccaggtctcaaactcctggtctcaagtgatcagcctcagcctcccaaagtgcagggattatataggcatgagccaccacgcccagccaaaagcaccatctttaaaggtagtagaaaggaaaatttaccgattaagcaaaaaagcaaaatgttttaattttttcagtttttgcattaacactctgttgaatattacatatactatactatcaagtaaataaatttataatcaccaatttagtgttagtacaaacactaaggatgtaataaaaactggttactaagatcaggagtatttttagtatacattgagcattccagtttactcattaccctcaaaaaattttacaaaattgtttgctttattatcttaactgcttttaaattaatcataaatttctgaaactgtttttttgttgggggcgggggaggtaaaagttgacatctccttcttaatcaagcttcttttctaaatcagaaagatatttcaatcccaaaatgaaagattcatgtatacattttgaagatgaggccaaatattttaacaagactaaacagttttccaggtcatcttttgaaatcagtcctcttgctgcaataatggttcatttttataaaggaagtttactcctcttgtccagttattttgagacacacaaatctgactggcaaataatcatgtgggatgcagggacaaataatcacaatggaaagaaaatctaacctgtgcctgataaatttatgtttcaggttgttaaatactatcctatagaatcctcaggaatatgatgaaattaagacattttagagggtggcactaatattctgtttcttcaacttgtccttcattattagttctttccccactggcatgcttaaatctttgttcaggagctgaaagaaatttgtctccaacttgtctcatctaaaaaagtcattcaatccttgtccctgtttccatccaccactattgtggaataattcttaacaagcacattaagaaccttatgaaattcaagagtcatatctcaattcttattttacttctttctatatagcatttaataatattaaagttactcctacaaaagctgcccttttctaggttctatacaacatactgtccaatgattggcaagccactccttgcccatatctattgagggcttcttcttctctattcatccttggaatagtgttggttcttagaattccttccccagttctcttccctagaaagtttccctgagtaatttcatctgtttttatgttttcaactaccaactagatcctgctgacttccaaatctctctctcaagttcagacttctcttctgagtgccagggccatataaccagttgactactaagtcatccatgttcatctcctccccaccaaaccttttgttctctttgtcagtgactgagtga
